US011667974B2

(12) United States Patent
Firat et al.

(10) Patent No.: US 11,667,974 B2
(45) Date of Patent: Jun. 6, 2023

(54) DIAGNOSTIC, PROGNOSTIC AND THERAPEUTIC USES OF LONG NONCODING RNAS FOR PATHOLOGIES AND TOXICITIES INDUCING HEART DISORDERS

(71) Applicants: Firalis SA, Huningue (FR); Luxembourg Institute of Health, Luxembourg (LU); The University Hospital of Lausanne, Lausanne (CH); The Cardinal Stefan Wyszynski Institute of Cardiology, Warsaw (PL)

(72) Inventors: Hueseyin Firat, Huningue (FR); Sabrina Danilin, Riedisheim (FR); Yvan Devaux, Zoufftgen (FR); Lu Zhang, Metz (FR); Przemyslaw Leszek, Warsaw (PL); Eric Schordan, Wentzwiller (FR); Samir Ounzain, Lausanne (CH); Thierry Pedrazzini, Lausanne (CH)

(73) Assignees: FIRALIS SA, Huningue (FR); LUXEMBOURG INSTITUTE OF HEALTH, Luxembourg (LU); THE UNIVERSITY HOSPITAL OF LAUSANNE, Lausanne (CH); THE CARDINAL STEFA WUSZYNSKI INSTITUTE OF CARDIOLOGY, Warsaw (PL)

( * ) Notice: Subject to any disclaimer, the term of this patent is extended or adjusted under 35 U.S.C. 154(b) by 0 days.

(21) Appl. No.: 16/622,059

(22) PCT Filed: Jun. 12, 2018

(86) PCT No.: PCT/EP2018/065492
§ 371 (c)(1),
(2) Date: Dec. 12, 2019

(87) PCT Pub. No.: WO2018/229046
PCT Pub. Date: Dec. 20, 2018

(65) Prior Publication Data
US 2021/0189491 A1 Jun. 24, 2021

Related U.S. Application Data

(60) Provisional application No. 62/518,418, filed on Jun. 12, 2017.

(51) Int. Cl.
*C12Q 1/6883* (2018.01)
*C12Q 1/686* (2018.01)
(52) U.S. Cl.
CPC ......... *C12Q 1/6883* (2013.01); *C12Q 1/686* (2013.01); *C12Q 2600/178* (2013.01)
(58) Field of Classification Search
CPC .............................................. C12Q 2600/178
See application file for complete search history.

(56) References Cited

FOREIGN PATENT DOCUMENTS

| EP | 2921561 A1 | 9/2015 |
| WO | WO 2015/092020 A2 | 6/2015 |
| WO | WO 2015/162161 A1 | 10/2015 |

OTHER PUBLICATIONS

Thum, T., Facts and updates about cardiovascular non-coding RNAs in heart failure, ESC Heart Failure, vol. 2, pp. 108-111 (Year: 2015).*
Devaux, Y. et al., Long noncoding RNAs in cardiac development and ageing, Nature Reviews, Cardiology, vol. 12, pp. 415-425 (Year: 2015).*
NONHSAT211604.1, pp. 1-3, downloaded from NONCODE database on Apr. 28, 2022 (Year: 2022).*
GenBank Accession No. NR_135480, Uncharacterized lncRNA, pp. 1-2 (Year: 2017).*
LNCipedia, gene ID SP2-AS1, pp. 1-2, downloaded from the database on May 2, 2022 (Year: 2022).*
LncBook, transcript ID HSALNT0241779, pp. 1-5, downloaded from the database on May 2, 2022 (Year: 2022).*
GenBank Accession No. NR_033963, *Homo sapiens* heart tissue-associated transcript 92 (HRAT92) lncRNA, pp. 1-3 (Year: 2017).*
GenBank Accession No. NR_046252, *Homo sapiens* FGD5 antisense RNA1 (FGD5-AS1), transcript variant 2, lncRNA; pp. 1-4 (Year: 2017).*
GenBank Accession No. NR_044993 , *Homo sapiens* GAS6 antisense RNA 2 (head to head) (GAS6-AS2) lncRNA , pp. 1-3 (Year: 2017).*
Lncbook, transcript HSALNT0207435, pp. 1-5, downloaded from the database on May 2, 2022 (Year: 2022).*

(Continued)

*Primary Examiner* — Teresa E Strzelecka
(74) *Attorney, Agent, or Firm* — Hoxie & Associates LLC

(57) ABSTRACT

The present invention provides methods for the diagnosing, monitoring and prognostication of primary and secondary cardiac disorders in a subject based on lncRNA expression. The invention also provides methods for predicting heart failure after myocardial infarction, and differenciation of Ischemic versus non-ischemic Heart Failure. The assessment/quantification of these lncRNAs may also be used as a marker for monitoring drug-induced cardiac toxicities and for the assessment of cardiac involvement during systemic diseases and others disorders/toxicities impacting cardiac function. These lncRNAs are cardiac tissue enriched and may be involved in different cardiac pathophysiological events and represent a potential target for therapeutical approaches.

16 Claims, 7 Drawing Sheets
Specification includes a Sequence Listing.

(56) References Cited

OTHER PUBLICATIONS

GenBank Accession No. NR_027451, *Homo sapiens* non-coding RNA activated by DNA damage (NORAD), pp. 1-4 (Year: 2016).*
Lncbook, transcript ID HSALNT0289380, pp. 1-5, downloaded from the database on May 2, 2022 (Year: 2022).*
GenBank Accession No. NR_024484, *Homo sapiens* long intergenic non-protein coding RNA909 (LINC00909), pp. 1-5 (Year: 2017).*
Lncbook, transcript ID HSALNT0289071, pp. 1-5, downloaded from the database on May 2, 2022 (Year: 2022).*
Hui Zhai, et al., "Expression pattern of genome-scale long noncoding RNA following acute myocardial infarction in Chinese Uyghur patients", OncoTarget, vol. 8, No. 19, (2017).
Gao, J. et al., "The Role and Molecular Mechanism of Non-Coding RNAs in Pathological Cardiac Remodeling," International Journal of Molecular Sciences, 2017, 18(3):1-17.
"Gene: HSPC324, ENSG00000228401—Summary—*Homo sapiens*—Ensembl genome browser 89," Ensembl, May 1, 2017, retrieved from the Internet, date retrieved: Jul. 18, 2018, 1 page, URL: http://may2017.archive.ensembl.org/Homo_sapiens/Gene/Summary?g=ENSG00000228401;r=9:138394717-138394717;t=ENST00000411904.
International Search Report of International Application No. PCT/EP2018/065492, prepared by the International Searching Authority, dated Sep. 24, 2018, 9 pages.
Kataoka, M. et al., "Noncoding RNAs in Cardiovascular Disease," Etiology and Morphogenesis of Congenital Heart Disease, 2016, Chapter 44, 313-317.
Vausort, M. et al., "Long Noncoding RNAs in Patients with Acute Myocardial Infarction," Circulation Research, 2014, 115(7):668-677.
Viereck, J. et al., "Long Noncoding RNAs in Pathological Cardiac Remodeling," Circulation Research, 2017, 120(2):262-264.
Zhai, H. et al., "Expression pattern of genome-scale long noncoding RNA following acute myocardial infarction in Chinese Uyghur patients," Oncotarget, 2017, 8(19):31449-31464.

* cited by examiner

DIAGNOSTIC, PROGNOSTIC AND THERAPEUTIC USES OF LONG NONCODING RNAS FOR PATHOLOGIES AND TOXICITIES INDUCING HEART DISORDERS

CROSS REFERENCE TO RELATED APPLICATIONS

This application is a U.S. national stage application filed under 35 U.S.C. § 371 of International Application No. PCT/EP2018/065492, filed on Jun. 12, 2018, which claims the benefit and priority of U.S. provisional application 62/518,418, filed on Jun. 12, 2017, the contents of each of which are incorporated herein by reference in their entireties.

REFERENCE TO A SEQUENCE LISTING

This application contains a Sequence Listing as a separate part of the disclosure. The Sequence Listing is incorporated herein by reference.

The present invention provides new biomarkers and methods for the diagnosing, monitoring and prognostication of primary and secondary cardiac disorders in a subject based on lncRNA expression. The invention also provides methods for predicting heart failure (HF) after myocardial infarction, or differentiation between Ischemic (ICM) versus non-ischemic (Non-ICM) HF (e.g., dilated cardiomyopathy (DCM)). The assessment/quantification of these lncRNAs in a single mode or in combination with other lncRNAs can also be used as a marker for monitoring drug-induced cardiac toxicities and for the assessment of cardiac involvement during systemic diseases and others disorders/toxicities impacting cardiac function. These lncRNAs are cardiac tissue enriched and may be involved in different pathophysiological events pertaining to cardiac function and represent a potential target for therapeutic approaches. These therapeutic approaches may be inhibitors or activators of these lncRNAs or the products activated or inhibited by these lncRNAs.

FIELD OF THE INVENTION

The present invention provides a list of cardiac associated or cardiac-enriched lncRNAs and methods for monitoring and diagnosing cardiac disorders in a subject based on lncRNA expression. The invention also provides methods for diagnosing different types of HF such as ICM versus Non-ICM (e.g., DCM), methods for predicting HF after myocardial infarction, and for monitoring treatment efficacy and drug-induced cardiac toxicities.

BACKGROUND OF THE INVENTION

In recent years, long non-coding RNA (lncRNAs) have emerged as a new type of non-coding RNA and many studies have shown their potential as powerful biomarkers in varous pathologies such as cancer.

In contrast to other non-coding RNA such as miRNA or snoRNA, lncRNA lack strong whole sequence conservation across different species but rather appear to contain short, highly conserved elements. Despite only a few lncRNA having been shown to be biologically relevant and functionally annotated, there's growing evidence that the majority of them are likely to be functional. While the exact function of most lncRNAs remain unknown, they have been implicated in various biological processes, mainly relating to transcriptional, post-transcriptional and epigenetic regulation. The majority of lncRNAs to date, that are functionally characterized, are believed to regulate developmental processes. However, recent profiling of the mice cardiac transcriptome, after myocardial infarction in mice cardiac tissue, has shown their role in controlling mature tissue as well as the relevance of their expression level in cardiac pathologies. There are publications which have argued for apparent similar roles of certain lncRNAs in humans e.g., WO2015092020, Cardiac disorders such as coronary artery disease (CAD), acute myocardial infarcation (AMI) and heart failure (HF) are leading causes of mortality and morbidity in the world and cardiac toxicities such as those induced by drugs and drug candidates are the most important cause of drug withdrawal. Thus, there is a very important unmet medical need for diverse types of biomarkers for assessing cardiac function, including but not limited to diagnosis, prognosis, monitoring of drug effects and diseases activity. Several cardiac pathologies remain still incurable or need less aggressive and more personalized treatment. lncRNA represent a novel family of targets useful for these diagnostic and therapeutic applications in the cardiovascular area. The present invention relates to lncRNAs that are cardiac enriched and described for the first time in human cardiac tissues. They represent good therapeutic and diagnostic candidates for cardiac related disorders.

SUMMARY OF THE INVENTION

Given that expression levels of lncRNAs could be associated with heart disease in human cardiac biopsies, the inventors set out to characterize lncRNA specifically relevant to cardiac tissue and involved in cardiac remodeling.

The present invention relates to lncRNAs having a sequence selected from the group consisting of SEQ ID NO:1 to SEQ ID NO: 3238 (Human sequences) isoforms thereof, fragments thereof and variant sharing at least 80% nucleotide sequence homology (hereinafter named "lncRNA of the invention") suitable for the diagnosis, prognosis and monitoring of subjects suffering from cardiovascular disorders.

In particular, the invention provides a method for diagnosing and monitoring cardiac disorders, the method comprising determining the level of expression, in a biological sample derived from said subject, of one or more lncRNAs of the invention and calculating differential expression of one of more lncRNAs of the invention compared to one or more lncRNA in a biological sample from a control subject, wherein differential expression of one or more lncRNAs of the invention indicates that the subject has developed or is at risk of developing a cardiac disorder. This method of the invention is also suitable for the prognostication of cardiac disorders.

In another aspect, the invention provides a method for predicting the development of heart failure (HF) in a subject having suffered myocardial infarction, a method for monitoring treatment efficacy in a subject suffering from cardiac injury and receiving a pharmaceutical cardiac therapy, a method for evaluating drug-induced cardiac toxicity in a subject receiving an effective amount of pharmaceutical composition, a method for diagnosing ischemic cardiomyopathy (ICM) in a subject, a method for diagnosing dilated cardiomyopathy (DCM) in a subject, a method for differentiating ICM vs Non-ICM (e.g., DCM) in subjects suffering heart failure, the methods comprising determining the level of expression, in a biological sample derived from said subject, of one or more lncRNAs of the invention and calculating differential expression of one of more lncRNAs of the invention compared to one or more lncRNA in a biological sample from a control subject.

In another aspect, the invention concerns a diagnostic/prognostic kit for carrying out any of the before cited methods.

In still another aspect, the present invention provides a method for treating a cardiac pathology in a subject comprising administering to said subject an effective amount of a pharmaceutical agent modulating the expression of one or more lncRNAs of the invention.

It yet another aspect, the invention provides for a method of detecting one or more lncRNAs (e.g., lncRNAs having a sequence selected from the group consisting of SEQ ID NO: 1 to SEQ ID NO: 3238). In one aspect, the method comprises the step of obtaining the lncRNA from a human biological sample (e.g., a human plasma sample).

In still another aspect, the invention provides a method of obtaining one or more lncRNAs, wherein the method comprises selection and isolation of total RNA. In one aspect, the lncRNA is correlated with the risk or development of a cardiac disorder. In one aspect the lncRNA is obtained from a biological sample (e.g., a cardiac biopsy or blood sample (e.g., plasma sample)).

BRIEF DESCRIPTION OF THE FIGURES

FIG. 3A compares ICM and Control. FIG. 3B compares DCM and Control.

DETAILED DESCRIPTION OF THE INVENTION

Figure 1:
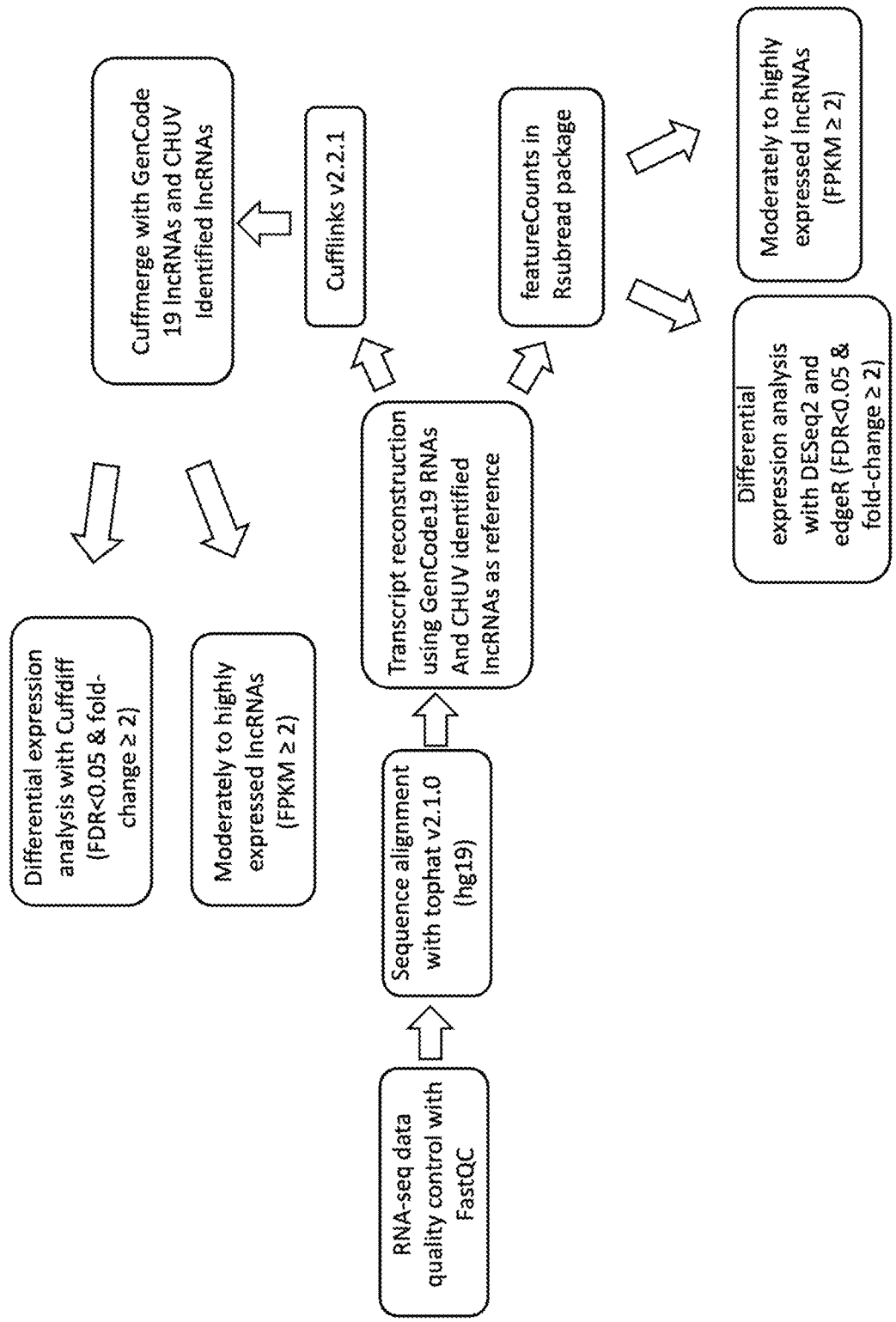
FIG. 1 shows the sequencing data analysis and the selection procedure of known lncRNA relevant to the cardiac pathologies.
Figure 2:
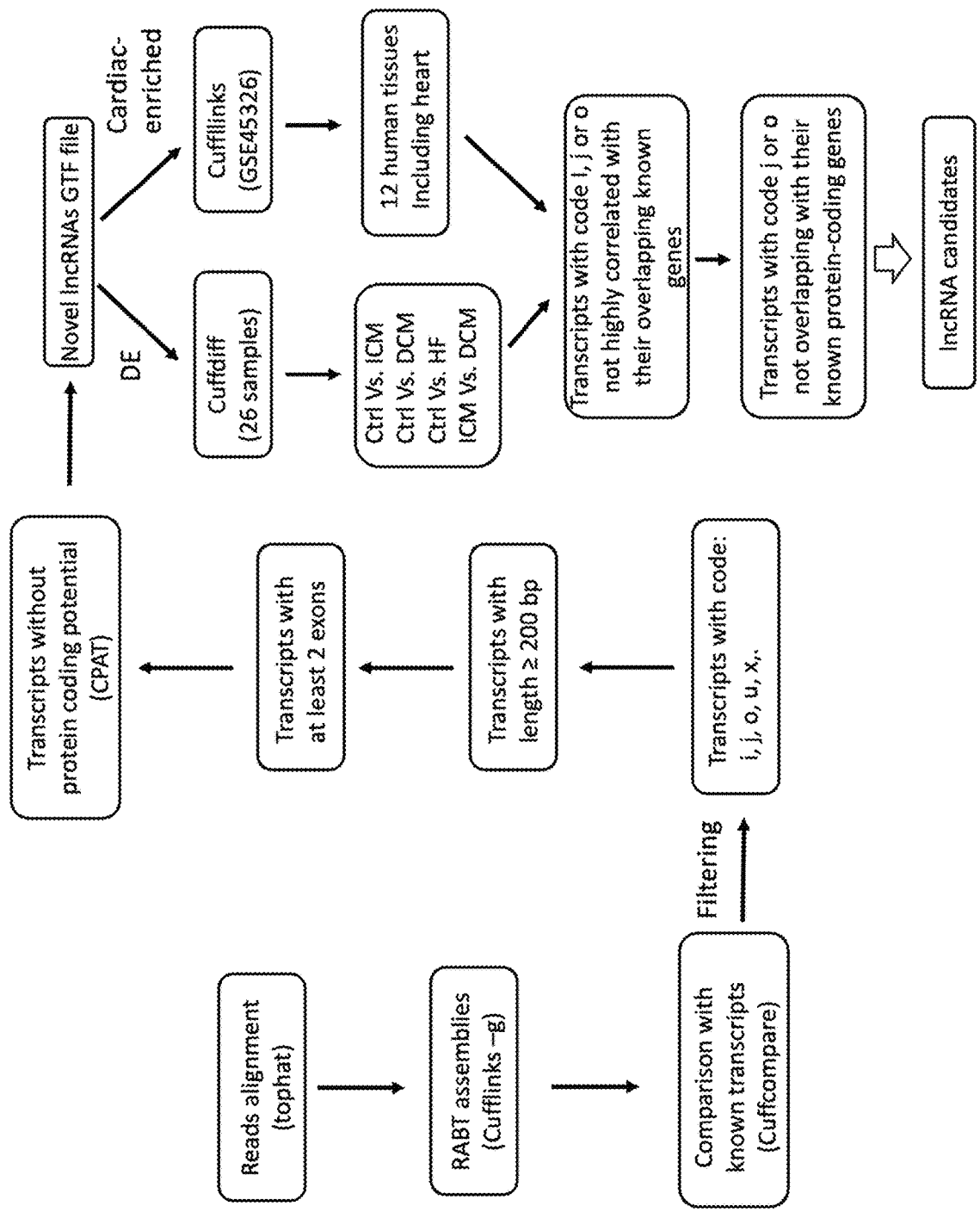
FIG. 2 shows the sequencing data analysis and the selection procedure of novel identified lncRNA relevant to the cardiac pathologies.
Figure 3A:
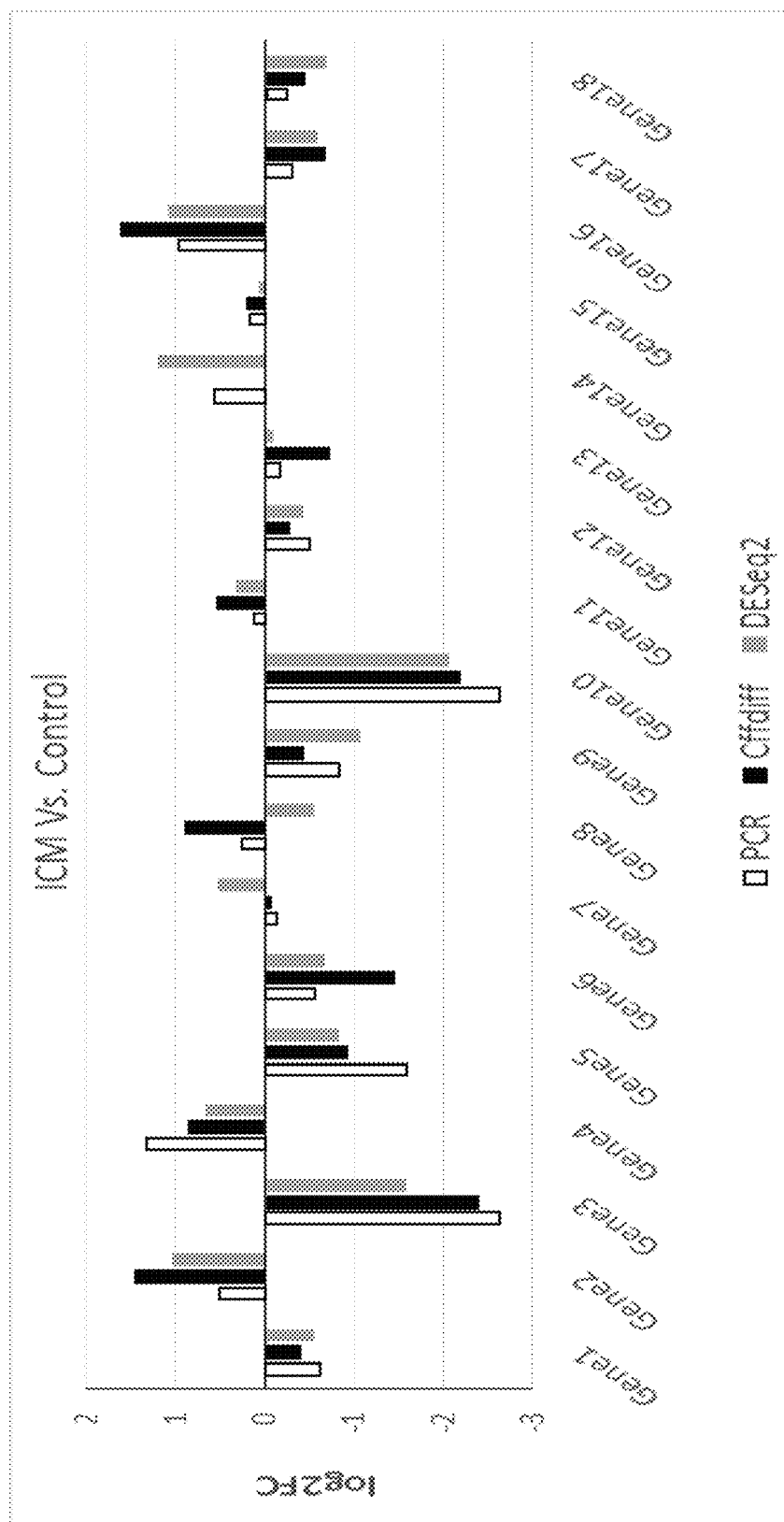
FIGS. 3A and 3B show the correlation between results obtained by sequencing with both Cuffdiff (middle bar) and DeSeq (right bar) analysis and results obtained by PCR (left bar) on patients of the same conditions.
Figure 3B:
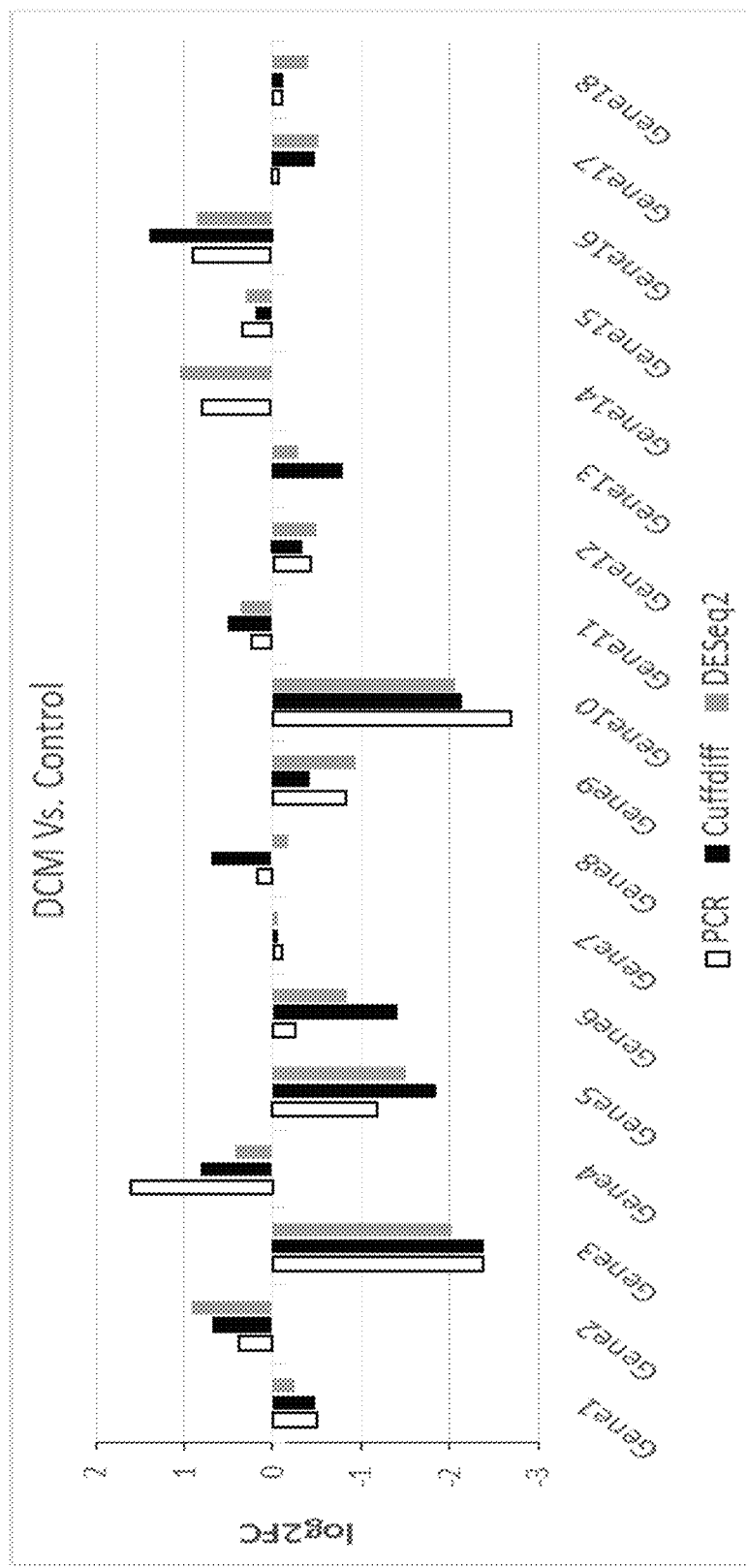

The Inventors intended to characterize the cardiac long non-coding transcriptome and more particularly the dynamically modulated fraction after left ventricular remodeling. The Inventors performed deep RNA-sequencing of cardiac biopsies coupled to novel transcript reconstruction and integration in genome-wide data sets as well as previously characterized predicted human cardiac-specific lncRNA to systematically identify and annotate heart-specific lncRNAs.

Surprisingly, it has been found that the lncRNAs of the invention are highly cardiac and context specific, thus providing a high potential as biomarkers of cardiac disorders as well as pathological response and physiological homeostasis. In addition, using novel transcripts reconstruction, novel lncRNA never described before that are cardiac-enriched and differentially expressed in cardiomyopathies have been found. These findings have been validated by comparing their RNA-Seq data with qPCR data from patients suffering the same conditions. A number of these human lncRNAs are detected in human plasma samples, supporting the feasibility of measuring their expression in patient biofluids for diagnosis and prognosis purposes. Furthermore, the inventors have identified lncRNAs which are differentially expressed in blood sample between the low LVEF (left ventricular ejection fraction) group and the high LVEF group after PCI (Percutaneous Coronary Intervention). Collectively, a novel panel of heart-specific lncRNAs with unique prognosis value relevant to cardiac disorders has been found.

As used herein, a control sample refers to a biological sample such as tissue or cells (e.g., blood sample) from a normal subject (e.g. an individual who does not have cardiac disease or any condition or symptom associated with).

As used herein, "identity" refers to the sequence matching between two polypeptides, molecules or between two nucleic acids. When a position in both of the two compared sequences is occupied by the same base or amino acid monomer subunit (for instance, if a position in each of the two DNA molecules is occupied by adenine, or a position in each of two polypeptides is occupied by a lysine), then the respective molecules are identical at that position. The "percentage identity" between two sequences is a function of the number of matching positions shared by the two sequences divided by the number of positions compared times 100. Such alignment can be provided using, for instance, the program Basic Local Alignment Search Tool (BLAST) from the National Center for Biotechnology Information NCBI.

The one or more lncRNAs, fragments thereof, isoforms thereof and variants sharing at least 80% nucleotide sequence identity thereto listed in Table 1 are not part of the present invention. The sequences of these one or more lncRNAs, excluded from the present invention, are described in PCT/EP2014/078868 (Université de Lausanne) and in filed in ST25 format.

TABLE 1

| XLOC_ID | Physiology Cluster | Lnc |
| --- | --- | --- |
| XLOC_007900 | 1 | Lnc7900 |
| XLOC_008052 | 1 | Lnc8052 |
| XLOC_006224 | 1 | Lnc6224 |
| XLOC_013471 | 1 | Lnc13471 |
| XLOC_002075 | 1 | Lnc2075 |
| XLOC_023749 | 1 | Lnc23749 |
| XLOC_008063 | 1 | Lnc8063 |
| XLOC_024203 | 1 | Lnc24203 |
| XLOC_019889 | 1 | Lnc19889 |
| XLOC_008229 | 1 | Lnc8229 |
| XLOC_014116 | 1 | Lnc14116/Novlnc11 |
| XLOC_003166 | 1 | Lnc3166 |
| XLOC_010335 | 1 | Lnc10335 |
| XLOC_021863 | 1 | Lnc21863 |
| XLOC_012367 | 1 | Lnc12367 |

TABLE 1-continued

| XLOC_ID | Physiology Cluster | Lnc |
|---|---|---|
| XLOC_007833 | 1 | Lnc7833 |
| XLOC_023850 | 2 | Lnc23850 |
| XLOC_029624 | 2 | Lnc-TEAD1 |
| XLOC_022865 | 2 | Lnc-SE-22865 |
| XLOC_018239 | 2 | Lnc18239 |
| XLOC_022715 | 2 | Lnc-COL16A1 |
| XLOC_013413 | 2 | Lnc13413 |
| XLOC_005390 | 2 | Lnc-MEOX1 |
| XLOC_010961 | 2 | Lnc-WISP1 |
| XLOC_000709 | 2 | Lnc-TGFB2 |
| XLOC_013407 | 2 | Lnc-SLC8A1 |
| XLOC_020214 | 2 | Lnc-CYR61 |
| XLOC_012723 | 2 | Lnc-SE-12723/Novlnc174 |
| XLOC_022262 | 2 | Lnc22262 |
| XLOC_000719 | 2 | Lnc00719 |
| XLOC_004951 | 2 | Lnc4951 |
| XLOC_026589 | 2 | Lnc26589 |
| XLOC_019010 | 2 | Lnc19010 |
| XLOC_022236 | 2 | Lnc22236 |
| XLOC_011236 | 3 | Lnc-SLC38A2 |
| XLOC_012015 | 3 | Lnc-KCNJ6 |
| XLOC_012884 | 3 | Lnc-NKX2.5 |
| XLOC_004797 | 3 | Lnc4797 |
| XLOC_003851 | 3 | Lnc-SPNB2 |
| XLOC_011237 | 3 | Lnc-SLC38A2 |
| XLOC_014898 | 3 | Lnc-SE-14989 |
| XLOC_030839 | 3 | Lnc-CDH13 |
| XLOC_012194 | 3 | Lnc-ACAP2 |
| XLOC_031308 | 3 | Lnc-IRX3 |
| XLOC_026621 | 3 | Lnc-ATOH8 |
| XLOC_002721 | 3 | Lnc-TXLNB |
| XLOC_003170 | 3 | Lnc-KITLG |
| XLOC_002849 | 4 | Lnc-Novlnc6 |
| XLOC_016279 | 4 | Lnc-Novlnc25 |
| XLOC_024141 | 4 | Lnc-CARD11 |
| XLOC_021524 | 4 | Lnc-NFIB |
| XLOC_021715 | 4 | Lnc-FOXO6 |
| XLOC_020321 | 4 | Lnc-ANX5A |
| XLOC_006274 | 4 | Lnc-MAX |
| XLOC_021416 | 4 | Lnc21416 |
| XLOC_003767 | 4 | Lnc-LIF |
| XLOC_014118 | 4 | Lnc-LCLAT1 |
| XLOC_004833 | 4 | Lnc4833 |
| XLOC_009582 | 4 | Lnc-PPIF |
| XLOC_024449 | 4 | Lnc24449 |
| XLOC_006146 | 4 | Lnc6146 |
| XLOC_033521 | 4 | Lnc-Dedbt (Lnc033521) |
| XLOC_025643 | 4 | Lnc25643 |
| XLOC_004910 | 4 | Lnc-SPARC |
| XLOC_010967 | 4 | Lnc-miR30b |
| XLOC_002503 | 4 | Lnc-SOCS2 |
| XLOC_017764 | 4 | Lnc-ID1 |
| XLOC_020119 | 4 | Lnc20119 |
| XLOC_001065 | 4 | Lnc-GPC1 |
| XLOC_009131 | 4 | Lnc-OTX2 |
| XLOC_000264 | 4 | Lnc-FAM124B |
| XLOC_032325 | 4 | Lnc-TALIN1 |
| XLOC_002546 | 4 | Lnc-KRR1 |
| XLOC_006241 | 4 | Lnc-DACT1 |
| XLOC_029781 | 4 | Lnc29781 |
| XLOC_030722 | 4 | Lnc-SE-30722 |
| XLOC_032031 | 4 | Lnc-KCNJ |
| XLOC_020634 | 4 | Lnc-SE-20634 |
| XLOC_031524 | 4 | Lnc-IRF2BP2 |
| XLOC_020212 | 4 | Lnc-CYR61 |
| XLOC_000336 | 4 | Lnc-HDAC4 |
| XLOC_015960 | 4 | Lnc-ITPRIP |
| XLOC_004067 | 4 | Lnc-MYOCD |
| XLOC_015277 | 4 | Lnc-SMAD7/Novlnc23 |
| XLOC_020313 | 4 | Lnc20313 |
| XLOC_008190 | 4 | Lnc8190 |
| XLOC_033125 | 4 | Lnc33125 |
| XLOC_032788 | 4 | Lnc32788/Novlnc90 |
| XLOC_014917 | 4 | Lnc14917 |
| XLOC_014935 | 4 | Lnc14935 |
| XLOC_007419 | 4 | Lnc7419 |
| XLOC_006561 | 4 | Lnc6561 |
| XLOC_024370 | 4 | Lnc24370 |
| XLOC_006255 | 4 | Lnc6255 |
| XLOC_029637 | 4 | Lnc29637 |
| XLOC_010855 | 2 | Lnc10855 |
| XLOC_007852 | 4 | Lnc7852/Novlnc15 |
| XLOC_009335 | 4 | Lnc9335/Novlnc32 |
| XLOC_019782 | 2 | Lnc19782/Novlnc35 |
| XLOC_010735 | 4 | Lnc10735/Novlnc44 |
| XLOC_007917 | 4 | Lnc7917/Novlnc61 |
| XLOC_033357 | 4 | Lnc33357 |
| XLOC_023848 | 4 | Lnc23848/Novlnc49 |
| XLOC_016979 | 4 | Lnc16979 |

The present invention relates to lncRNAs having a sequence selected from the group consisting of SEQ ID NO: 1 to SEQ ID NO: 3238 (Human sequences) isoforms thereof, fragments thereof and variant sharing at least 80% (e.g., at least 90%, at least 95%, at least 98%, or at least 99%) nucleotide sequence homology suitable for the diagnosis, prognosis and monitoring of subjects suffering from cardiovascular disorders.

In some embodiments, the lncRNA which is detected is selected from any of SEQ ID NO: 1 to SEQ ID NO: 3238.

In some embodiments, the lncRNA which is detected is selected from the group consisting of:
  (i) 15 lncRNAs of SEQ ID NO: 1204, SEQ ID NO: 1736, SEQ ID NO: 0544, SEQ ID NO: 0915, SEQ ID NO:2368, SEQ ID NO: 1595, SEQ ID NO: 2382, SEQ ID NO: 0859, SEQ ID NO: 3112, SEQ ID NO: 1869, SEQ ID NO: 1406, SEQ ID NO: 0043, SEQ ID NO: 0363, SEQ ID NO: 0069 and SEQ ID NO: 1947;
  (ii) 11 lncRNAs of SEQ ID NO: 2373, SEQ ID NO: 1748, SEQ ID NO: 3112, SEQ ID NO: 1231, SEQ ID NO: 0664, SEQ ID NO: 1686, SEQ ID NO: 0791, SEQ ID NO: 2126, SEQ ID NO: 2750, SEQ ID NO: 3010, and SEQ ID NO: 2241;
  (iii) 14 lncRNAs of SEQ ID NO: 2150, SEQ ID NO: 1534, SEQ ID NO: 0311, SEQ ID NO: 2952, SEQ ID NO: 2838, SEQ ID NO: 1437, SEQ ID NO: 1297, SEQ ID NO: 1059, SEQ ID NO: 1465, SEQ ID NO: 2826, SEQ ID NO: 0180, SEQ ID NO: 0538, SEQ ID NO: 0258, and SEQ ID NO: 2273;
  (iv) 20 lncRNAs of SEQ ID NO: 0190, SEQ ID NO: 0359, SEQ ID NO: 0776, SEQ ID NO: 1421, SEQ ID NO: 1795, SEQ ID NO: 0477, SEQ ID NO: 1511, SEQ ID NO: 0435, SEQ ID NO: 1418, SEQ ID NO: 1025, SEQ ID NO: 0265, SEQ ID NO: 1311, SEQ ID NO: 2540, SEQ ID NO: 2323, SEQ ID NO: 3011, SEQ ID NO: 2447, SEQ ID NO: 2863, SEQ ID NO: 2697, SEQ ID NO: 3128, and SEQ ID NO: 2265;
  (v) 11 lncRNAs of SEQ ID NO: 2540, SEQ ID NO: 0545, SEQ ID NO: 1766, SEQ ID NO: 3011, SEQ ID NO: 0968, SEQ ID NO: 2371, SEQ ID NO: 1533, SEQ ID NO: 0749, SEQ ID NO: 0609, SEQ ID NO: 1446, and SEQ ID NO: 2986;
  (vi) 8 lncRNAs of SEQ ID NO: 1204, SEQ ID NO: 2454, SEQ ID NO: 0334, SEQ ID NO: 1403, SEQ ID NO: 1089, SEQ ID NO: 2692, SEQ ID NO: 2273, SEQ ID NO: 0502;
  (vii) 4 lncRNAs of SEQ ID NO: 0097, SEQ ID NO: 1947, SEQ ID NO: 1051 and SEQ ID NO: 2996; and
  (viii) lncRNAs in Table 4, Table 5, Table 8, Table 9, Table 12, Table 15, Table 18, Table 19, Table 20, Table 21, Table 22, Table 24, Table 25, Table 28, Table 29, Table 32, Table 33, Table 34, Table 35, Table 36, Table 37, Table 38, Table 39, Table 40, and/or Table 41.

As used herein, a biological sample may be any sample that may be taken from a subject, such as whole blood, serum, plasma, semen, saliva, tears, urine, fecal material, sweat, buccal smears, skin, cardiac tissue, liver, brain tissue, amniotic fluid, nerve tissue and hair. It also includes specific cellular subtypes or derivatives extracted from those such as PBMCs. The sample used in this invention is preferably blood or cardia tissue, more preferably blood, e.g., serum.

The expression level of lncRNAs may be determined by any technology known by a man skilled in the art. In particular, the expression level of lncRNAs is determined by measuring the amount of nucleic acid transcripts of each lncRNA. The amount of nucleic acid transcripts can be measured by any technology known by a man skilled in the art. The measure may be carried out directly on an extracted RNA sample or on retrotranscribed complementary DNA (cDNA) prepared from extracted RNA by technologies well-known in the art. From the RNA or cDNA sample, the amount of nucleic acid transcripts may be measured using any technology known by a man skilled in the art, including nucleic acid microarrays, quantitative PCR, sequencing (e.g., next generation sequencing), and hybridization with a labeled probe.

In some embodiments, the expression level of lncRNAs is determined using sequencing, e.g., next generation sequencing. Sequencing may be carried out after converting extracted RNA to cDNA using reverse transcriptase or RNA molecules may be directly sequenced. In a particular embodiment, which should not be considered as limiting the scope of the invention, the measurement of the expression level using next generation sequencing may be performed as follows. Briefly, RNA is extracted from a sample (e.g., blood sample). After removing rRNA, RNA samples are then reverse transcribed into cDNA. To ensure strand specificity, single stranded cDNA is first synthetized using Super-Script II reverse transcriptase and random primers in the presence of Actinomycin D, and then converted to double stranded cDNA with the second strand marking mix that incorporates dUTP in place of dTTP. Resulting blunt ended cDNA are purified using AMPure XP magnetic beads. After a 3'end adenylation step, adaptor is attached to cDNA. So obtained cDNA (sequencing library) may be amplified by PCR. The sequencing libraries can be sequenced by any next generation sequencing technology known by a man skilled in the art.

In some embodiments, the measurement of the expression level of lncRNAs, e.g., by sequencing (e.g., next generation sequencing), is facilitated by capturing and enriching nucleic acids (RNA or cDNA) corresponding to lncRNAs of interest prior to the measurement. As used herein, enrichment refers to increasing the percentage of the nucleic acids of interest in the sample relative to the initial sample by selectively purifying the nucleic acids of interest. The enrichment of nucleic acids corresponding to lncRNAs of interest can be carried out on extracted RNA sample or cDNA sample prepared from extracted RNA. In some embodiments, nucleic acids corresponding to lncRNAs of interest are captured and enriched by hybridizing RNA or cDNA sample to oligonucleotide probes specific to lncRNAs of interest (e.g. oligonucleotide probes comprising a sequence complementary to a region of lncRNAs of interest) under conditions allowing for hybridization of the probes and target nucleic acids to form probe-target nucleic acid complexes. Probes may be DNA or RNA, preferably DNA. The length of probes may be from 30 to 80 nucleotides, e.g., from 40 to 70, from 40 to 60, or about 50 nucleotides. The probe-target nucleic acid complexes can be purified by any technology known by a man skilled in the art. In a preferred embodiment, probes are biotinylated. The biotinylated probe-target nucleic acid complexes can be purified by using a streptavidin-coated substrate, e.g, a streptavidin-coated magnetic particle, e.g., T1 streptavidin coated magnetic bead.

In some embodiments, the expression level of lncRNAs may be determined using quantitative PCR. Quantitative, or real-time, PCR is a well known and easily available technology for those skilled in the art and does not need a precise description. In a particular embodiment, which should not be considered as limiting the scope of the invention, the determination of the expression profile using quantitative PCR may be performed as follows. Briefly, the real-time PCR reactions are carried out using the TaqMan Universal PCR Master Mix (Applied Biosystems). 6 µl cDNA is added to a 9 µl PCR mixture containing 7.5 µl TaqMan Universal PCR Master Mix, 0.75 µl of a 20× mixture of probe and primers and 0.75 µl water. The reaction consisted of one initiating step of 2 min at 50 deg. C., followed by 10 min at 95 deg. C., and 40 cycles of amplification including 15 sec at 95 deg. C. and 1 min at 60 deg. C. The reaction and data acquisition can be performed using the ABI 7900HT Fast Real-Time PCR System (Applied Biosystems). The number of template transcript molecules in a sample is determined by recording the amplification cycle in the exponential phase (cycle threshold or $C_Q$ or $C_T$), at which time the fluorescence signal can be detected above background fluorescence. Thus, the starting number of template transcript molecules is inversely related to $C_T$.

In some embodiments, the expression level of lncRNAs may be determined by the use of a nucleic acid microarray. A nucleic acid microarray consists of different nucleic acid probes that are attached to a substrate, which can be a microchip, a glass slide or a microsphere-sized bead. A microchip may be constituted of polymers, plastics, resins, polysaccharides, silica or silica-based materials, carbon, metals, inorganic glasses, or nitrocellulose. Probes can be nucleic acids such as cDNAs ("cDNA microarray") or oligonucleotides ("oligonucleotide microarray"), and the oligonucleotides may be about 25 to about 60 base pairs or less in length. To determine the expression profile of a target nucleic acid sample, said sample is labelled, contacted with the microarray in hybridization conditions, leading to the formation of complexes between target nucleic acids that are complementary to probe sequences attached to the microarray surface. The presence of labelled hybridized complexes is then detected. Many variants of the microarray hybridization technology are available to the man skilled in the art.

The present invention provides Method 1. Method 1 is a method of diagnosing or monitoring or treating cardiac diseases or disorders in a subject, the method comprising
  a.) obtaining a sample from said subject;
  b.) detecting the level of expression of one or more lncRNAs (e.g., having a sequence consisting of SEQ ID NO: 1 to SEQ ID NO: 3238, isoforms thereof, fragment thereof and variant sharing at least 80% nucleotide sequence homology); and
  c.) diagnosing the subject with one or mores cardiac diseases or disorders based upon the level of expression of one or more lncRNAs compared to a control, with the proviso that the one or more lncRNAs, fragments thereof, isoforms thereof and variants sharing at least 80% nucleotide sequence identity thereto listed in Table 1 are not part of the present invention.

In various aspects, Method 1 includes the following:
1.1 Method 1, wherein the method wherein the level of expression or the differential expression of one or more said lncRNAs indicates that the subject has developed or is at risk of developing a cardiac disorder.
1.2 Method 1 or 1.1, wherein cardiac disorder is selected from the group consisting of: pathologies or abnormalities with Interventricular Septal Thickness (IVS), heart failure (e.g., left and right ventricle dilatation/dysfunction), EF, LVID, MI, HFrEF, myocardial infarction, myocarditis (e.g., viral myocarditis), cardiac toxicity, brachycardia, arrhythmia, congenital heart defects, hypertension, diabetic cardiomyopathy, idiopathic and dilated cardiomyopathy, pathologies characterized by malformation, pathologies characterized by tissue remodeling, pathologies characterized by affected function, pathologies characterized by disorders of the right heart, pathologies characterized by arrhythmias, pathologies characterized by intoxication, pathologies characterized by cancer, pathologies characterized by neurologic disorders, pathologies characterized by trauma, pathologies characterized by a change in hemodynamic, pathologies characterized by vascular disorders altering cardiac functions such as Coronary artery disease (CAD), and pathologies resulted from cardiac dysfunction/disorders inducing ischemic (embolic/thrombotic) stroke.
1.3 The method of Method 1, 1.1, or 1.2, wherein the diagnosis step includes predicting the development of heart failure in a subject having suffered AMI, the method comprising determining the level of expression, in a biological sample derived from said subject, of one or more lncRNAs of the invention or calculating differential expression of one of more lncRNAs compared to one or more lncRNAs in the same biological sample, wherein the level of expression or the differential expression of one or more said lncRNAs predicts the risk for the subject to develop HF.
1.4 The method of any of Method 1-1.3, wherein the method optionally further comprises the step of administering at least one pharmaceutical to the subject in order to treat one or more cardiovascular diseases or disorders.
1.5 The method of any of Method 1-1.4, wherein the level of expression refers to the differential expression of lncRNAs, the presence of lncRNAs, or the absence of lncRNAs.
1.6 The method of any of Methods 1-1. 5, wherein the level of expression of one or more said lncRNAs indicates that the subject suffers ICM.
1.7 The method of any of Methods 1-1. 5, wherein the level of expression of one or more said lncRNAs indicates that the subject suffers Non-ICM (e.g., DCM).
1.8 The method of any of the preceding methods, wherein the subject has been previously diagnosed with Heart Failure (e.g., congestive heart failure)
1.9 The method of 1.8, wherein the level of expression of one or more said lncRNAs indicates that the subject with Heart Failure also suffers Non-ICM (e.g., DCM).
1.10 Any of the preceding methods, wherein the biological sample is selected from the group consisting of: whole blood, serum, plasma, semen, saliva, tears, urine, fecal material, sweat, buccal smears, skin, cardiac tissue, liver, brain tissue, amniotic fluid, nerve tissue and hair (e.g, wherein the sample is preferably plasma or cardiac tissue).
1.11 Any of the preceding methods, wherein the lncRNA expression levels are detected in a sample (e.g., biological sample) using a technique selected from the group consisting of: S1 nuclease protection assay, microarray analysis, polymerase chain reaction (PCR), hybridization technologies, reverse transcriptase polymerase chain reaction (RT-PCR), Northern blot, serial analysis of gene expression (SAGE), immunoassay, and mass spectrometry.
1.12 Any of the preceding methods, wherein the lncRNA expression level of lncRNA in sample (e.g., biological sample) is detected using a singleplexed or multiplexed method selected from a group consisting of: fluorescence, luminescence, radio-marking, sequencing, e.g., next generation sequencing, and coded microdisks.
1.13 Any of the preceding methods further comprising administering a pharmaceutical composition which modulates one or more lncRNAs, wherein the pharmaceutical composition is selected from the group consisting of: a chemical agent, a RNA mimic, an antibody, an engineered protease, a CRISPR based technology and enzymatically active RNA.
1.14 The method of 1.13, wherein the enzymatically active RNA is selected from the group consisting of: a miRNA, a siRNA, a piRNA, a hnRNA, a snRNA, esiRNA, shRNA, decoys, RNA aptamers and an antisense oligonucleotide.
1.15 Any of the preceding methods, wherein the method is a method of diagnosis.
1.16 Any of the preceding methods, wherein the method is a method of monitoring.
1.17 Any of the preceding methods, wherein the method is a method of treatment.
1.18 Any of the preceding methods, wherein the expression level of the lncRNAs of the invention are detected by measuring the levels of cDNAs, amplified RNAs or DNAs or quantities of DNA probes, or other molecules, in a sample (e.g., biological sample) that are indicative of the expression level of the lncRNA.
1.19 Any of the preceding methods, wherein the lncRNA which is detected is selected from any of SEQ ID NO: 1 to SEQ ID NO: 3238.
1.20 Any of the preceding methods, wherein the lncRNA which is detected is selected from selected from the group consisting of:
  (i) 15 lncRNAs of SEQ ID NO: 1204, SEQ ID NO: 1736, SEQ ID NO: 0544, SEQ ID NO: 0915, SEQ ID NO:2368, SEQ ID NO: 1595, SEQ ID NO: 2382, SEQ ID NO: 0859, SEQ ID NO: 3112, SEQ ID NO: 1869, SEQ ID NO: 1406, SEQ ID NO: 0043, SEQ ID NO: 0363, SEQ ID NO: 0069 and SEQ ID NO: 1947;
  (ii) 11 lncRNAs of SEQ ID NO: 2373, SEQ ID NO: 1748, SEQ ID NO: 3112, SEQ ID NO: 1231, SEQ ID NO: 0664, SEQ ID NO: 1686, SEQ ID NO: 0791, SEQ ID NO: 2126, SEQ ID NO: 2750, SEQ ID NO: 3010, and SEQ ID NO: 2241;
  (iii) 14 lncRNAs of SEQ ID NO: 2150, SEQ ID NO: 1534, SEQ ID NO: 0311, SEQ ID NO: 2952, SEQ ID NO: 2838, SEQ ID NO: 1437, SEQ ID NO: 1297, SEQ ID NO: 1059, SEQ ID NO: 1465, SEQ ID NO: 2826, SEQ ID NO: 0180, SEQ ID NO: 0538, SEQ ID NO: 0258, and SEQ ID NO: 2273;
  (iv) 20 lncRNAs of SEQ ID NO: 0190, SEQ ID NO: 0359, SEQ ID NO: 0776, SEQ ID NO: 1421, SEQ ID NO: 1795, SEQ ID NO: 0477, SEQ ID NO: 1511, SEQ ID NO: 0435, SEQ ID NO: 1418, SEQ ID NO:

1025, SEQ ID NO: 0265, SEQ ID NO: 1311, SEQ ID NO: 2540, SEQ ID NO: 2323, SEQ ID NO: 3011, SEQ ID NO: 2447, SEQ ID NO: 2863, SEQ ID NO: 2697, SEQ ID NO: 3128, and SEQ ID NO: 2265;
(v) 11 lncRNAs of SEQ ID NO: 2540, SEQ ID NO: 0545, SEQ ID NO: 1766, SEQ ID NO: 3011, SEQ ID NO: 0968, SEQ ID NO: 2371, SEQ ID NO: 1533, SEQ ID NO: 0749, SEQ ID NO: 0609, SEQ ID NO: 1446, and SEQ ID NO: 2986;
(vi) 8 lncRNAs of SEQ ID NO: 1204, SEQ ID NO: 2454, SEQ ID NO: 0334, SEQ ID NO: 1403, SEQ ID NO: 1089, SEQ ID NO: 2692, SEQ ID NO: 2273, SEQ ID NO: 0502;
(vii) 4 lncRNAs of SEQ ID NO: 0097, SEQ ID NO: 1947, SEQ ID NO: 1051 and SEQ ID NO: 2996; and
(viii) lncRNAs in Table 4, Table 5, Table 8, Table 9, Table 12, Table 15, Table 18, Table 19, Table 20, Table 21, Table 22, Table 24, Table 25, Table 28, Table 29, Table 32, Table 33, Table 34, Table 35, Table 36, Table 37, Table 38, Table 39, Table 40, and/or Table 41.

1.21 Any of the preceding methods, wherein the expression level of lncRNA (e.g., SEQ ID NO: 1 to SEQ ID NO: 3238) is compared to a control.

1.22 Any of the preceding methods, wherein cardiac disorder can be selected from the group consisting of: pathologies or abnormalities related to heart failure (HF) e.g., left and right ventricle dilatation/dysfunction, reduced ejection fraction (HFrEF), independently from HF etiology: ICM (Ischemic HF-related with coronary artery disease, myocardial infarction, etc.) vs Non-ICM (Non-Ischemic HF-related with myocarditis, cardiac toxicity, arrhythmia, hypertension, congenital heart defects, diabetic, idiopathic cardiomyopathy or others).

The invention also provides Method 2. Method 2 is a method for monitoring treatment efficacy in a subject suffering from a cardiac disease or disorder and receiving a pharmaceutical cardiac therapy, the method comprising
a.) administering a pharmaceutical to a subject suffering from cardiac injury;
b.) obtaining a sample (e.g., a biological sample) from the subject;
c.) detecting the level of expression of one or more lncRNAs (e.g., having a sequence selected from the group consisting of SEQ ID NO: 1 to SEQ ID NO: 3238, isoforms thereof, fragment thereof and variant sharing at least 80% nucleotide sequence homology) in the sample, wherein the expression level of lncRNA is compared to a control; and
d.) determining the level of expression of one or more lncRNAs, wherein the level of expression of said one or more lncRNAs indicates the efficacy of the treatment,
with the proviso that the one or more lncRNAs, fragments thereof, isoforms thereof and variants sharing at least 80% nucleotide sequence identity thereto listed in Table 1 are not part of the present invention.

In various aspects, Method 2 includes the following:
2.1 Method 2, wherein the level of expression of one or more said lncRNAs indicates that the subject has developed or is at risk of developing a cardiac disorder despite the administration of a pharmaceutical.
2.2 Method 2 or 2.1, wherein cardiac disorder is selected from the group consisting of: pathologies or abnormalities with Interventricular Septal Thickness (IVS), heart failure (e.g., left and right ventricle dilatation/dysfunction), EF, LVID, MI, HFrEF, myocardial infarction, myocarditis (e.g., viral myocarditis), cardiac toxicity, brachycardia, arrhythmia, congenital heart defects, hypertension, diabetic cardiomyopathy, idiopathic and dilated cardiomyopathy, pathologies characterized by malformation, pathologies characterized by tissue remodeling, pathologies characterized by affected function, pathologies characterized by disorders of the right heart, pathologies characterized by arrhythmias, pathologies characterized by intoxication, pathologies characterized by cancer, pathologies characterized by neurologic disorders, pathologies characterized by trauma, pathologies characterized by a change in hemodynamic, pathologies characterized by vascular disorders altering cardiac functions such as Coronary artery disease (CAD), and pathologies resulted from cardiac dysfunction/disorders inducing ischemic (embolic/thrombotic) stroke.
2.3 The method of Method 2, 2.1, or 2.2, wherein the diagnosis step includes predicting the development of heart failure in a subject having suffered AMI, the method comprising determining the level of expression, in a biological sample derived from said subject, of one or more lncRNAs of the invention or calculating differential expression of one of more lncRNAs compared to one or more lncRNAs in the same biological sample, wherein the level of expression or the differential expression of one or more said lncRNAs predicts the risk for the subject to develop HF.
2.4 The method of any of Method 2-2.3, wherein the method optionally further comprises the step of administering at least one pharmaceutical to the subject depending on the efficacy of the treatment.
2.5 The method of any of Method 2-2.4, wherein the level of expression refers to the differential expression of lncRNAs, the presence of lncRNAs, or the absence of lncRNAs.
2.6 The method of any of the preceding methods, wherein the subject has been previously diagnosed with Heart Failure (e.g., congestive heart failure)
2.7 Any of the preceding methods, wherein the biological sample is selected from the group consisting of: whole blood, serum, plasma, semen, saliva, tears, urine, fecal material, sweat, buccal smears, skin, cardiac tissue, liver, brain tissue, amniotic fluid, nerve tissue and hair (e.g, wherein the sample is preferably plasma or cardiac tissue).
2.8 Any of the preceding methods, wherein the lncRNA expression levels are measured by technique selected from the group consisting of: Si nuclease protection assay, microarray analysis, polymerase chain reaction (PCR), hybridization technologies, reverse transcriptase polymerase chain reaction (RT-PCR), Northern blot, serial analysis of gene expression (SAGE), immunoassay, and mass spectrometry.
2.9 Any of the preceding methods, wherein the lncRNA expression level is detected using a singleplexed or multiplexed method selected from a group consisting of: fluorescence, luminescence, radio-marking, next generation sequencing and coded microdisks.
2.10 Any of the preceding methods further comprising administering a pharmaceutical composition which modulates one or more lncRNAs, wherein the pharmaceutical composition is selected from the group consisting of: a chemical agent, a RNA mimic, an antibody, an engineered protease, a CRISPR based technology and enzymatically active RNA.

2.11 The method of 2.10, wherein the enzymatically active RNA is selected from the group consisting of: a miRNA, a siRNA, a piRNA, a hnRNA, a snRNA, esiRNA, shRNA, decoys, RNA aptamers and an antisense oligonucleotide.

2.12 Any of the preceding methods, wherein the expression level of the lncRNAs of the invention are determined by measuring the levels of cDNAs, amplified RNAs or DNAs or quantities of DNA probes, or other molecules that are indicative of the expression level of the lncRNA.

2.13 Any of the preceding methods, wherein the lncRNA which is detected is selected from any of SEQ ID NO: 1 to SEQ ID NO: 3238.

2.14 Any of the preceding methods, wherein the lncRNA which is detected is selected from selected from the group consisting of:
- (i) 15 lncRNAs of SEQ ID NO: 1204, SEQ ID NO: 1736, SEQ ID NO: 0544, SEQ ID NO: 0915, SEQ ID NO:2368, SEQ ID NO: 1595, SEQ ID NO: 2382, SEQ ID NO: 0859, SEQ ID NO: 3112, SEQ ID NO: 1869, SEQ ID NO: 1406, SEQ ID NO: 0043, SEQ ID NO: 0363, SEQ ID NO: 0069 and SEQ ID NO: 1947;
- (ii) 11 lncRNAs of SEQ ID NO: 2373, SEQ ID NO: 1748, SEQ ID NO: 3112, SEQ ID NO: 1231, SEQ ID NO: 0664, SEQ ID NO: 1686, SEQ ID NO: 0791, SEQ ID NO: 2126, SEQ ID NO: 2750, SEQ ID NO: 3010, and SEQ ID NO: 2241;
- (iii) 14 lncRNAs of SEQ ID NO: 2150, SEQ ID NO: 1534, SEQ ID NO: 0311, SEQ ID NO: 2952, SEQ ID NO: 2838, SEQ ID NO: 1437, SEQ ID NO: 1297, SEQ ID NO: 1059, SEQ ID NO: 1465, SEQ ID NO: 2826, SEQ ID NO: 0180, SEQ ID NO: 0538, SEQ ID NO: 0258, and SEQ ID NO: 2273;
- (iv) 20 lncRNAs of SEQ ID NO: 0190, SEQ ID NO: 0359, SEQ ID NO: 0776, SEQ ID NO: 1421, SEQ ID NO: 1795, SEQ ID NO: 0477, SEQ ID NO: 1511, SEQ ID NO: 0435, SEQ ID NO: 1418, SEQ ID NO: 1025, SEQ ID NO: 0265, SEQ ID NO: 1311, SEQ ID NO: 2540, SEQ ID NO: 2323, SEQ ID NO: 3011, SEQ ID NO: 2447, SEQ ID NO: 2863, SEQ ID NO: 2697, SEQ ID NO: 3128, and SEQ ID NO: 2265;
- (v) 11 lncRNAs of SEQ ID NO: 2540, SEQ ID NO: 0545, SEQ ID NO: 1766, SEQ ID NO: 3011, SEQ ID NO: 0968, SEQ ID NO: 2371, SEQ ID NO: 1533, SEQ ID NO: 0749, SEQ ID NO: 0609, SEQ ID NO: 1446, and SEQ ID NO: 2986;
- (vi) 8 lncRNAs of SEQ ID NO: 1204, SEQ ID NO: 2454, SEQ ID NO: 0334, SEQ ID NO: 1403, SEQ ID NO: 1089, SEQ ID NO: 2692, SEQ ID NO: 2273, SEQ ID NO: 0502;
- (vii) 4 lncRNAs of SEQ ID NO: 0097, SEQ ID NO: 1947, SEQ ID NO: 1051 and SEQ ID NO: 2996; and
- (viii) lncRNAs in Table 4, Table 5, Table 8, Table 9, Table 12, Table 15, Table 18, Table 19, Table 20, Table 21, Table 22, Table 24, Table 25, Table 28, Table 29, Table 32, Table 33, Table 34, Table 35, Table 36, Table 37, Table 38, Table 39, Table 40, and/or Table 41.

2.15 Any of the preceding methods, wherein cardiac disorder can be selected from the group consisting of: pathologies or abnormalities related to heart failure (HF) e.g., left and right ventricle dilatation/dysfunction, reduced ejection fraction (HFrEF), independently from HF etiology: ICM (Ischemic HF-related with coronary artery disease, myocardial infarction, etc.) vs Non-ICM (Non-Ischemic HF-related with myocarditis, cardiac toxicity, arrhythmia, hypertension, congenital heart defects, diabetic, idiopathic cardiomyopathy or others).

The invention also provides for Method 3. Method 3 is a method for diagnosing drug-induced cardiac toxicity in a subject receiving a pharmaceutical composition, wherein the method comprises
- a.) obtaining a sample from the subject;
- b.) measuring the level of expression, (e.g., in a biological sample derived from said subject) of one or more lncRNAs of the invention from the sample
- c.) diagnosing the subject as having a cardiac toxicity from the pharmaceutical composition depending upon the level of expression of one or more said lncRNAs (e.g, wherein the lncRNA is one or more sequences selected from SEQ ID NO: 1 to SEQ ID NO: 3238), with the proviso that the one or more lncRNAs, fragments thereof, isoforms thereof and variants sharing at least 80% nucleotide sequence identity thereto listed in Table 1 are not part of the present invention.

The invention also provides for Method 4. Method 4 is a method of detecting one or more lncRNAs (e.g., lncRNAs having a sequence selected from the group consisting of SEQ ID NO: 1 to SEQ ID NO: 3238) useful for Method 1 et seq, Method 2 et seq, and Method 3 et seq. In one aspect, the method comprises the step of obtaining the lncRNA from a human biological sample (e.g., a human plasma sample). The sample can be any biological sample as described in Method 1 et seq, Method 2 et seq, and Method 3 et seq. Method 4 comprises:
- a.) obtaining a sample (e.g., biological sample) from a subject; and
- b.) measuring the expression level of the lncRNA (e.g, wherein the lncRNA is detected by sequencing (e.g., next generation sequencing), 51 nuclease protection assay, microarray analysis, polymerase chain reaction (PCR), hybridization technologies, reverse transcriptase polymerase chain reaction (RT-PCR), Northern blot, serial analysis of gene expression (SAGE), immunoassay, and mass spectrometry) (e.g, wherein the lncRNA is one or more sequences selected from SEQ ID NO: 1 to SEQ ID NO: 3238), with the proviso that the lncRNAs, fragments thereof, isoforms thereof and variants sharing at least 80% nucleotide sequence identity thereto listed in Table 1 are not part of the present invention.

In various aspects, Method 4 includes the following:

4.1 Method 4, wherein the expression level of the lncRNA is measured by sequencing (e.g., next generation sequencing).

4.2 The method of any of the preceding methods, wherein measuring the expression level of the lncRNA comprises the steps of:
- (i) extracting RNA from the sample (e.g., blood sample),
- (ii) converting the RNA to cDNA,
- (iii) optionally, amplifying the cDNA by PCR, and
- (iv) sequencing the cDNA.

4.3 The method of any of the preceding methods further comprising a step of capturing and enriching extracted RNA or cDNA corresponding to lncRNAs of interest prior to sequencing, comprising the steps of:
- (1) hybridizing extracted RNA or cDNA to oligonucleotide probes specific to lncRNAs of interest (e.g., oligonucleotide probes comprising a sequence complementary to a region of lncRNAs of interest)

under a condition allowing for hybridization of the probes and RNA or cDNA corresponding to lncRNAs of interest to form probe-target nucleic acid complexes, and (2) purifying the probe-target nucleic acid complexes.

4.4 The method of Method 4.3 wherein oligonucleotide probes are hybridized to cDNA.

4.5 The method of any of Methods 4.3-4.4 wherein the oligonucleotide probe is biotinylated and purifying the probe-target nucleic acid complexes comprises binding the probe-target nucleic acid complexes to a streptavidin-coated substrate.

4.6 The method of Method 4.5 wherein the streptavidin-coated substrate is a streptavidin coated magnetic particle, e.g., T1 streptavidin coated magnetic bead.

4.7 The method of any of the preceding methods wherein the sample is blood sample.

4.8 Any of the preceding methods, wherein the lncRNA which is detected is selected from selected from the group consisting of:
  (i) 15 lncRNAs of SEQ ID NO: 1204, SEQ ID NO: 1736, SEQ ID NO: 0544, SEQ ID NO: 0915, SEQ ID NO:2368, SEQ ID NO: 1595, SEQ ID NO: 2382, SEQ ID NO: 0859, SEQ ID NO: 3112, SEQ ID NO: 1869, SEQ ID NO: 1406, SEQ ID NO: 0043, SEQ ID NO: 0363, SEQ ID NO: 0069 and SEQ ID NO: 1947;
  (ii) 11 lncRNAs of SEQ ID NO: 2373, SEQ ID NO: 1748, SEQ ID NO: 3112, SEQ ID NO: 1231, SEQ ID NO: 0664, SEQ ID NO: 1686, SEQ ID NO: 0791, SEQ ID NO: 2126, SEQ ID NO: 2750, SEQ ID NO: 3010, and SEQ ID NO: 2241;
  (iii) 14 lncRNAs of SEQ ID NO: 2150, SEQ ID NO: 1534, SEQ ID NO: 0311, SEQ ID NO: 2952, SEQ ID NO: 2838, SEQ ID NO: 1437, SEQ ID NO: 1297, SEQ ID NO: 1059, SEQ ID NO: 1465, SEQ ID NO: 2826, SEQ ID NO: 0180, SEQ ID NO: 0538, SEQ ID NO: 0258, and SEQ ID NO: 2273;
  (iv) 20 lncRNAs of SEQ ID NO: 0190, SEQ ID NO: 0359, SEQ ID NO: 0776, SEQ ID NO: 1421, SEQ ID NO: 1795, SEQ ID NO: 0477, SEQ ID NO: 1511, SEQ ID NO: 0435, SEQ ID NO: 1418, SEQ ID NO: 1025, SEQ ID NO: 0265, SEQ ID NO: 1311, SEQ ID NO: 2540, SEQ ID NO: 2323, SEQ ID NO: 3011, SEQ ID NO: 2447, SEQ ID NO: 2863, SEQ ID NO: 2697, SEQ ID NO: 3128, and SEQ ID NO: 2265;
  (v) 11 lncRNAs of SEQ ID NO: 2540, SEQ ID NO: 0545, SEQ ID NO: 1766, SEQ ID NO: 3011, SEQ ID NO: 0968, SEQ ID NO: 2371, SEQ ID NO: 1533, SEQ ID NO: 0749, SEQ ID NO: 0609, SEQ ID NO: 1446, and SEQ ID NO: 2986;
  (vi) 8 lncRNAs of SEQ ID NO: 1204, SEQ ID NO: 2454, SEQ ID NO: 0334, SEQ ID NO: 1403, SEQ ID NO: 1089, SEQ ID NO: 2692, SEQ ID NO: 2273, SEQ ID NO: 0502;
  (vii) 4 lncRNAs of SEQ ID NO: 0097, SEQ ID NO: 1947, SEQ ID NO: 1051 and SEQ ID NO: 2996; and
  (viii) lncRNAs in Table 4, Table 5, Table 8, Table 9, Table 12, Table 15, Table 18, Table 19, Table 20, Table 21, Table 22, Table 24, Table 25, Table 28, Table 29, Table 32, Table 33, Table 34, Table 35, Table 36, Table 37, Table 38, Table 39, Table 40, and/or Table 41.

The invention also provides for Method 5. Method 5 is a method for identifying lncRNA from a sample (e.g., a biological sample as described in any of Method 1 et seq, Method 2 et seq, and Method 3 et seq.), wherein the lncRNA can be used to treat, diagnose, and/or predict primary and secondary cardiac disorder(s) in a subject. The method comprises
  a.) isolating total RNA from the biological sample (e.g. cardiac biopsy, serum, or plasma)
  b.) sequencing total RNA from the sample and determining which are lncRNA; and
  c.) comparing the expression (e.g., either relative levels or presence or absence) of lncRNA to a control;
wherein the expression of the lncRNA, compared to a control, means that the lncRNA can be indicative of primary and secondary cardiac disorder(s) in a subject, with the proviso that the one or more lncRNAs, fragments thereof, isoforms thereof and variants sharing at least 80% nucleotide sequence identity thereto listed in Table 1 are not part of the present invention.

Method 5 uses any detection method described in Method 1 et seq, Method 2, et seq, Method 3, et seq., and/or Method 4 et seq.

In still a further aspect, the present invention also encompasses a diagnostic/prognostic kit for carrying out any of the previously cited methods (any of Method 1 et seq, Method 2, et seq, Method 3, et seq., and/or Method 4 et seq and/or Method 5 et seq.). In some embodiments, the diagnostic/prognostic kit comprises one or more oligonucleotide probes specific to lncRNAs of interest (e.g., lncRNAs selected from the group consisting of SEQ ID NO: 1 to SEQ ID NO: 3238, isoforms thereof, fragment thereof and variant sharing at least 80% nucleotide sequence homology) and a reagent for purifying the probe-target nucleic acid complexes. The oligonucleotide probes comprise a sequence complementary to a region of the lncRNAs of interest. The oligonucleotide probes may be DNA or RNA. The oligonucleotide probes are preferably DNA. The length of oligonucleotide probes may be from 30 to 80 nucleotides, e.g., from 40 to 70, from 40 to 60, or about 50 nucleotides. In a preferred embodiment, the oligonucleotide probes are biotinylated and the reagent for purifying the probe-target complexes is a streptavidin-coated substrate, e.g, a streptavidin-coated magnetic particle, e.g., T1 streptavidin coated magnetic bead.

In some embodiments, the diagnostic/prognostic kit comprises one or more oligonucleotide probes specific to one or more lncRNAs (i.e., oligonucleotide probes comprising a sequence complementary to a region of the lncRNAs of interest) selected from any of SEQ ID NO: 1 to SEQ ID NO: 3238.

In some embodiments, the diagnostic/prognostic kit comprises one or more oligonucleotide probes specific to one or more lncRNAs selected from the group consisting of:
  (i) 15 lncRNAs of SEQ ID NO: 1204, SEQ ID NO: 1736, SEQ ID NO: 0544, SEQ ID NO: 0915, SEQ ID NO:2368, SEQ ID NO: 1595, SEQ ID NO: 2382, SEQ ID NO: 0859, SEQ ID NO: 3112, SEQ ID NO: 1869, SEQ ID NO: 1406, SEQ ID NO: 0043, SEQ ID NO: 0363, SEQ ID NO: 0069 and SEQ ID NO: 1947;
  (ii) 11 lncRNAs of SEQ ID NO: 2373, SEQ ID NO: 1748, SEQ ID NO: 3112, SEQ ID NO: 1231, SEQ ID NO: 0664, SEQ ID NO: 1686, SEQ ID NO: 0791, SEQ ID NO: 2126, SEQ ID NO: 2750, SEQ ID NO: 3010, and SEQ ID NO: 2241;
  (iii) 14 lncRNAs of SEQ ID NO: 2150, SEQ ID NO: 1534, SEQ ID NO: 0311, SEQ ID NO: 2952, SEQ ID NO: 2838, SEQ ID NO: 1437, SEQ ID NO: 1297, SEQ ID NO: 1059, SEQ ID NO: 1465, SEQ ID NO: 2826, SEQ ID NO: 0180, SEQ ID NO: 0538, SEQ ID NO: 0258, and SEQ ID NO: 2273;

(iv) 20 lncRNAs of SEQ ID NO: 0190, SEQ ID NO: 0359, SEQ ID NO: 0776, SEQ ID NO: 1421, SEQ ID NO: 1795, SEQ ID NO: 0477, SEQ ID NO: 1511, SEQ ID NO: 0435, SEQ ID NO: 1418, SEQ ID NO: 1025, SEQ ID NO: 0265, SEQ ID NO: 1311, SEQ ID NO: 2540, SEQ ID NO: 2323, SEQ ID NO: 3011, SEQ ID NO: 2447, SEQ ID NO: 2863, SEQ ID NO: 2697, SEQ ID NO: 3128, and SEQ ID NO: 2265;

(v) 11 lncRNAs of SEQ ID NO: 2540, SEQ ID NO: 0545, SEQ ID NO: 1766, SEQ ID NO: 3011, SEQ ID NO: 0968, SEQ ID NO: 2371, SEQ ID NO: 1533, SEQ ID NO: 0749, SEQ ID NO: 0609, SEQ ID NO: 1446, and SEQ ID NO: 2986;

(vi) 8 lncRNAs of SEQ ID NO: 1204, SEQ ID NO: 2454, SEQ ID NO: 0334, SEQ ID NO: 1403, SEQ ID NO: 1089, SEQ ID NO: 2692, SEQ ID NO: 2273, SEQ ID NO: 0502;

(vii) 4 lncRNAs of SEQ ID NO: 0097, SEQ ID NO: 1947, SEQ ID NO: 1051 and SEQ ID NO: 2996; and (viii) lncRNAs in Table 4, Table 5, Table 8, Table 9, Table 12, Table 15, Table 18, Table 19, Table 20, Table 21, Table 22, Table 24, Table 25, Table 28, Table 29, Table 32, Table 33, Table 34, Table 35, Table 36, Table 37, Table 38, Table 39, Table 40, and/or Table 41.

EXAMPLES

Example 1 Identification of lncRNAs of the Invention

The inventors incorporate deep RNA-sequencing of cardiac biopsies starting from total RNA to characterize both coding and non-coding transcriptomes and identify cardiac relevant lncRNA through a multistep analysis procedure. The Inventors use differential expression analysis as well as novel transcript reconstruction and data integration into genome-wide data sets as well as previously characterized predicted human cardiac-specific lncRNA to systematically identify heart-specific lncRNAs. Using the aforementioned techniques, the Inventors can identify 3,238 lncRNAs potentially relevant to cardiac disorders. Indeed, hundreds of known lncRNA are differentially expressed in a control subject compared to a subject suffering from ischemic or dilated cardiomyopathies. The Inventors are able to determine that 1027 novel lncRNAs, including some orthologs predicted in the art, that are differentially expressed and/or cardiac-enriched.

Sample Collection

Cardiac biopsies are obtained from 5 control patients, 11 patients suffering ICM and 10 patients suffering DCM. Biopsies of control hearts are provided from subjects with either head injury (n=2) or subarachnoid haemorrhage (n=3). The protocol is approved by the Local Ethics Committee at Cardinal Stefan Wyszynski Institute of Cardiology (approval number IK-NP-0021-48/846/13 (Apr. 9, 2013). No donors or their relatives completed the National Refusal List. Heart biopsies obtained from the left ventricle are snap-frozen and stored at −80° C. until RNA isolation.

RNA Isolation

Total RNA is extracted from cardiac biopsies using the mirVana isolation kit (Life technologies, Merelbeke, Belgium). Potential contaminating genomic DNA is digested with DNase I (Qiagen, Venlo, The Netherlands). RNA concentration is measured with a Nanodrop spectrophotometer (Nanodrop products, Wilmington, USA) and RNA integrity is verified using a 2100 Bioanalyzer (Agilent technologies, Santa Clara, USA).

Biopsies Sequencing

Sequencing libraries are prepared from 0.5 µg of total RNA using the Illumina TruSeq stranded total RNA library preparation kit combined with the human/mouse/rat RiboZero rRNA removal kit (Illumina Inc. San Diego, USA, C). All steps are performed with the low-throughput protocol and according to the manufacturer's instructions. Briefly, cytoplasmic rRNA are hybridized to biotinylated target-specific oligos and removed using streptavidin coated magnetic beads. rRNA depleted RNA samples are then fragmented by heat digestion with divalent cations (8 minutes, 94° C.) and reverse transcribed into cDNA. To ensure strand specificity, single stranded cDNA is first synthetized using Super-Script II reverse transcriptase (Invitrogen) and random primers in the presence of Actinomycin D, and then converted to double stranded cDNA with the second strand marking mix that incorporates dUTP in place of dTTP. Resulting blunt ended cDNA are purified using AMPure XP magnetic beads. After a 3' end adenylation step, Illumina's adapters ligation is performed. The singled indexed libraries thus obtained are washed twice using AMPure XP beads to remove excess adapters and enriched by PCR (15 cycles). PCR products are purified with a final AMPure XP beads wash and sequencing ready libraries are eluted in 30 µl of resuspension buffer.

For quality control, 1 µl of each library is run on the Agilent Technologies 2100 Bioanalyzer using a DNA 1000 chip according to the manufacturer's recommendations. Absence of adapter dimers is checked and the average library size is determined by a region table. Libraries are quantified by qPCR using the KAPA Library quantification kit for Illumina Platforms (KAPAbiosystems). Samples are run in duplicate and quantified against a standard curve ranging from 20 to 2.10-4 pM. Library size previously determined on the Bioanalyzer is used for size correction of the calculated concentrations.

All libraries are sequenced with the Illumina NextSeq500 (2×75 bp).

Sequencing Analysis for Known Transcripts

All RNA-seq reads of 26 samples are aligned to human reference genome (hg19) using Tophat 2.1.0 (1). Bowtie index of UCSC reference sequences are downloaded from Illumina iGenomes. The transcript assembly is performed using cufflinks 2.2.1 (1) with –G option and the feature-Counts function of Rsubread R package (2). The GTF file is generated by integrating GENCODE comprehensive gene annotation release 19 (3) and human lncRNAs identified by Ounzain et al. (4). Cuffdiff (1) and DESeq2 (5) are respectively used for differential expression analysis. Transcripts with an adjusted p-value<0.05 between controls and failing hearts, or with a p-value<0.05 between ICM and DCM are considered to be differentially expressed.

Pipeline of Novel lncRNA Prediction

De Novo Transcript Assembly

RABT (Reference Annotation Based Transcript) assembly (6) is performed using cufflinks with –g option for 3 control samples, 3 ICM samples and 3 DCM samples. The GTF file is the same as the one used for known transcripts. The cuffcompare (1) program is used to compare the assembled transcripts to the reference annotated GTF file and to generate a new GTF file with all transcripts from 9 samples for further analysis.

Filtering for Novel lncRNAs

Filtering is done on Transfrag class codes generated by cuffcompare, transcript length, number of exons and protein coding potential. Firstly, the transcripts with code 'i', 'j', 'o', 'u', 'x' and '.' are extracted, all of which could potentially include novel lncRNAs. The 'i' category, for example, could contain the lncRNAs entirely within the intron of known genes. Similarly, the '.' category could be long non-coding isoforms of known genes. The 'o' category could include novel lncRNAs having generic exonic overlap with known transcripts. The V category could be long intergenic non-coding RNAs (lincRNAs). The 'x' category could contain novel lncRNAs on the opposite strand of reference genes. The category may be sequences with multiple classifications. The combined GTF file is converted to a BED file using UCSC table browser (7). Following this, only the transcripts with a length of ≥200 nt and with at least 2 exons are kept for the next step. Finally, the BED files of transcripts from the last 2 filtering steps are uploaded to CPAT (Coding-Potential Assessment Tool) (8) to calculate the coding potential score. The transcripts with CPAT scores <0.364 are considered as non-coding. A new GTF file is generated with the final list of selected novel lncRNAs.

Differential Expression of Novel lncRNAs

The cuffdiff (1) is used for all 26 samples with the new GTF file of novel lncRNAs. Transcripts with an adjusted p-value<0.05 are considered to be differentially expressed.

Analysis for Public Dataset

Fastq files of GSE45326 are downloaded from ArrayExpress (9). The dataset includes RNA-seq data of 12 normal human tissues. The paired-end sequencing is performed on ribominus total RNA library. Reads alignment and transcript assembly for known genes are performed as described before. Cufflinks (1) with the GTF file of novel lncRNAs is used to calculate FPKM of novel lncRNAs in each tissue. The transcripts with FPKM≥1 and at least twice higher than the FPKM of any other tissues are considered as cardiac-enriched.

The selection of the lncRNA of the panel is a multistep procedure:

Known transcripts selection.

In a first step, the inventors focused on the identification of known lncRNA that are relevant to cardiac pathophysiology. After data alignment and transcript reconstruction using both Cufflink and features counts using Gencode19, the authors used two distinct tools that use different approaches for differential expression analysis, respectively Cuffdiff and DeSeq2, and only transcripts showing high expression (fragments per kilobase of transcript per million mapped reads (FPKM) FPKM or FPM≥1) in at least half the samples of one group are considered. Differential expression using both tools is analysed in controls vs ICM samples, controls vs DCM samples, as well as ICM vs DCM samples. 80 and 1193 differentially expressed transcripts between any of the groups are identified with Cuffdiff and DeSeq2 analysis respectively. This difference is mainly due to the low number of lncRNA flagged OK by Cuffdiff (ie, neither NOTEST nor HIDATA). As those excluded lncRNA are included in the DeSeq2 analysis, Cuffdiff default settings are not modified. Interestingly, we observed from the DeSeq2 analysis that even if the majority of differentially expressed transcripts in controls vs ICM samples are also differentially expressed in controls vs DCM samples (and vice versa), about one third of them are ICM or DCM specific, illustrating that as the coding transcriptome, the noncoding transcriptome shows features common to a common heart defect (cardiomyopathies) but also specific ones differentiating the physiological bases of this defect (ischemic vs non-ischemic). Moreover, 97 lncRNAs are also differentially expressed between ICM and DCM patients, differentiating the 2 pathologies. Similar observations are made from the Cuffdiff analysis.

The authors also focused on highly expressed non coding transcripts and thus selected 687 lncRNA having a FPKM or FPM≥2 to include in the panel.

In summary, the authors identified 1,835 lncRNA corresponding to 1,501 genes, previously annotated in Gencode19, as relevant for cardiac function.

Predicted Human Orthologs Selection

In order to validate the relevance of the humans orthologs identified by Ounzain et al, the authors realized the same analysis using the GTF file containing the predicted human orthologs as reference for transcripts reconstruction. Surprisingly, the inventors identified few predicted orthologs that are expressed in human tissue: 86 corresponding to 77 genes. Among them, 75 are differentially expressed lncRNA across the control, ICM and DCM groups, 16 highly expressed (FPKM or FPM≥2) lncRNA and 5 of them fitted the 2 criteria. This unexpected low amount of validated predicted human orthologs can in part be explained by the different sequencing approaches used in the 2 studies. Nonetheless, the so identified lncRNAs, shown to be highly tissue and context specific in mice and validated in human cardiac disorders appear to be promising biomarker candidates playing crucial roles in cardiac function regulation.

Cardiac-Enriched Transcripts Selection

As stated in the previous study from Ounzain et al, lncRNA regulating cardiac homeostasis identified in mice are highly context specific but also and importantly, cardiac tissue specific.

This led us to look for non-coding transcripts that are enriched in the cardiac tissue compared to others and thus might play important roles in cardiac functions. By comparing public RNA-seq data from 12 human tissues (heart, brain, bladder, colon, breast, skin, lung, ovary, kidney, prostate, liver, muscle), the inventors identified 470 and 24 lncRNA, from known and Human predicted transcripts respectively, that had at least a 2 fold higher expression rate in cardiac tissue than in any other tissue.

Novel Transcripts Selection

The growing interest on lncRNA together with the development of next generation sequencing techniques over the past years has led to a better knowledge of these non-coding transcripts. Nonetheless, non-coding transcripts account for the majority of the human transcriptome and have so far not been completely characterized. The authors thus performed very deep sequencing to allow for discovery of novel transcripts. After de novo transcript reconstruction and transcript selection as detailed in the material and methods, the inventors can identify over 13,000 new transcripts with no coding potential. Among them, they can identify 696 lncRNA differentially expressed between the 3 groups (FDR<0.05) and 810 lncRNA enriched in cardiac tissue. The transcripts having class codes 'o', 'j' or 'i' and highly positively correlated with overlapped known genes are eliminated. ('i' category, for example, could contain the lncRNAs entirely within the intron of known genes, the 'j' category could be long non-coding isoforms of known genes and the 'o' category could include novel lncRNAs having generic exonic overlap with known transcripts). The transcripts with class codes 'j' or 'o' and overlapping with exons of known protein-coding genes on the same strand are discarded. This resulted in a total number of novel lncRNAs of 755 relevant to cardiac physiology.

In summary, the inventors identified a highly relevant panel of 3,092 cardiac-related lncRNAs. This panel encompasses 2,317 known transcripts here shown to be relevant to cardiac physiology, as well as 755 lncRNA, here described for the first time and relevant to cardiac tissue.

Example 2

LncRNA Detection in Plasma Samples and PCR Validation in Biopsies

Sample Selection: Mitocare Aidbank/

Like miRNA, lncRNA can be released from the original tissue into the body circulation. Thus such markers may be detected in body fluids like whole blood or plasma which facilitates their use in clinics. The expression of four lncRNA previously identified is verified in plasma samples from patients who suffered AMI versus control patients.

Plasma samples from 3 control subjects and 3 subjects who suffered AMI are used. RNA extraction is performed using Norgen Serum/plasma extraction kit according to the manufacturer's instructions. Isolated RNAs are then subjected to reverse transcription using the high capacity cDNA synthesis kit with the following thermal conditions: 25° C. for 10 min, 37° C. for 2 hours, 85° C. for 5 min Preamplification reactions are prepared using Applied Biosystems preamplication master mix with 0.1× (100 nM) of each of the 4 primers pairs corresponding to the lncRNAs of interest (sequences listed below). 16 preamplification cycles are performed as recommended by the furnisher (50° C. 2 minutes, 96° C. 10 minutes, 40 cycles at 95° C. for 15 seconds and 60° C. for 1 minute). Preamplified products are then diluted 1/20 in TE buffer and quantified by qPCR using the Biorad Ssoadvanced SYBR green kit. Briefly, 15 µl reactions containing 6 ul of each diluted sample are amplified in a 1× ready to use reaction mix containing 500 µl of the diluted sample, 1× biorad reaction mix and 500 nM sense and reverse primers are amplified on a ABIHT7900 with the following conditions: 30 sec 95° C., 40 cycles of 15 sec at 95° C. denaturation and 30 sec at 60° C. annealing and extension). Relative expression level is determined against a standard curve realized on a 5 log scale.

TABLE 2

| | |
|---|---|
| Lnc21524Se (SEQ ID NO: 3239) | TTGAATCCTGGCTTTGCTCT |
| Lnc21524As (SEQ ID NO: 3240) | GGAAAGGCAATTGAGTGAGG |
| Lnc23749Se (SEQ ID NO: 3241) | TTGGTCTTTCACCCTTCCTG |
| Lnc23749As (SEQ ID NO: 3242) | GAAAACGTCCTCCCTCCTTC |
| Lnc19889Se (SEQ ID NO: 3243) | ACACGGGAAGCTCTTTGAGA |
| Lnc19889As (SEQ ID NO: 3244) | TCAAGAGGGAAGGATGGATG |
| LncAnx5aSe (SEQ ID NO: 3245) | GAATTTCTGGGGACCTTTCC |
| LncAnx5aAs (SEQ ID NO: 3246) | GCAAAGGGAGAGAAAGCAGA |

Figure 4:
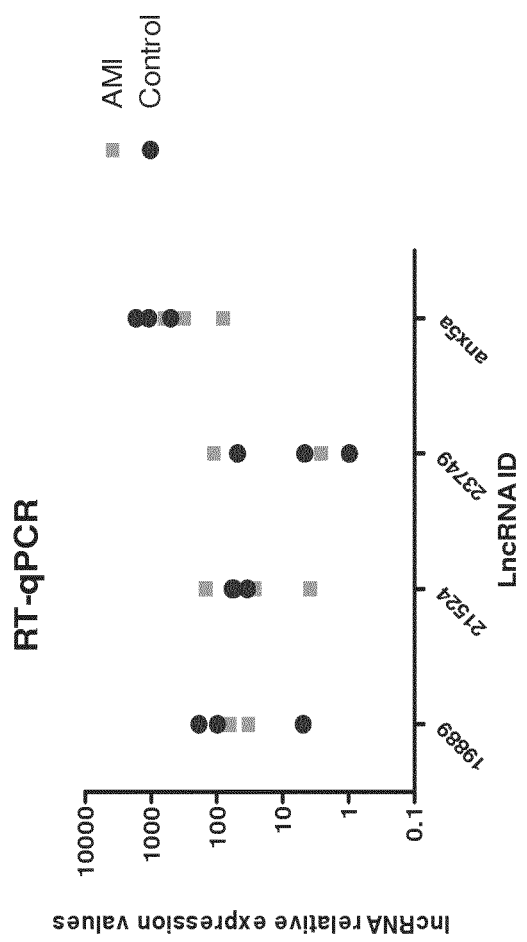
FIG. 4 shows the expression of 4 lncRNA in human plasma samples as analyzed by qRT-PCR after preamplification: AMI indicated by a square and Control indicated by a circle.

In FIG. 4, the authors showed that lncRNA are indeed detectable in plasma samples. Moreover expression profile compared to NGS data (lnc21524 identified with NGS need more precision on DE).

Example 3: lncRNA Detection in Serum Samples Using a Total RNA-Seq Protocol

Material and Methods:

Quantification of lncRNAs in body fluids like whole blood, serum or plasma is a non-invasive way to develop a diagnostic test to use in clinics. The expression of circulating lncRNA released by the tissues was studied in serum samples from patients with AMI and control subjects. Serum samples collected at discharge of patient between D3 and D5 from 30 patients with AMI from the MitoCare cohort were used for lncRNA profiling. Mitocare is a multicenter, randomized, double-blind, placebo controlled study. The study population includes AMI patients undergoing PCI (Percutaneous Coronary Intervention), older than 18 years. The primary endpoint is the level of left ventricular ejection fraction (LVEF) less than 40% at 1 month. Patients demographics are presented in Table 3. Control serum samples were selected from subjects of ADDIA Chronobiological study.

TABLE 3

Demographic data of Mitocare samples:

| | Group 1 | Group 2 | Group 3 |
|---|---|---|---|
| EF | <40 | 41-50 | >50 |
| Nb | 10 | 10 | 10 |
| Age | 64.0 | 64.2 | 60.9 |
| Male | 80% | 80% | 70% |
| BMI | 27.4 | 28.3 | 27.6 |
| Systolic Blood Pressure | 103.5 | 116.9 | 113.6 |
| Diastolic Blood Pressure | 67.4 | 70.2 | 66.5 |
| Heart Rate | 83.3 | 75.9 | 69.3 |

Serum Samples Sequencing

RNA is extracted from 1.5 ml of serum, using Norgen Serum extraction and RNA Clean-Up and Concentration Micro-Elute Kits according to the manufacturer's instructions. Sequencing libraries are prepared from the total amount of extracted RNA, using the Illumina TruSeq stranded total RNA library preparation kit combined with the human/mouse/rat RiboZero rRNA removal kit (Illumina Inc. San Diego, USA, C). All steps are performed with the low-throughput protocol and according to the manufacturer's instructions, with no fragmentation step. Briefly, cytoplasmic rRNA are hybridized to biotinylated target-specific oligos and removed using streptavidin coated magnetic beads. rRNA depleted RNA samples are then reverse transcribed into cDNA. To ensure strand specificity, single stranded cDNA is first synthetized using Super-Script II reverse transcriptase (Invitrogen) and random primers in the presence of Actinomycin D, and then converted to double stranded cDNA with the second strand marking mix that incorporates dUTP in place of dTTP. Resulting blunt ended cDNA are purified using AMPure XP magnetic beads. After a 3' end adenylation step, Illumina's adapters ligation is performed. So obtained singled indexed libraries are washed twice using AMPure XP beads to remove excess adapters and enriched by PCR (15 cycles). PCR products are purified with a final AMPure XP beads wash and sequencing ready libraries are eluted in 30 µl of resuspension buffer.

For quality control, 1 µl of each library is run on the Agilent Technologies 2100 Bioanalyzer using a DNA 1000 chip according to the manufacturer's recommendations. Absence of adapter dimers is checked and the average library size is determined by a region table. Libraries are quantified on Qubit 2.0 using Qubit dsDNA High Sensitivity assay kit (Invitrogen). Library size previously determined on the Bioanalyzer is used to calculate molar concentrations from mass concentrations.

All libraries are sequenced with the Illumina NextSeq500 (2×75 bp).

Sequencing Analysis for the 3238 lncRNAs

RNA-seq data analysis is performed using Partek Flow (Partek Inc., St Louis, Mo., USA build 6). The pre-alignment QA/QC module of Partek Flow is used to visualize the read quality of the FASTQ files. All reads are examined. The raw FASTQ files are trimmed at the 3' end in function of their quality score (Phred score). The parameters used are an end minimum quality level of 30 and a minimum trimmed read length of 50. Unaligned reads are mapped using the *Homo* sapiens hg19 genome and using as guide a GTF file with the patented lncRNA annotation. This mapping is done using the software STAR version 2.5.3. The default parameters are used. The post-alignment QC module of Partek Flow is used to visualize the average base quality score per position as well as the mapping quality per alignment. The mapped reads are quantified using the GTF file with the patented lncRNA annotation for quantification using the Partek Expectation/Maximization (E/M) algorithm. The default parameters are used. The transcript counts are normalized by CPM (counts per million). Only transcripts showing high expression (CPM≥10) in at least half the samples of one group are considered.

Statistical Analysis and Predictive Modelling

For the statistical analysis, samples are grouped into 2 groups based on the left ventricular ejection fraction (LVEF) measured by echocardiography at 1-month after the PCI. To identify differentially expressed lncRNA, a statistical analysis is performed using a non-parametric Wilcoxon-Mann-Whitney test and a parametric T-test. A lncRNA with a p-value≤0.05 is considered as differentially expressed.

In order to build classification models for the 2 classifications, the Classification for MicroArrays (CMA) package of R (Slawski et al, 2008) with a leave-one-out cross-validation is used. The algorithms used for this predictive modelling are (a) random forest, (b) linear discriminant analysis and (c) naïve Bayes.

Results:

Comparison Between Low LVEF (LVEF≤40) and High LVEF (LVEF>40)

First, samples were grouped into 2 groups by a dichotomized variable: 1-month LVEF<40% considered as LV dysfunction (Ventricular remodeling) and 1-month LVEF>40% considered as preserved LV function. The volcano plot showed the differential expression of lncRNA. 192 lncRNAs are differentially expressed and among these, 20 lncRNAs are differentially expressed and have a fold change>2 or <0.5 between the low LVEF (LVEF≤40) and the high LVEF (LVEF>40) groups. The p-value and the fold-change of these lncRNA are listed in the Table 4. 316 lncRNAs which have a P<0.05 and/or an individual AUC>0.7 or <0.3 are listed in Table 5.

TABLE 4

List of 20 lncRNAs which are differentially expressed between the low LVEF group (LVEF ≤ 40) and the high LVEF group (LVEF > 40)

| lncRNA | p-value | Fold change |
|---|---|---|
| SEQ ID NO: 0930 | 0.03736 | 2.042 |
| SEQ ID NO: 0821 | 0.03299 | 0.491 |
| SEQ ID NO: 1196 | 0.00653 | 2.648 |
| SEQ ID NO: 0664 | 0.00660 | 0.441 |
| SEQ ID NO: 2642 | 0.04102 | 2.623 |
| SEQ ID NO: 1910 | 0.04224 | 2.669 |
| SEQ ID NO: 1239 | 0.01161 | 0.475 |
| SEQ ID NO: 0243 | 0.04133 | 0.490 |
| SEQ ID NO: 2368 | 0.00240 | 0.443 |
| SEQ ID NO: 0283 | 0.01599 | 2.363 |
| SEQ ID NO: 1837 | 0.04199 | 0.416 |
| SEQ ID NO: 0527 | 0.01436 | 0.487 |
| SEQ ID NO: 1167 | 0.01803 | 0.296 |
| SEQ ID NO: 0153 | 0.04675 | 2.333 |
| SEQ ID NO: 1757 | 0.04483 | 2.224 |
| SEQ ID NO: 1719 | 0.02190 | 0.367 |
| SEQ ID NO: 1650 | 0.00217 | 0.487 |
| SEQ ID NO: 0051 | 0.01192 | 52.864 |
| SEQ ID NO: 1410 | 0.00818 | 2.953 |
| SEQ ID NO: 2699 | 0.02230 | 2.072 |

TABLE 5

List of 316 lncRNAs which are differentially expressed and/or have an AUC >0.7 or <0.3 between the low LVEF group (LVEF ≤ 40) and the high LVEF group (LVEF > 40)

| LncRNA (SEQ ID NO:) | p-value | AUC |
|---|---|---|
| 0005 | 0.033 | 0.755 |
| 0033 | 0.131 | 0.715 |
| 0037 | 0.061 | 0.73 |
| 0042 | 0.119 | 0.715 |
| 0043 | 0.068 | 0.175 |
| 0051 | 0.012 | 0.225 |
| 0069 | 0.168 | 0.255 |
| 0075 | 0.028 | 0.745 |
| 0119 | 0.021 | 0.33 |
| 0120 | 0.046 | 0.735 |
| 0136 | 0.026 | 0.71 |
| 0141 | 0.05 | 0.28 |
| 0153 | 0.047 | 0.328 |
| 0163 | 0.083 | 0.285 |
| 0169 | 0.042 | 0.73 |
| 0172 | 0.045 | 0.74 |
| 0173 | 0.046 | 0.76 |
| 0189 | 0.024 | 0.755 |
| 0190 | 0.043 | 0.73 |
| 0199 | 0.004 | 0.83 |
| 0208 | 0.027 | 0.283 |
| 0216 | 0.087 | 0.735 |
| 0226 | 0.083 | 0.72 |
| 0243 | 0.041 | 0.73 |
| 0244 | 0.01 | 0.24 |
| 0283 | 0.016 | 0.27 |
| 0290 | 0.079 | 0.715 |
| 0312 | 0.065 | 0.25 |
| 0321 | 0.022 | 0.815 |
| 0334 | 0.017 | 0.785 |
| 0339 | 0.042 | 0.71 |
| 0363 | 0.001 | 0.87 |
| 0366 | 0.216 | 0.3 |
| 0383 | 0.052 | 0.7 |
| 0386 | 0.113 | 0.715 |
| 0388 | 0.116 | 0.71 |
| 0392 | 0.029 | 0.74 |
| 0398 | 0.027 | 0.795 |
| 0405 | 0.051 | 0.73 |
| 0420 | 0.06 | 0.72 |
| 0454 | 0.06 | 0.295 |
| 0493 | 0.05 | 0.715 |
| 0495 | 0.072 | 0.755 |
| 0502 | 0.065 | 0.75 |
| 0538 | 0.083 | 0.715 |
| 0544 | 0.002 | 0.825 |
| 0552 | 0.039 | 0.775 |
| 0560 | 0.063 | 0.725 |
| 0565 | 0.064 | 0.7 |
| 0586 | 0.032 | 0.775 |
| 0615 | 0.008 | 0.825 |
| 0638 | 0.017 | 0.77 |
| 0643 | 0.072 | 0.725 |
| 0664 | 0.007 | 0.815 |
| 0677 | 0.073 | 0.74 |
| 0685 | 0.014 | 0.79 |
| 0688 | 0.079 | 0.72 |
| 0702 | 0.035 | 0.77 |

TABLE 5-continued

List of 316 lncRNAs which are differentially expressed and/or have an AUC >0.7 or <0.3 between the low LVEF group (LVEF ≤ 40) and the high LVEF group (LVEF > 40)

| LncRNA (SEQ ID NO:) | p-value | AUC |
|---|---|---|
| 0745 | 0.029 | 0.725 |
| 0748 | 0.052 | 0.71 |
| 0753 | 0.063 | 0.7 |
| 0781 | 0.015 | 0.76 |
| 0796 | 0.065 | 0.7 |
| 0821 | 0.033 | 0.738 |
| 0858 | 0.129 | 0.7 |
| 0861 | 0.082 | 0.715 |
| 0866 | 0.036 | 0.735 |
| 0904 | 0.042 | 0.73 |
| 0910 | 0.054 | 0.72 |
| 0915 | 0.009 | 0.81 |
| 0917 | 0.025 | 0.765 |
| 0925 | 0.037 | 0.72 |
| 0930 | 0.037 | 0.3 |
| 0935 | 0.039 | 0.72 |
| 0944 | 0.055 | 0.725 |
| 0948 | 0.073 | 0.28 |
| 0959 | 0.029 | 0.745 |
| 0994 | 0.12 | 0.715 |
| 1001 | 0.11 | 0.713 |
| 1004 | 0.041 | 0.715 |
| 1014 | 0.037 | 0.74 |
| 1036 | 0.038 | 0.25 |
| 1040 | 0.134 | 0.72 |
| 1042 | 0.046 | 0.31 |
| 1046 | 0.006 | 0.785 |
| 1075 | 0.069 | 0.7 |
| 1081 | 0.055 | 0.73 |
| 1089 | 0.045 | 0.765 |
| 1094 | 0.013 | 0.78 |
| 1095 | 0.089 | 0.74 |
| 1113 | 0.037 | 0.725 |
| 1114 | 0.063 | 0.71 |
| 1127 | 0.061 | 0.715 |
| 1171 | 0.106 | 0.745 |
| 1179 | 0.049 | 0.28 |
| 1182 | 0.032 | 0.73 |
| 1198 | 0.016 | 0.765 |
| 1204 | 0 | 0.88 |
| 1205 | 0.001 | 0.8 |
| 1214 | 0.045 | 0.71 |
| 1231 | 0.037 | 0.3 |
| 1240 | 0.044 | 0.74 |
| 1271 | 0.109 | 0.715 |
| 1276 | 0.053 | 0.725 |
| 1281 | 0.016 | 0.22 |
| 1286 | 0.409 | 0.71 |
| 1301 | 0.087 | 0.71 |
| 1319 | 0.048 | 0.32 |
| 1329 | 0.006 | 0.245 |
| 1340 | 0.084 | 0.283 |
| 1347 | 0.065 | 0.705 |
| 1348 | 0.013 | 0.275 |
| 1356 | 0.099 | 0.705 |
| 1373 | 0.024 | 0.215 |
| 1377 | 0.121 | 0.7 |
| 1385 | 0.117 | 0.71 |
| 1391 | 0.133 | 0.71 |
| 1398 | 0.004 | 0.195 |
| 1403 | 0.018 | 0.775 |
| 1404 | 0.109 | 0.705 |
| 1406 | 0.083 | 0.74 |
| 1410 | 0.008 | 0.235 |
| 1412 | 0.042 | 0.775 |
| 1420 | 0.042 | 0.75 |
| 1428 | 0.006 | 0.225 |
| 1442 | 0.026 | 0.715 |
| 1444 | 0.057 | 0.29 |
| 1449 | 0.089 | 0.7 |
| 1454 | 0.098 | 0.708 |
| 1462 | 0.071 | 0.728 |
| 1468 | 0.002 | 0.81 |
| 1483 | 0.041 | 0.27 |
| 1518 | 0.154 | 0.71 |
| 1528 | 0.018 | 0.735 |
| 1556 | 0.102 | 0.72 |
| 1564 | 0.018 | 0.765 |
| 1576 | 0.051 | 0.725 |
| 1583 | 0.083 | 0.715 |
| 1595 | 0.152 | 0.715 |
| 1601 | 0.007 | 0.24 |
| 1618 | 0.056 | 0.275 |
| 1626 | 0.004 | 0.785 |
| 1632 | 0.048 | 0.305 |
| 1638 | 0.091 | 0.275 |
| 1656 | 0.083 | 0.725 |
| 1667 | 0.022 | 0.735 |
| 1674 | 0.006 | 0.8 |
| 1683 | 0.024 | 0.745 |
| 1692 | 0.084 | 0.745 |
| 1693 | 0.05 | 0.7 |
| 1705 | 0.12 | 0.295 |
| 1707 | 0.016 | 0.77 |
| 1712 | 0.063 | 0.71 |
| 1715 | 0.01 | 0.665 |
| 1719 | 0.022 | 0.77 |
| 1726 | 0.006 | 0.23 |
| 1732 | 0.002 | 0.855 |
| 1733 | 0.046 | 0.74 |
| 1737 | 0.037 | 0.315 |
| 1746 | 0.137 | 0.705 |
| 1757 | 0.045 | 0.338 |
| 1793 | 0.13 | 0.71 |
| 1804 | 0.056 | 0.75 |
| 1809 | 0.05 | 0.305 |
| 1818 | 0.022 | 0.74 |
| 1819 | 0.031 | 0.8 |
| 1820 | 0.154 | 0.255 |
| 1837 | 0.042 | 0.748 |
| 1842 | 0.035 | 0.735 |
| 1853 | 0.194 | 0.705 |
| 1869 | 0.051 | 0.755 |
| 1910 | 0.042 | 0.37 |
| 1926 | 0.061 | 0.755 |
| 1938 | 0.058 | 0.71 |
| 1942 | 0.048 | 0.72 |
| 1947 | 0.091 | 0.733 |
| 1950 | 0.156 | 0.71 |
| 1954 | 0.174 | 0.29 |
| 1979 | 0.04 | 0.72 |
| 1983 | 0.002 | 0.865 |
| 2026 | 0.031 | 0.71 |
| 2049 | 0.012 | 0.78 |
| 2053 | 0.121 | 0.71 |
| 2061 | 0.068 | 0.29 |
| 2074 | 0.004 | 0.215 |
| 2100 | 0.007 | 0.78 |
| 2114 | 0.062 | 0.725 |
| 2121 | 0.058 | 0.725 |
| 2126 | 0.032 | 0.25 |
| 2157 | 0.049 | 0.695 |
| 2162 | 0.051 | 0.705 |
| 2190 | 0.109 | 0.705 |
| 2209 | 0.074 | 0.81 |
| 2216 | 0.077 | 0.71 |
| 2240 | 0.069 | 0.27 |
| 2253 | 0.006 | 0.19 |
| 2260 | 0.063 | 0.285 |
| 2273 | 0.064 | 0.72 |
| 2274 | 0.043 | 0.27 |
| 2282 | 0.023 | 0.235 |
| 2286 | 0.06 | 0.295 |
| 2287 | 0.048 | 0.27 |
| 2288 | 0.007 | 0.2 |
| 2294 | 0.086 | 0.705 |
| 2299 | 0.015 | 0.765 |
| 2314 | 0.019 | 0.735 |

TABLE 5-continued

List of 316 lncRNAs which are differentially expressed and/or have an AUC >0.7 or <0.3 between the low LVEF group (LVEF ≤ 40) and the high LVEF group (LVEF > 40)

| LncRNA (SEQ ID NO:) | p-value | AUC |
|---|---|---|
| 2320 | 0.005 | 0.83 |
| 2344 | 0.024 | 0.72 |
| 2349 | 0.1 | 0.275 |
| 2352 | 0.033 | 0.32 |
| 2353 | 0.075 | 0.705 |
| 2360 | 0.045 | 0.295 |
| 2368 | 0.002 | 0.85 |
| 2373 | 0 | 0.85 |
| 2374 | 0.016 | 0.245 |
| 2377 | 0.036 | 0.73 |
| 2382 | 0.012 | 0.835 |
| 2385 | 0.05 | 0.72 |
| 2402 | 0.003 | 0.82 |
| 2405 | 0.102 | 0.7 |
| 2407 | 0.1 | 0.275 |
| 2411 | 0.047 | 0.7 |
| 2454 | 0.015 | 0.755 |
| 2457 | 0.027 | 0.74 |
| 2461 | 0.031 | 0.245 |
| 2466 | 0.138 | 0.71 |
| 2470 | 0.001 | 0.15 |
| 2472 | 0.032 | 0.255 |
| 2478 | 0.02 | 0.23 |
| 2484 | 0.038 | 0.28 |
| 2485 | 0.026 | 0.375 |
| 2501 | 0.008 | 0.805 |
| 2502 | 0.049 | 0.745 |
| 2518 | 0.091 | 0.29 |
| 2521 | 0.015 | 0.3 |
| 2523 | 0.019 | 0.76 |
| 2540 | 0.019 | 0.745 |
| 2544 | 0.022 | 0.255 |
| 2560 | 0.075 | 0.705 |
| 2567 | 0.026 | 0.745 |
| 2593 | 0.057 | 0.29 |
| 2605 | 0.044 | 0.32 |
| 2618 | 0.032 | 0.215 |
| 2622 | 0.118 | 0.29 |
| 2631 | 0.027 | 0.27 |
| 2644 | 0.054 | 0.285 |
| 2657 | 0.033 | 0.65 |
| 2658 | 0.069 | 0.27 |
| 2677 | 0.037 | 0.7 |
| 2684 | 0.005 | 0.185 |
| 2692 | 0.062 | 0.28 |
| 2695 | 0.026 | 0.24 |
| 2696 | 0.07 | 0.265 |
| 2697 | 0.045 | 0.725 |
| 2698 | 0.052 | 0.705 |
| 2699 | 0.022 | 0.325 |
| 2702 | 0.041 | 0.34 |
| 2703 | 0.005 | 0.805 |
| 2715 | 0.032 | 0.25 |
| 2720 | 0.054 | 0.7 |
| 2726 | 0.04 | 0.735 |
| 2750 | 0.047 | 0.735 |
| 2752 | 0.025 | 0.695 |
| 2753 | 0.06 | 0.735 |
| 2785 | 0.039 | 0.275 |
| 2794 | 0.035 | 0.32 |
| 2800 | 0.18 | 0.705 |
| 2825 | 0.11 | 0.7 |
| 2830 | 0.018 | 0.72 |
| 2833 | 0.158 | 0.295 |
| 2853 | 0.003 | 0.785 |
| 2875 | 0.047 | 0.28 |
| 2882 | 0.037 | 0.24 |
| 2896 | 0.02 | 0.27 |
| 2912 | 0.119 | 0.7 |
| 2921 | 0.06 | 0.295 |
| 2922 | 0.015 | 0.25 |
| 2928 | 0.016 | 0.775 |
| 2930 | 0.046 | 0.295 |
| 2960 | 0.057 | 0.28 |
| 2971 | 0.024 | 0.755 |
| 2973 | 0.039 | 0.28 |
| 2974 | 0.067 | 0.7 |
| 2982 | 0.007 | 0.22 |
| 2998 | 0.022 | 0.765 |
| 3002 | 0.04 | 0.69 |
| 3006 | 0.023 | 0.77 |
| 3007 | 0.041 | 0.26 |
| 3013 | 0.05 | 0.725 |
| 3040 | 0.066 | 0.705 |
| 3048 | 0.017 | 0.31 |
| 3066 | 0.009 | 0.805 |
| 3070 | 0.052 | 0.3 |
| 3080 | 0.045 | 0.25 |
| 3085 | 0.034 | 0.725 |
| 3112 | 0.029 | 0.265 |
| 3113 | 0.024 | 0.28 |
| 3118 | 0.085 | 0.265 |
| 3128 | 0.034 | 0.295 |
| 3129 | 0.005 | 0.19 |
| 3133 | 0.019 | 0.765 |
| 3141 | 0.126 | 0.74 |
| 3142 | 0.107 | 0.295 |
| 3143 | 0.025 | 0.305 |
| 3153 | 0.005 | 0.795 |
| 3156 | 0.051 | 0.71 |
| 3170 | 0.044 | 0.295 |
| 3180 | 0.039 | 0.725 |
| 3184 | 0.024 | 0.28 |
| 3187 | 0.024 | 0.33 |
| 3200 | 0.049 | 0.26 |
| 3203 | 0.002 | 0.19 |
| 3204 | 0.017 | 0.75 |
| 3210 | 0.044 | 0.665 |
| 3221 | 0.002 | 0.135 |
| 3230 | 0.036 | 0.3 |

For this classification, the variable selection was performed by using a Random Forest model. A combination of 15 pre-selected lncRNAs through a Random Forest Classifier (Table 6) is the best predictive model obtained here. The lncRNAs were selected using a random forest algorithm. This model has an area under the receiver-operating characteristic curve (AUC) of 0.988, an accuracy of 0.9, a sensitivity of 0.8, a specificity of 0.95, a Positive Predictive Value (PPV) of 0.889 and Negative Predictive Value (PNV) of 0.905. The confusion matrix is presented in Table 7.

TABLE 6

List of 15 pre-selected lncRNAs through a Random Forest Classifier for the classification low LVEF (LVEF ≤ 40) and high LVEF (LVEF > 40)

| lncRNA | Rank in the model |
|---|---|
| SEQ ID NO: 1204 | 1 |
| SEQ ID NO: 1736 | 2 |
| SEQ ID NO: 0544 | 3 |
| SEQ ID NO: 0915 | 4 |
| SEQ ID NO: 2368 | 5 |
| SEQ ID NO: 1595 | 6 |
| SEQ ID NO: 2382 | 7 |
| SEQ ID NO: 0859 | 8 |
| SEQ ID NO: 3112 | 9 |
| SEQ ID NO: 1869 | 10 |
| SEQ ID NO: 1406 | 11 |
| SEQ ID NO: 0043 | 12 |
| SEQ ID NO: 0363 | 13 |

TABLE 6-continued

List of 15 pre-selected lncRNAs through a Random Forest Classifier for the classification low LVEF (LVEF ≤ 40) and high LVEF (LVEF > 40)

| lncRNA | Rank in the model |
|---|---|
| SEQ ID NO: 0069 | 14 |
| SEQ ID NO: 1947 | 15 |

TABLE 7

Confusion matrix of the best model for this classification

| | Low LVEF predicted | High LVEF predicted |
|---|---|---|
| Low LVEF real | 8 | 2 |
| High LVEF real | 1 | 19 |

Comparison between low LVEF (LVEF≤45) and high LVEF (LVEF>45) In this analysis, samples were grouped into 2 groups using the threshold of 45% LVEF: low LVEF (LVEF≤45) and high LVEF (LVEF>45). The volcano plot showed the differential expression of lncRNA. 147 lncRNAs are differentially expressed and among them 15 lncRNA are differentially expressed and have a fold change>2 or <0.5 between the low LVEF (LVEF≤45) and the high LVEF (LVEF>45) groups. The p-value and the fold-change of these lncRNA are listed in the Table 8. 206 lncRNAs which have a P<0.05 and/or an individual AUC>0.7 or <0.3 are listed in Table 9.

TABLE 8

List of 15 lncRNAs which are differentially expressed and have a fold change >2 or <0.5 between the low LVEF group (LVEF ≤ 45) and the high LVEF group (LVEF > 45)

| lncRNA | p-value | fold change |
|---|---|---|
| SEQ ID NO: 2114 | 0.03396 | 0.471 |
| SEQ ID NO: 2512 | 0.04168 | 0.498 |
| SEQ ID NO: 0372 | 0.02201 | 0.427 |
| SEQ ID NO: 0821 | 0.03922 | 0.499 |
| SEQ ID NO: 0664 | 0.00001 | 0.253 |
| SEQ ID NO: 1239 | 0.02909 | 0.499 |
| SEQ ID NO: 2709 | 0.04561 | 0.433 |
| SEQ ID NO: 1385 | 0.03278 | 0.490 |
| SEQ ID NO: 1167 | 0.01103 | 0.222 |
| SEQ ID NO: 1719 | 0.04844 | 0.434 |
| SEQ ID NO: 0917 | 0.00885 | 0.499 |
| SEQ ID NO: 2295 | 0.02772 | 3.217 |
| SEQ ID NO: 1692 | 0.00763 | 0.453 |
| SEQ ID NO: 1707 | 0.00490 | 0.463 |
| SEQ ID NO: 2477 | 0.02006 | 2.142 |

TABLE 9

List of 206 lncRNAs which are differentially expressed and/or have an AUC >0.7 or <0.3 between the low LVEF group (LVEF ≤ 45) and the high LVEF group (LVEF > 45)

| LncRNA (SEQ ID NO:) | p-value | AUC |
|---|---|---|
| 0005 | 0.029 | 0.72 |
| 0022 | 0.046 | 0.62 |
| 0023 | 0.012 | 0.73 |
| 0024 | 0.010 | 0.25 |
| 0037 | 0.056 | 0.72 |
| 0043 | 0.074 | 0.23 |
| 0069 | 0.054 | 0.26 |
| 0076 | 0.051 | 0.73 |
| 0139 | 0.016 | 0.75 |
| 0141 | 0.039 | 0.29 |
| 0147 | 0.021 | 0.72 |
| 0173 | 0.020 | 0.74 |
| 0190 | 0.016 | 0.75 |
| 0213 | 0.123 | 0.72 |
| 0216 | 0.095 | 0.71 |
| 0226 | 0.060 | 0.71 |
| 0227 | 0.054 | 0.72 |
| 0276 | 0.052 | 0.29 |
| 0321 | 0.059 | 0.71 |
| 0334 | 0.023 | 0.77 |
| 0336 | 0.032 | 0.75 |
| 0348 | 0.158 | 0.70 |
| 0357 | 0.025 | 0.72 |
| 0372 | 0.022 | 0.73 |
| 0400 | 0.015 | 0.75 |
| 0440 | 0.022 | 0.75 |
| 0472 | 0.033 | 0.74 |
| 0493 | 0.042 | 0.73 |
| 0502 | 0.065 | 0.71 |
| 0544 | 0.019 | 0.75 |
| 0586 | 0.025 | 0.73 |
| 0615 | 0.066 | 0.70 |
| 0664 | 0.000 | 0.95 |
| 0670 | 0.032 | 0.74 |
| 0688 | 0.040 | 0.72 |
| 0724 | 0.019 | 0.72 |
| 0758 | 0.043 | 0.75 |
| 0778 | 0.524 | 0.73 |
| 0781 | 0.031 | 0.71 |
| 0790 | 0.038 | 0.72 |
| 0821 | 0.039 | 0.71 |
| 0838 | 0.027 | 0.73 |
| 0845 | 0.068 | 0.70 |
| 0867 | 0.039 | 0.72 |
| 0885 | 0.035 | 0.30 |
| 0886 | 0.041 | 0.71 |
| 0891 | 0.059 | 0.30 |
| 0892 | 0.055 | 0.28 |
| 0914 | 0.037 | 0.23 |
| 0915 | 0.018 | 0.76 |
| 0917 | 0.009 | 0.78 |
| 0935 | 0.030 | 0.69 |
| 0983 | 0.055 | 0.28 |
| 1066 | 0.019 | 0.75 |
| 1089 | 0.012 | 0.76 |
| 1097 | 0.065 | 0.28 |
| 1103 | 0.073 | 0.29 |
| 1109 | 0.041 | 0.70 |
| 1162 | 0.030 | 0.72 |
| 1188 | 0.047 | 0.68 |
| 1191 | 0.039 | 0.73 |
| 1204 | 0.062 | 0.72 |
| 1207 | 0.006 | 0.76 |
| 1231 | 0.018 | 0.25 |
| 1237 | 0.104 | 0.29 |
| 1251 | 0.011 | 0.76 |
| 1281 | 0.031 | 0.24 |
| 1302 | 0.033 | 0.27 |
| 1315 | 0.051 | 0.71 |
| 1321 | 0.069 | 0.72 |
| 1329 | 0.032 | 0.26 |
| 1337 | 0.057 | 0.72 |
| 1377 | 0.012 | 0.76 |
| 1385 | 0.033 | 0.75 |
| 1402 | 0.030 | 0.73 |
| 1403 | 0.034 | 0.76 |
| 1404 | 0.031 | 0.72 |
| 1406 | 0.011 | 0.77 |
| 1426 | 0.040 | 0.75 |
| 1428 | 0.005 | 0.22 |
| 1446 | 0.083 | 0.74 |

TABLE 9-continued

List of 206 lncRNAs which are differentially expressed and/or have an AUC >0.7 or <0.3 between the low LVEF group (LVEF ≤ 45) and the high LVEF group (LVEF > 45)

| LncRNA (SEQ ID NO:) | p-value | AUC |
|---|---|---|
| 1454 | 0.063 | 0.70 |
| 1468 | 0.024 | 0.76 |
| 1483 | 0.032 | 0.27 |
| 1489 | 0.141 | 0.26 |
| 1499 | 0.078 | 0.30 |
| 1564 | 0.011 | 0.73 |
| 1576 | 0.096 | 0.70 |
| 1601 | 0.078 | 0.29 |
| 1667 | 0.063 | 0.71 |
| 1674 | 0.055 | 0.73 |
| 1692 | 0.008 | 0.82 |
| 1707 | 0.005 | 0.78 |
| 1719 | 0.048 | 0.71 |
| 1728 | 0.042 | 0.32 |
| 1737 | 0.008 | 0.27 |
| 1748 | 0.111 | 0.72 |
| 1767 | 0.036 | 0.29 |
| 1793 | 0.067 | 0.73 |
| 1804 | 0.048 | 0.69 |
| 1819 | 0.035 | 0.74 |
| 1820 | 0.048 | 0.26 |
| 1821 | 0.055 | 0.71 |
| 1858 | 0.054 | 0.27 |
| 1869 | 0.003 | 0.81 |
| 1873 | 0.071 | 0.71 |
| 1923 | 0.017 | 0.72 |
| 1983 | 0.002 | 0.84 |
| 2049 | 0.029 | 0.74 |
| 2074 | 0.022 | 0.24 |
| 2100 | 0.041 | 0.69 |
| 2114 | 0.034 | 0.68 |
| 2121 | 0.035 | 0.76 |
| 2126 | 0.031 | 0.27 |
| 2127 | 0.220 | 0.73 |
| 2170 | 0.013 | 0.19 |
| 2209 | 0.124 | 0.71 |
| 2216 | 0.033 | 0.72 |
| 2234 | 0.032 | 0.26 |
| 2253 | 0.004 | 0.21 |
| 2255 | 0.055 | 0.70 |
| 2260 | 0.060 | 0.27 |
| 2273 | 0.052 | 0.72 |
| 2282 | 0.043 | 0.29 |
| 2287 | 0.009 | 0.22 |
| 2288 | 0.024 | 0.15 |
| 2313 | 0.013 | 0.74 |
| 2320 | 0.051 | 0.72 |
| 2344 | 0.028 | 0.71 |
| 2362 | 0.031 | 0.76 |
| 2368 | 0.013 | 0.74 |
| 2372 | 0.035 | 0.72 |
| 2373 | 0.002 | 0.85 |
| 2377 | 0.009 | 0.77 |
| 2382 | 0.029 | 0.73 |
| 2402 | 0.012 | 0.83 |
| 2411 | 0.077 | 0.70 |
| 2420 | 0.043 | 0.73 |
| 2454 | 0.015 | 0.75 |
| 2466 | 0.041 | 0.70 |
| 2470 | 0.072 | 0.28 |
| 2471 | 0.039 | 0.76 |
| 2472 | 0.022 | 0.27 |
| 2478 | 0.027 | 0.27 |
| 2485 | 0.033 | 0.33 |
| 2502 | 0.061 | 0.71 |
| 2512 | 0.042 | 0.70 |
| 2521 | 0.031 | 0.32 |
| 2523 | 0.066 | 0.73 |
| 2558 | 0.160 | 0.72 |
| 2571 | 0.013 | 0.76 |
| 2583 | 0.115 | 0.28 |
| 2622 | 0.023 | 0.24 |
| 2625 | 0.027 | 0.72 |
| 2637 | 0.046 | 0.31 |
| 2657 | 0.036 | 0.65 |
| 2658 | 0.040 | 0.28 |
| 2677 | 0.022 | 0.75 |
| 2692 | 0.052 | 0.29 |
| 2699 | 0.020 | 0.27 |
| 2703 | 0.020 | 0.76 |
| 2712 | 0.091 | 0.30 |
| 2737 | 0.072 | 0.70 |
| 2742 | 0.034 | 0.73 |
| 2750 | 0.000 | 0.88 |
| 2791 | 0.045 | 0.28 |
| 2825 | 0.046 | 0.72 |
| 2830 | 0.013 | 0.76 |
| 2856 | 0.017 | 0.73 |
| 2875 | 0.019 | 0.26 |
| 2880 | 0.054 | 0.28 |
| 2883 | 0.028 | 0.35 |
| 2896 | 0.012 | 0.25 |
| 2912 | 0.102 | 0.72 |
| 2928 | 0.033 | 0.69 |
| 2957 | 0.048 | 0.31 |
| 2968 | 0.045 | 0.28 |
| 2982 | 0.002 | 0.19 |
| 2984 | 0.043 | 0.28 |
| 2998 | 0.005 | 0.79 |
| 3006 | 0.026 | 0.72 |
| 3010 | 0.016 | 0.23 |
| 3053 | 0.013 | 0.76 |
| 3054 | 0.019 | 0.27 |
| 3056 | 0.030 | 0.71 |
| 3061 | 0.023 | 0.71 |
| 3064 | 0.023 | 0.77 |
| 3080 | 0.033 | 0.26 |
| 3084 | 0.034 | 0.73 |
| 3096 | 0.044 | 0.31 |
| 3104 | 0.070 | 0.30 |
| 3112 | 0.010 | 0.22 |
| 3125 | 0.041 | 0.71 |
| 3128 | 0.041 | 0.32 |
| 3133 | 0.080 | 0.70 |
| 3137 | 0.163 | 0.73 |
| 3184 | 0.049 | 0.28 |
| 3187 | 0.038 | 0.30 |
| 3193 | 0.065 | 0.71 |
| 3196 | 0.030 | 0.29 |
| 3197 | 0.029 | 0.71 |
| 3200 | 0.015 | 0.26 |
| 3210 | 0.036 | 0.70 |
| 3215 | 0.012 | 0.24 |
| 3230 | 0.012 | 0.27 |
| 3231 | 0.016 | 0.75 |

For this classification, the 2 groups (low LVEF (LVEF≤45) and high LVEF (LVEF>45)) have the same number of samples. The variable selection was performed by using a Random Forest model. A combination of 11 preselected lncRNAs through a Random Forest Classifier (Table 10) is the best predictive model obtained here. The lncRNAs were selected using a random forest algorithm. This model has an area under the receiver-operating characteristic curve (AUC) of 0.996, an accuracy of 0.933, a sensitivity of 0.882, a specificity of 1, a Positive Predictive Value (PPV) of 1 and Negative Predictive Value (PNV) of 0.867. The confusion matrix is presented in Table 11.

TABLE 10

List of 11 pre-selected lncRNAs through a Random Forest Classifier for the classification low LVEF (LVEF ≤ 45) and high LVEF (LVEF > 45)

| lncRNA | Ranking |
| --- | --- |
| SEQ ID NO: 2373 | 1 |
| SEQ ID NO: 1748 | 2 |
| SEQ ID NO: 3112 | 3 |
| SEQ ID NO: 1231 | 4 |
| SEQ ID NO: 0664 | 5 |
| SEQ ID NO: 1686 | 6 |
| SEQ ID NO: 0791 | 7 |
| SEQ ID NO: 2126 | 8 |
| SEQ ID NO: 2750 | 9 |
| SEQ ID NO: 3010 | 10 |
| SEQ ID NO: 2241 | 11 |

TABLE 11

Confusion matrix

| | Low LVEF predicted | High LVEF predicted |
| --- | --- | --- |
| Low LVEF real | 15 | 2 |
| High LVEF real | 0 | 13 |

Correlation Between LncRNA and Left Ventricular Ejection Fraction

Instead of applying a threshold to predict patients as HF or non HF, the expression level of LncRNAs can be considered as a continuous value. For this approach, spearman correlation factor is calculated to measure the correlation between LVEF value at one month and expression level of LncRNA. When a threshold of (+or −) 0.45 for correlation factor is applied, the expression of 73 lncRNAs are positively or negatively correlated with LVEF at 1 month. Among these 73 lncRNAs, 26 have a positive correlation factor whereas 47 have a negative correlation factor (Table 12).

TABLE 12

List of 73 lncRNA with spearman correlation factor higher than 0.45 (absolute value)

| LncRNA (SEQ ID NO:) | Correlation |
| --- | --- |
| 0005 | −0.52414 |
| 0008 | −0.45621 |
| 0069 | −0.56061 |
| 0173 | −0.52934 |
| 0285 | −0.47612 |
| 0321 | −0.52163 |
| 0334 | −0.49958 |
| 0352 | 0.60914 |
| 0398 | 0.607739 |
| 0544 | 0.46328 |
| 0566 | 0.461135 |
| 0586 | 0.510946 |
| 0664 | 0.547218 |
| 0688 | −0.45551 |
| 0758 | −0.46513 |
| 0914 | −0.55591 |
| 1109 | −0.5676 |
| 1144 | −0.45238 |
| 1204 | −0.45716 |
| 1281 | 0.466222 |
| 1385 | −0.45266 |
| 1398 | −0.50488 |
| 1406 | −0.55967 |
| 1428 | −0.5583 |
| 1564 | −0.61193 |
| 1626 | 0.457149 |
| 1674 | 0.566205 |
| 1707 | 0.467787 |
| 1715 | 0.477576 |
| 1804 | −0.48111 |
| 1858 | −0.52538 |
| 1869 | −0.4541 |
| 2100 | 0.534861 |
| 2157 | −0.52703 |
| 2216 | −0.53537 |
| 2253 | −0.50086 |
| 2281 | −0.46295 |
| 2287 | −0.63378 |
| 2311 | −0.58252 |
| 2368 | 0.510665 |
| 2373 | −0.55046 |
| 2377 | −0.45729 |
| 2382 | −0.48369 |
| 2402 | −0.51064 |
| 2454 | −0.48739 |
| 2470 | 0.495523 |
| 2472 | −0.46052 |
| 2478 | −0.46735 |
| 2501 | 0.470795 |
| 2523 | −0.51113 |
| 2545 | −0.49398 |
| 2593 | −0.4538 |
| 2637 | 0.455663 |
| 2645 | −0.49274 |
| 2703 | 0.459314 |
| 2742 | −0.45062 |
| 2746 | −0.47907 |
| 2750 | 0.542019 |
| 2753 | 0.514263 |
| 2830 | 0.460882 |
| 2896 | 0.499645 |
| 2928 | 0.463878 |
| 2930 | −0.48812 |
| 2971 | 0.50357 |
| 2973 | 0.483104 |
| 2982 | −0.4529 |
| 2998 | 0.49442 |
| 3013 | 0.476852 |
| 3080 | −0.48109 |
| 3128 | −0.66808 |
| 3196 | −0.49516 |
| 3200 | 0.536685 |
| 3230 | −0.50558 |

Example 4: lncRNA Detection in Serum Samples with a Targeted lncRNA-Seq (FiMICS) Protocol Circulating lncRNAs in body fluids such as whole blood, serum or plasma are numerous and released from many different tissues. Thus, performing total RNA sequencing on peripheral samples implies to generate a high amount of data to get sufficient data on the lncRNAs of interest. To optimize cardiac lncRNA quantification in peripheral blood samples, a targeted sequencing kit is developed to specifically quantify the cardiac lncRNAs of interest. For this purpose, capture probes of 50 nucleotides specific and complementary to the sequence of lncRNAs associated to the cardiac tissue (SEQ ID NO 1 to SEQ ID NO 3238) are designed. Each probe covers region of 200 bp. Multiple probes are designed for each lncRNA over 200 bp to cover specific region. Maximum probe coverage is limited to 2000 nucleotides. Celemics technology was used to develop the assay but similar technologies using capture probes for targeting sequencing panel can be used.

Material and Methods:

Serum samples collected at discharge of patient between D3 and D5 from 30 patients with AMI from the MitoCare cohort were used for lncRNA profiling. Mitocare is a multicenter, randomized, double-blind, placebo controlled study. The study population includes AMI patients undergoing PCI, older than 18 years. The primary endpoint is the level of left ventricular ejection fraction (LVEF) less than 40% at 1 month. Demographics of the patients are presented in Table 13. Control serum samples were selected from subjects of ADDIA Chronobiological study.

TABLE 13

Demographic data for Mitocare patients used with Fi-MICS test

|  | Group 1 | Group 2 | Group 3 |
|---|---|---|---|
| EF | <40 | 41-50 | >50 |
| Nb | 6 | 6 | 5 |
| Age | 62.8 | 63.8 | 59.9 |
| Male | 100% | 83% | 60% |
| BMI | 27.9 | 28.0 | 27.6 |
| Systolic Blood Pressure | 108 | 123.5 | 117.4 |
| Diastolic Blood Pressure | 70.5 | 70.7 | 66.2 |
| Heart Rate | 83.0 | 79.6 | 67.4 |

Sequencing libraries constructed in Example 3 from Serum RNA of 18 patients who suffered AMI, (6 who developed heart failure (HF) and 12 who did not) and 6 control subjects are used. The lncRNA capture panel called Fi-MICS kit is used to capture 3238 cardiac lncRNAs of interest, according to the manufacturer instructions. Briefly, biotinylated target capture probes, specific for the lncRNAs of interest, are hybridized to the sequencing libraries for 24 hours. So, captured lncRNA sequences are purified on T1 streptavidin coated magnetic beads. Six successive washes are performed to eliminate all libraries sequences not specific to the panel probes. Finally, captures sequenced are enriched by PCR (14 cycles) and PCR products are purified with a final AMPure XP beads wash. Captured libraries are eluted in 30 µl of nuclease-free water.

For quality control, 1 µl of each library is run on the Agilent Technologies 2100 Bioanalyzer using a DNA 1000 chip according to the manufacturer's recommendations. Absence of adapter dimers is checked and the average library size is determined by a region table. Libraries are quantified on Qubit 2.0 using Qubit dsDNA High Sensitivity assay kit (Invitrogen). Library size previously determined on the Bioanalyzer is used to calculate molar concentrations from mass concentrations. All libraries are sequenced using the Illumina NextSeq500 (2×75 bp).

Sequencing Analysis and Statistical Analysis

The read alignment and the quantification are performed as described in Example 3. The transcript counts were normalized by CPM (counts per millions). To determine differentially expressed lncRNAs, a statistical analysis is performed using a non-parametric Wilcoxon-Mann-Whitney test and a parametric T-test. A lncRNA with a p-value≤0.05 is considered as differentially expressed.

Results:

Coverage in Targeted Sequencing is Improved

Figure 5:
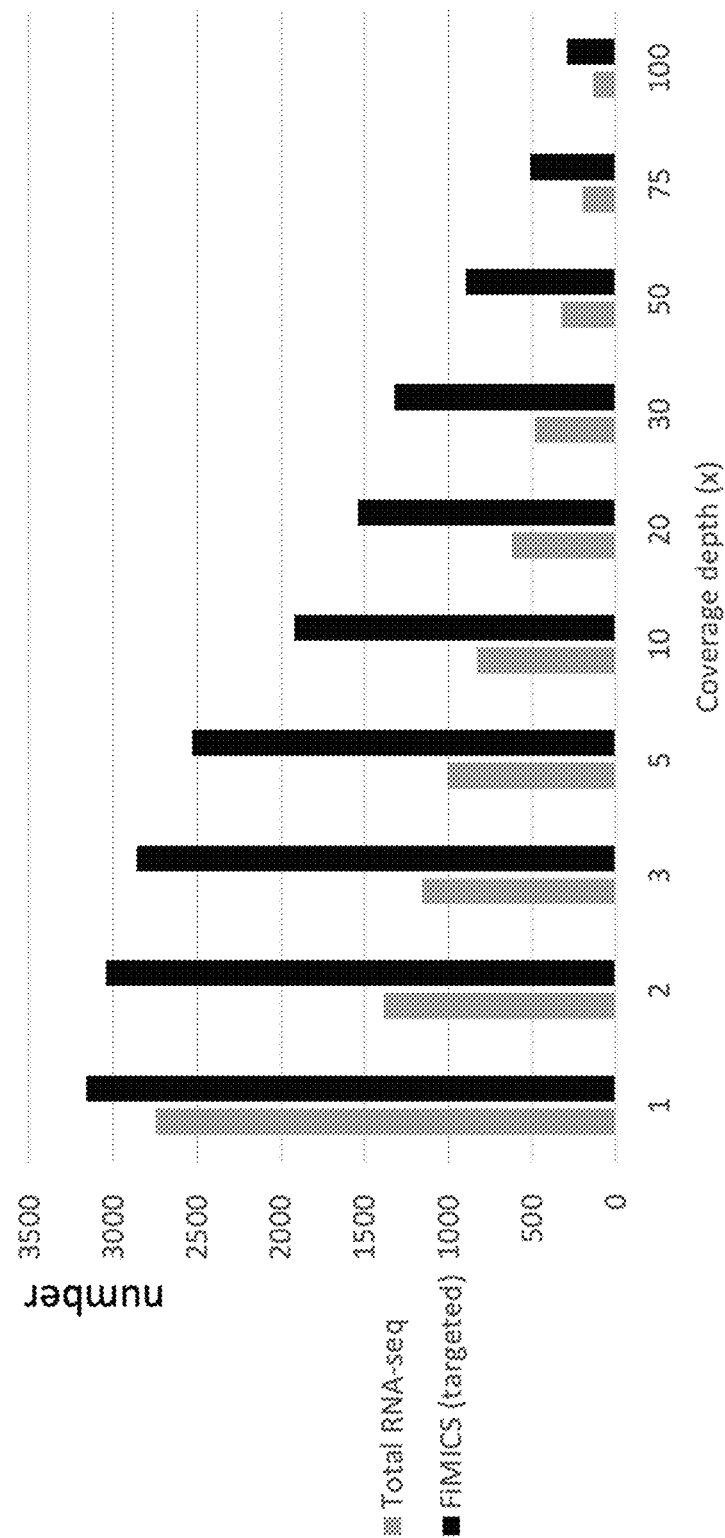
FIG. 5 shows a histogram with the number of lncRNA, which passed the different threshold of coverage depth (in horizontal axis). In total RNA-seq protocol (left bar), half of 3238 lncRNA have an average coverage depth less than 2×. In FiMICS (targeted sequencing) protocol (right bar), more than 3000 lncRNA have at least an average coverage depth of 2×.

The average coverage depth across all bases in the sample is the sum of the read depths of each base in each region divided by the sum of the lengths of every region. Using the Fi-MICS kit, the average coverage is improved (11 times better in average with equivalent number of reads) compared to a total RNA-seq protocol, as shown in Table 14. Among the 3238 lncRNAs present in the panel, 2432 lncRNAs passed the threshold of 10 CPM in serum samples. Detection and quantification in function of coverage depth is presented in FIG. 5. Whereas 2744 lncRNAs are measured with a coverage of at least 1× by total RNA-Seq experiment, 3162 lncRNAs are measured with a coverage of at least 1× with FiMICS panel with 10 fold less reads generated. At a coverage of at least 2×, half of the lncRNAs are excluded with total-RNA-Seq approach (1385) whereas 3041 lncR-NAs are passing the threshold in FiMICS panel. Efficiency of the targeted panel is highly enhanced (FIG. 5). The FiMICS (targeted sequencing) detects more lncRNA in terms of numbers of lncRNAs and their level of expression and thus using much less total sequencing reads.

TABLE 14

Number of reads and average coverage for 18 samples in the 2 sequencing protocols

|  | Total RNA-seq protocol | | Targeted RNA-seq protocol | |
|---|---|---|---|---|
| Sample name | Total reads | Average coverage depth | Total reads | Average coverage depth |
| Sample 1 | 35,545,396 | 62.01 | 4,113,215 | 135.54 |
| Sample 2 | 34,427,599 | 70.57 | 5,051,804 | 107.11 |
| Sample 3 | 27,820,331 | 64.19 | 7,664,878 | 100.01 |
| Sample 4 | 46,070,066 | 87.04 | 5,939,425 | 94.2 |
| Sample 5 | 37,846,232 | 76.60 | 5,251,571 | 96.98 |
| Sample 6 | 45,285,008 | 51.97 | 8,649,560 | 118.7 |
| Sample 7 | 63,215,798 | 88.00 | 5,342,296 | 99.26 |
| Sample 8 | 37,467,050 | 67.20 | 6,552,391 | 93.25 |
| Sample 9 | 65,796,180 | 87.51 | 6,602,505 | 129.06 |
| Sample 10 | 50,693,623 | 48.89 | 5,043,709 | 76.41 |
| Sample 11 | 64,165,816 | 88.80 | 6,586,358 | 83.5 |
| Sample 12 | 33,302,080 | 54.82 | 6,725,419 | 105.28 |
| Sample 13 | 29,673,123 | 50.11 | 8,178,840 | 123.15 |
| Sample 14 | 56,386,693 | 76.81 | 5,613,486 | 105.63 |
| Sample 15 | 75,267,997 | 107.00 | 6,789,160 | 124.8 |
| Sample 16 | 40,789,456 | 66.70 | 5,875,488 | 81.59 |
| Sample 17 | 54,651,503 | 78.11 | 7,038,893 | 85.31 |
| Sample 18 | 66,866,920 | 78.91 | 5,275,438 | 82.16 |

Comparison Between Samples after Myocardial Infarction and Control Samples

First, the statistical analysis was performed by comparing 18 samples after myocardial infarction (AMI) and 6 control samples with the goal to diagnose myocardial infraction. The volcano plot showed the differential expression of lncRNA. 20 lncRNAs are differentially expressed between the samples AMI and the control samples. The p-value and the fold-change of these lncRNA are listed in the Table 15.

TABLE 15

List of 20 lncRNAs which are differentially expressed between samples AMI and control samples

| lncRNA | p-value | Fold change |
|---|---|---|
| SEQ ID NO: 0097 | 1.35E−05 | 0.446 |
| SEQ ID NO: 2114 | 0.00194062 | 0.477 |
| SEQ ID NO: 0534 | 0.02513143 | 0.354 |
| SEQ ID NO: 1404 | 0.0128132 | 0.486 |
| SEQ ID NO: 0311 | 0.00046383 | 0.217 |
| SEQ ID NO: 1262 | 0.01381743 | 0.412 |
| SEQ ID NO: 0990 | 0.00060722 | 0.182 |
| SEQ ID NO: 1300 | 0.04098375 | 0.364 |
| SEQ ID NO: 0978 | 0.00358642 | 0.498 |
| SEQ ID NO: 0215 | 0.00013071 | 0.369 |
| SEQ ID NO: 0288 | 0.04991173 | 0.392 |

TABLE 15-continued

List of 20 lncRNAs which are differentially expressed
between samples AMI and control samples

| lncRNA | p-value | Fold change |
|---|---|---|
| SEQ ID NO: 1418 | 0.00010606 | 0.450 |
| SEQ ID NO: 2070 | 0.00078855 | 0.457 |
| SEQ ID NO: 0309 | 0.00322822 | 0.141 |
| SEQ ID NO: 0597 | 0.0182368 | 0.401 |
| SEQ ID NO: 1875 | 0.0343985 | 0.457 |
| SEQ ID NO: 1984 | 0.0108457 | 0.479 |
| SEQ ID NO: 0538 | 3.89E−05 | 0.386 |
| SEQ ID NO: 1871 | 0.00021278 | 0.360 |

For this classification, a combination of 14 pre-selected lncRNA through a Random Forest Classifier (Table 16) is the best predictive model obtained here. The lncRNAs were selected using a random forest algorithm. This model has an area under the receiver-operating characteristic curve (AUC) of 0.971, an accuracy of 0.870, a sensitivity of 0.941, a specificity of 0.667, a Positive Predictive Value (PPV) of 0.889 and Negative Predictive Value (PNV) of 0.800. The confusion matrix is presented in Table 17.

TABLE 16

List of 14 pre-selected lncRNAs through a Random Forest
Classifier for the classification between the samples
AMI and the control samples

| lncRNA | rank |
|---|---|
| SEQ ID NO: 2150 | 1 |
| SEQ ID NO: 1534 | 2 |
| SEQ ID NO: 0311 | 3 |
| SEQ ID NO: 2952 | 4 |
| SEQ ID NO: 2838 | 5 |
| SEQ ID NO: 1437 | 6 |
| SEQ ID NO: 1297 | 7 |
| SEQ ID NO: 1059 | 8 |
| SEQ ID NO: 1465 | 9 |
| SEQ ID NO: 2826 | 10 |
| SEQ ID NO: 0180 | 11 |
| SEQ ID NO: 0538 | 12 |
| SEQ ID NO: 0258 | 13 |
| SEQ ID NO: 2273 | 14 |

TABLE 17

Confusion matrix of the Random Forest model

| | Predicted AMI | Predicted Control |
|---|---|---|
| Real Control | 4 | 2 |
| True AMI | 1 | 16 |

Comparison Between Low LVEF (LVEF≤40) and High LVEF (LVEF>40)

In this analysis, the 18 samples AMI were grouped into 2 groups based on the 1-month LVEF: low LVEF (LVEF≤40) and high LVEF (LVEF>40). The volcano plot showed the differential expression of lncRNA. 95 lncRNAs are differentially expressed and among them, 6 lncRNAs are differentially expressed with a fold change>2 or <0.5 between the samples with low LVEF and the samples with high LVEF. The p-value and the fold-change and individual AUC of these 6 lncRNAs are listed in the Table 18 and 353 lncRNAs which have a P<0.05 and/or an individual AUC>0.7 or <0.3 are listed in Table 19.

TABLE 18

List of 6 lncRNAs which are differentially expressed and have a fold
change >2 or <0.5 between the low LVEF group (LVEF ≤ 40)
and the high LVEF group (LVEF > 40)

| lncRNA | p-value | Fold change | Individual AUC |
|---|---|---|---|
| SEQ ID NO: 0631 | 0.022 | 2.497 | 0.848 |
| SEQ ID NO: 0758 | 0.030 | 0.354 | 0.242 |
| SEQ ID NO: 0789 | 0.030 | 0.388 | 0.258 |
| SEQ ID NO: 1399 | 0.021 | 0.163 | 0.242 |
| SEQ ID NO: 2914 | 0.012 | 2.493 | 0.985 |
| SEQ ID NO: 2924 | 0.147 | 2.232 | 0.727 |

TABLE 19

List of 353 lncRNAs which are differentially expressed and/or
have an AUC >0.7 or <0.3 between the low LVEF group
(LVEF ≤ 40) and the high LVEF group (LVEF > 40)

| LncRNA (SEQ ID NO:) | p-value | AUC |
|---|---|---|
| 0002 | 0.006 | 0.939 |
| 0006 | 0.965 | 0.712 |
| 0007 | 0.199 | 0.712 |
| 0008 | 0.224 | 0.288 |
| 0018 | 0.5 | 0.258 |
| 0019 | 0.027 | 0.182 |
| 0023 | 0.127 | 0.742 |
| 0041 | 0.091 | 0.258 |
| 0042 | 0.151 | 0.242 |
| 0048 | 0.145 | 0.288 |
| 0057 | 0.163 | 0.712 |
| 0060 | 0.192 | 0.288 |
| 0094 | 0.264 | 0.773 |
| 0106 | 0.168 | 0.273 |
| 0117 | 0.097 | 0.727 |
| 0120 | 0.642 | 0.288 |
| 0134 | 0.075 | 0.212 |
| 0149 | 0.448 | 0.712 |
| 0151 | 0.011 | 0.182 |
| 0155 | 0.023 | 0.833 |
| 0190 | 0.05 | 0.242 |
| 0191 | 0.064 | 0.818 |
| 0205 | 0.047 | 0.212 |
| 0208 | 0.051 | 0.197 |
| 0222 | 0.018 | 0.833 |
| 0228 | 0.171 | 0.712 |
| 0236 | 0.06 | 0.788 |
| 0239 | 0.121 | 0.712 |
| 0241 | 0.097 | 0.288 |
| 0242 | 0.462 | 0.727 |
| 0285 | 0.149 | 0.758 |
| 0295 | 0.076 | 0.273 |
| 0308 | 0.12 | 0.273 |
| 0312 | 0.075 | 0.212 |
| 0334 | 0.021 | 0.864 |
| 0345 | 0.107 | 0.758 |
| 0350 | 0.017 | 0.152 |
| 0354 | 0.346 | 0.727 |
| 0358 | 0.161 | 0.288 |
| 0362 | 0.25 | 0.273 |
| 0366 | 0.095 | 0.758 |
| 0371 | 0.349 | 0.258 |
| 0380 | 0.141 | 0.727 |
| 0384 | 0.026 | 0.803 |
| 0394 | 0.029 | 0.152 |
| 0412 | 0.342 | 0.227 |
| 0434 | 0.179 | 0.712 |
| 0441 | 0.05 | 0.197 |
| 0443 | 0.211 | 0.712 |
| 0445 | 0.446 | 0.288 |
| 0460 | 0.046 | 0.227 |
| 0468 | 0.059 | 0.727 |
| 0469 | 0.09 | 0.288 |
| 0487 | 0.091 | 0.212 |
| 0502 | 0.106 | 0.758 |
| 0542 | 0.068 | 0.727 |

TABLE 19-continued

List of 353 lncRNAs which are differentially expressed and/or have an AUC >0.7 or <0.3 between the low LVEF group (LVEF ≤ 40) and the high LVEF group (LVEF > 40)

| LncRNA (SEQ ID NO:) | p-value | AUC |
| --- | --- | --- |
| 0547 | 0.016 | 0.803 |
| 0551 | 0.196 | 0.742 |
| 0552 | 0.042 | 0.833 |
| 0561 | 0.192 | 0.712 |
| 0581 | 0.057 | 0.758 |
| 0597 | 0.108 | 0.742 |
| 0601 | 0.075 | 0.803 |
| 0604 | 0.284 | 0.258 |
| 0612 | 0.071 | 0.288 |
| 0621 | 0.21 | 0.742 |
| 0629 | 0.176 | 0.758 |
| 0631 | 0.022 | 0.848 |
| 0659 | 0.052 | 0.848 |
| 0661 | 0.157 | 0.742 |
| 0670 | 0.053 | 0.742 |
| 0677 | 0.035 | 0.788 |
| 0680 | 0.045 | 0.227 |
| 0681 | 0.047 | 0.773 |
| 0701 | 0.159 | 0.212 |
| 0702 | 0.365 | 0.712 |
| 0724 | 0.058 | 0.742 |
| 0726 | 0.515 | 0.712 |
| 0729 | 0.017 | 0.864 |
| 0730 | 0.076 | 0.818 |
| 0732 | 0.098 | 0.758 |
| 0751 | 0.03 | 0.212 |
| 0758 | 0.03 | 0.242 |
| 0766 | 0.033 | 0.803 |
| 0779 | 0.36 | 0.742 |
| 0789 | 0.03 | 0.258 |
| 0821 | 0.004 | 0.864 |
| 0823 | 0.117 | 0.273 |
| 0829 | 0.143 | 0.227 |
| 0841 | 0.063 | 0.773 |
| 0844 | 0.021 | 0.136 |
| 0847 | 0.107 | 0.288 |
| 0868 | 0.228 | 0.242 |
| 0884 | 0.322 | 0.288 |
| 0891 | 0.044 | 0.742 |
| 0915 | 0.077 | 0.758 |
| 0926 | 0.285 | 0.288 |
| 0937 | 0.075 | 0.727 |
| 0938 | 0.271 | 0.742 |
| 0946 | 0.008 | 0.833 |
| 0956 | 0.012 | 0.879 |
| 0958 | 0.027 | 0.818 |
| 0960 | 0.036 | 0.788 |
| 0981 | 0.07 | 0.288 |
| 0986 | 0.044 | 0.788 |
| 1005 | 0.178 | 0.712 |
| 1052 | 0.221 | 0.727 |
| 1065 | 0.045 | 0.212 |
| 1075 | 0.025 | 0.197 |
| 1076 | 0.275 | 0.288 |
| 1089 | 0.002 | 0.97 |
| 1093 | 0.037 | 0.197 |
| 1109 | 0.114 | 0.788 |
| 1111 | 0.139 | 0.288 |
| 1146 | 0.039 | 0.182 |
| 1156 | 0.28 | 0.742 |
| 1162 | 0.019 | 0.803 |
| 1164 | 0.181 | 0.273 |
| 1179 | 0.078 | 0.197 |
| 1186 | 0.135 | 0.273 |
| 1191 | 0.064 | 0.242 |
| 1204 | 0.012 | 0.848 |
| 1207 | 0.047 | 0.864 |
| 1217 | 0.13 | 0.742 |
| 1232 | 0.086 | 0.773 |
| 1252 | 0.208 | 0.273 |
| 1273 | 0.016 | 0.182 |
| 1288 | 0.021 | 0.197 |
| 1326 | 0.056 | 0.258 |
| 1333 | 0.199 | 0.712 |
| 1338 | 0.097 | 0.288 |
| 1350 | 0.162 | 0.242 |
| 1354 | 0.059 | 0.803 |
| 1399 | 0.021 | 0.242 |
| 1403 | 0.063 | 0.788 |
| 1405 | 0.17 | 0.727 |
| 1412 | 0.097 | 0.712 |
| 1422 | 0.04 | 0.758 |
| 1433 | 0.056 | 0.258 |
| 1439 | 0.029 | 0.152 |
| 1449 | 0.073 | 0.227 |
| 1459 | 0.125 | 0.242 |
| 1465 | 0.182 | 0.288 |
| 1467 | 0.067 | 0.742 |
| 1475 | 0.034 | 0.242 |
| 1476 | 0.022 | 0.833 |
| 1484 | 0.124 | 0.288 |
| 1485 | 0.143 | 0.727 |
| 1515 | 0.014 | 0.136 |
| 1516 | 0.076 | 0.818 |
| 1527 | 0.185 | 0.273 |
| 1534 | 0.038 | 0.212 |
| 1535 | 0.284 | 0.712 |
| 1556 | 0.133 | 0.727 |
| 1573 | 0.045 | 0.258 |
| 1578 | 0.197 | 0.742 |
| 1580 | 0.229 | 0.712 |
| 1598 | 0.146 | 0.712 |
| 1624 | 0.048 | 0.227 |
| 1635 | 0.089 | 0.758 |
| 1660 | 0.014 | 0.864 |
| 1661 | 0.038 | 0.258 |
| 1678 | 0.075 | 0.258 |
| 1696 | 0.231 | 0.288 |
| 1710 | 0.056 | 0.742 |
| 1722 | 0.091 | 0.864 |
| 1740 | 0.162 | 0.712 |
| 1744 | 0.021 | 0.167 |
| 1754 | 0.453 | 0.727 |
| 1760 | 0.086 | 0.727 |
| 1773 | 0.146 | 0.288 |
| 1806 | 0.168 | 0.258 |
| 1816 | 0.06 | 0.833 |
| 1818 | 0.106 | 0.288 |
| 1833 | 0.14 | 0.273 |
| 1852 | 0.008 | 0.864 |
| 1853 | 0.069 | 0.227 |
| 1854 | 0.164 | 0.773 |
| 1860 | 0.19 | 0.727 |
| 1862 | 0.107 | 0.258 |
| 1871 | 0.096 | 0.288 |
| 1872 | 0.142 | 0.712 |
| 1880 | 0.377 | 0.712 |
| 1896 | 0.083 | 0.227 |
| 1903 | 0.105 | 0.227 |
| 1908 | 0.066 | 0.758 |
| 1912 | 0.049 | 0.258 |
| 1937 | 0.098 | 0.773 |
| 1939 | 0.139 | 0.197 |
| 1959 | 0.012 | 0.212 |
| 1962 | 0.094 | 0.258 |
| 1992 | 0.049 | 0.227 |
| 1995 | 0.06 | 0.773 |
| 2000 | 0.06 | 0.197 |
| 2021 | 0.037 | 0.212 |
| 2022 | 0.27 | 0.258 |
| 2050 | 0.117 | 0.273 |
| 2084 | 0.104 | 0.788 |
| 2086 | 0.065 | 0.242 |
| 2091 | 0.214 | 0.712 |
| 2109 | 0.22 | 0.242 |
| 2141 | 0.128 | 0.242 |
| 2149 | 0.071 | 0.227 |
| 2151 | 0.064 | 0.242 |

TABLE 19-continued

List of 353 lncRNAs which are differentially expressed and/or have an AUC >0.7 or <0.3 between the low LVEF group (LVEF ≤ 40) and the high LVEF group (LVEF > 40)

| LncRNA (SEQ ID NO:) | p-value | AUC |
|---|---|---|
| 2161 | 0.051 | 0.273 |
| 2170 | 0.099 | 0.227 |
| 2172 | 0.023 | 0.773 |
| 2174 | 0.01 | 0.848 |
| 2192 | 0.013 | 0.864 |
| 2198 | 0.027 | 0.803 |
| 2205 | 0.047 | 0.758 |
| 2207 | 0.088 | 0.197 |
| 2218 | 0.078 | 0.788 |
| 2220 | 0.105 | 0.758 |
| 2221 | 0.105 | 0.788 |
| 2226 | 0.214 | 0.712 |
| 2227 | 0.058 | 0.258 |
| 2235 | 0.032 | 0.167 |
| 2238 | 0.024 | 0.197 |
| 2244 | 0.102 | 0.742 |
| 2273 | 0.098 | 0.773 |
| 2285 | 0.107 | 0.242 |
| 2286 | 0.16 | 0.712 |
| 2294 | 0.079 | 0.803 |
| 2311 | 0.388 | 0.273 |
| 2318 | 0.114 | 0.758 |
| 2325 | 0.482 | 0.288 |
| 2327 | 0.097 | 0.727 |
| 2338 | 0.012 | 0.818 |
| 2341 | 0.086 | 0.242 |
| 2345 | 0.102 | 0.227 |
| 2364 | 0.149 | 0.742 |
| 2368 | 0.045 | 0.742 |
| 2371 | 0.144 | 0.258 |
| 2375 | 0.01 | 0.121 |
| 2379 | 0.029 | 0.773 |
| 2395 | 0.113 | 0.773 |
| 2406 | 0.018 | 0.182 |
| 2407 | 0.27 | 0.773 |
| 2411 | 0.02 | 0.864 |
| 2422 | 0.138 | 0.742 |
| 2425 | 0.15 | 0.712 |
| 2429 | 0.049 | 0.212 |
| 2436 | 0.11 | 0.758 |
| 2440 | 0.238 | 0.258 |
| 2441 | 0.067 | 0.242 |
| 2451 | 0.205 | 0.712 |
| 2454 | 0.054 | 0.758 |
| 2475 | 0.045 | 0.197 |
| 2497 | 0.109 | 0.712 |
| 2513 | 0.189 | 0.712 |
| 2517 | 0.189 | 0.758 |
| 2520 | 0.176 | 0.727 |
| 2529 | 0.256 | 0.273 |
| 2544 | 0.259 | 0.742 |
| 2546 | 0.055 | 0.258 |
| 2553 | 0.196 | 0.242 |
| 2562 | 0.099 | 0.712 |
| 2572 | 0.227 | 0.727 |
| 2584 | 0.206 | 0.288 |
| 2611 | 0.112 | 0.288 |
| 2613 | 0.105 | 0.758 |
| 2621 | 0.152 | 0.727 |
| 2627 | 0.068 | 0.788 |
| 2629 | 0.093 | 0.712 |
| 2639 | 0.131 | 0.288 |
| 2640 | 0.08 | 0.727 |
| 2641 | 0.379 | 0.742 |
| 2656 | 0.085 | 0.712 |
| 2676 | 0.03 | 0.864 |
| 2677 | 0.082 | 0.212 |
| 2680 | 0.161 | 0.727 |
| 2681 | 0.07 | 0.788 |
| 2683 | 0.053 | 0.818 |
| 2684 | 0.076 | 0.197 |
| 2692 | 0.047 | 0.242 |
| 2713 | 0.052 | 0.803 |
| 2735 | 0.261 | 0.712 |
| 2737 | 0.035 | 0.848 |
| 2754 | 0.133 | 0.212 |
| 2760 | 0.135 | 0.273 |
| 2767 | 0.156 | 0.727 |
| 2768 | 0.14 | 0.758 |
| 2784 | 0.09 | 0.742 |
| 2788 | 0.15 | 0.288 |
| 2789 | 0.426 | 0.727 |
| 2796 | 0.162 | 0.773 |
| 2806 | 0.058 | 0.773 |
| 2819 | 0.111 | 0.727 |
| 2827 | 0.024 | 0.894 |
| 2834 | 0.098 | 0.288 |
| 2841 | 0.014 | 0.818 |
| 2856 | 0.13 | 0.273 |
| 2857 | 0.135 | 0.742 |
| 2870 | 0.035 | 0.212 |
| 2881 | 0.014 | 0.818 |
| 2903 | 0.19 | 0.712 |
| 2911 | 0.177 | 0.742 |
| 2914 | 0.012 | 0.985 |
| 2917 | 0.226 | 0.712 |
| 2924 | 0.147 | 0.727 |
| 2939 | 0.06 | 0.258 |
| 2945 | 0.727 | 0.727 |
| 2955 | 0.089 | 0.288 |
| 2958 | 0.071 | 0.758 |
| 2959 | 0.34 | 0.879 |
| 2961 | 0.009 | 0.121 |
| 2963 | 0.114 | 0.758 |
| 2967 | 0.042 | 0.227 |
| 2969 | 0.22 | 0.727 |
| 2973 | 0.17 | 0.773 |
| 2982 | 0.069 | 0.818 |
| 2995 | 0.063 | 0.273 |
| 3001 | 0.088 | 0.727 |
| 3007 | 0.217 | 0.712 |
| 3013 | 0.059 | 0.758 |
| 3015 | 0.147 | 0.727 |
| 3029 | 0.03 | 0.212 |
| 3035 | 0.004 | 0.136 |
| 3036 | 0.071 | 0.818 |
| 3052 | 0.064 | 0.773 |
| 3053 | 0.002 | 0.909 |
| 3058 | 0.037 | 0.803 |
| 3060 | 0.371 | 0.712 |
| 3064 | 0.048 | 0.758 |
| 3065 | 0.16 | 0.742 |
| 3069 | 0.328 | 0.258 |
| 3090 | 0.046 | 0.773 |
| 3091 | 0.161 | 0.712 |
| 3098 | 0.094 | 0.212 |
| 3101 | 0.102 | 0.833 |
| 3107 | 0.221 | 0.258 |
| 3124 | 0.008 | 0.864 |
| 3130 | 0.134 | 0.742 |
| 3134 | 0.158 | 0.727 |
| 3142 | 0.111 | 0.242 |
| 3146 | 0.114 | 0.712 |
| 3147 | 0.237 | 0.273 |
| 3148 | 0.33 | 0.758 |
| 3169 | 0.138 | 0.742 |
| 3172 | 0.033 | 0.758 |
| 3176 | 0.037 | 0.879 |
| 3183 | 0.006 | 0.909 |
| 3190 | 0.085 | 0.788 |
| 3195 | 0.186 | 0.273 |
| 3196 | 0.036 | 0.773 |
| 3197 | 0.119 | 0.758 |
| 3199 | 0.081 | 0.788 |
| 3208 | 0.015 | 0.197 |
| 3209 | 0.133 | 0.258 |
| 3213 | 0.027 | 0.152 |

TABLE 19-continued

List of 353 lncRNAs which are differentially expressed and/or have an AUC >0.7 or <0.3 between the low LVEF group (LVEF ≤ 40) and the high LVEF group (LVEF > 40)

| LncRNA (SEQ ID NO:) | p-value | AUC |
|---|---|---|
| 3222 | 0.051 | 0.197 |
| 3236 | 0.293 | 0.712 |

Comparison Between Low LVEF (LVEF<45) and High LVEF (LVEF>45)

In this analysis, the 18 samples AMI were grouped into 2 groups using the threshold of 45% LVEF: low LVEF (LVEF≤45) and high LVEF (LVEF>45). The volcano plot showed the differential expression of lncRNA. 80 lncRNA are differentially expressed and among them, 1 lncRNA has a fold change>2 or <0.5, which is shown in Table 20. 467 lncRNAs which have a P<0.05 and/or an individual AUC>0.7 or <0.3 are listed in Table 21.

TABLE 20

List of 1 lncRNA which is differentially expressed with a fold change >2 or <0.5 between the low LVEF group (LVEF ≤ 45) and the high LVEF group (LVEF > 45)

| lncRNA | p-value | Fold change | AUC |
|---|---|---|---|
| SEQ ID NO: 2924 | 0.034 | 2.526 | 0.829 |

TABLE 21

List of 467 lncRNAs which are differentially expressed and/or have an AUC > 0.7 or < 0.3 between the low LVEF group (LVEF ≤ 45) and the high LVEF group (LVEF > 45)

| lncRNA (SEQ ID NO:) | p-value | AUC | lncRNA (SEQ ID NO:) | p-value | AUC | lncRNA (SEQ ID NO:) | p-value | AUC | lncRNA (SEQ ID NO:) | p-value | AUC |
|---|---|---|---|---|---|---|---|---|---|---|---|
| 0008 | 0.186 | 0.286 | 0877 | 0.05 | 0.757 | 1708 | 0.298 | 0.3 | 2561 | 0.214 | 0.3 |
| 0023 | 0.152 | 0.743 | 0892 | 0.061 | 0.171 | 1722 | 0.078 | 0.771 | 2576 | 0.01 | 0.114 |
| 0024 | 0.151 | 0.3 | 0897 | 0.074 | 0.257 | 1744 | 0.204 | 0.271 | 2599 | 0.18 | 0.271 |
| 0063 | 0.014 | 0.843 | 0906 | 0.157 | 0.243 | 1754 | 0.13 | 0.714 | 2602 | 0.048 | 0.229 |
| 0067 | 0.09 | 0.757 | 0907 | 0.227 | 0.7 | 1755 | 0.16 | 0.729 | 2606 | 0.021 | 0.857 |
| 0068 | 0.105 | 0.229 | 0933 | 0.122 | 0.229 | 1758 | 0.103 | 0.757 | 2632 | 0.186 | 0.257 |
| 0071 | 0.106 | 0.2 | 0937 | 0.023 | 0.843 | 1771 | 0.057 | 0.2 | 2637 | 0.007 | 0.857 |
| 0076 | 0.18 | 0.729 | 0939 | 0.177 | 0.714 | 1777 | 0.016 | 0.871 | 2647 | 0.171 | 0.286 |
| 0092 | 0.103 | 0.729 | 0940 | 0.105 | 0.743 | 1788 | 0.093 | 0.729 | 2648 | 0.161 | 0.257 |
| 0095 | 0.092 | 0.214 | 0946 | 0.083 | 0.743 | 1815 | 0.108 | 0.743 | 2660 | 0.111 | 0.286 |
| 0104 | 0.286 | 0.3 | 0956 | 0.07 | 0.786 | 1833 | 0.122 | 0.229 | 2675 | 0.306 | 0.286 |
| 0105 | 0.031 | 0.2 | 0958 | 0.066 | 0.771 | 1834 | 0.182 | 0.729 | 2676 | 0.101 | 0.7 |
| 0106 | 0.006 | 0.1 | 0966 | 0.031 | 0.786 | 1842 | 0.099 | 0.743 | 2690 | 0.231 | 0.271 |
| 0107 | 0.143 | 0.729 | 0986 | 0.029 | 0.814 | 1852 | 0.003 | 0.914 | 2692 | 0.153 | 0.271 |
| 0108 | 0.118 | 0.729 | 0993 | 0.102 | 0.729 | 1854 | 0.032 | 0.857 | 2695 | 0.105 | 0.743 |
| 0112 | 0.201 | 0.3 | 1007 | 0.138 | 0.286 | 1882 | 0.06 | 0.143 | 2696 | 0.33 | 0.3 |
| 0113 | 0.146 | 0.3 | 1016 | 0.064 | 0.229 | 1887 | 0.567 | 0.3 | 2701 | 0.111 | 0.3 |
| 0117 | 0.134 | 0.743 | 1025 | 0.023 | 0.214 | 1888 | 0.184 | 0.729 | 2706 | 0.136 | 0.286 |
| 0127 | 0.015 | 0.843 | 1028 | 0.042 | 0.729 | 1903 | 0.126 | 0.186 | 2712 | 0.213 | 0.286 |
| 0130 | 0.07 | 0.757 | 1034 | 0.077 | 0.714 | 1913 | 0.165 | 0.286 | 2726 | 0.051 | 0.229 |
| 0134 | 0.047 | 0.186 | 1036 | 0.052 | 0.186 | 1944 | 0.039 | 0.786 | 2727 | 0.399 | 0.3 |
| 0136 | 0.234 | 0.714 | 1053 | 0.044 | 0.229 | 1947 | 0.1 | 0.757 | 2729 | 0.129 | 0.243 |
| 0139 | 0.089 | 0.771 | 1055 | 0.127 | 0.729 | 1951 | 0.196 | 0.243 | 2735 | 0.241 | 0.729 |
| 0141 | 0.007 | 0.143 | 1056 | 0.151 | 0.7 | 1962 | 0.071 | 0.229 | 2740 | 0.19 | 0.271 |
| 0155 | 0.065 | 0.743 | 1057 | 0.191 | 0.257 | 1972 | 0.129 | 0.757 | 2741 | 0.714 | 0.3 |
| 0161 | 0.162 | 0.7 | 1080 | 0.139 | 0.743 | 1976 | 0.193 | 0.7 | 2745 | 0.086 | 0.729 |
| 0162 | 0.191 | 0.3 | 1086 | 0.045 | 0.786 | 1995 | 0.174 | 0.743 | 2751 | 0.102 | 0.2 |
| 0167 | 0.142 | 0.729 | 1088 | 0.075 | 0.771 | 2003 | 0.106 | 0.729 | 2760 | 0.017 | 0.186 |
| 0170 | 0.151 | 0.257 | 1089 | 0.184 | 0.786 | 2021 | 0.06 | 0.214 | 2765 | 0.208 | 0.7 |
| 0193 | 0.129 | 0.271 | 1093 | 0.129 | 0.271 | 2024 | 0.097 | 0.729 | 2768 | 0.333 | 0.714 |
| 0194 | 0.029 | 0.2 | 1099 | 0.169 | 0.3 | 2031 | 0.032 | 0.186 | 2777 | 0.066 | 0.243 |
| 0200 | 0.186 | 0.3 | 1106 | 0.199 | 0.7 | 2068 | 0.147 | 0.3 | 2785 | 0.029 | 0.2 |
| 0208 | 0.647 | 0.3 | 1109 | 0.141 | 0.771 | 2079 | 0.261 | 0.3 | 2788 | 0.161 | 0.257 |
| 0215 | 0.202 | 0.743 | 1111 | 0.48 | 0.3 | 2082 | 0.052 | 0.771 | 2795 | 0.201 | 0.3 |
| 0217 | 0.099 | 0.3 | 1115 | 0.347 | 0.743 | 2085 | 0.141 | 0.743 | 2796 | 0.276 | 0.7 |
| 0219 | 0.149 | 0.7 | 1116 | 0.1 | 0.771 | 2086 | 0.101 | 0.286 | 2805 | 0.054 | 0.243 |
| 0236 | 0.111 | 0.771 | 1121 | 0.268 | 0.3 | 2109 | 0.12 | 0.271 | 2815 | 0.196 | 0.3 |
| 0239 | 0.011 | 0.771 | 1129 | 0.108 | 0.257 | 2113 | 0.125 | 0.2 | 2827 | 0.061 | 0.771 |
| 0242 | 0.184 | 0.757 | 1136 | 0.069 | 0.214 | 2114 | 0.057 | 0.743 | 2829 | 0.076 | 0.814 |
| 0267 | 0.146 | 0.286 | 1146 | 0.139 | 0.286 | 2131 | 0.005 | 0.1 | 2834 | 0.216 | 0.257 |
| 0273 | 0.14 | 0.757 | 1164 | 0.136 | 0.271 | 2138 | 0.209 | 0.3 | 2852 | 0.145 | 0.286 |
| 0299 | 0.122 | 0.257 | 1182 | 0.126 | 0.743 | 2157 | 0.043 | 0.743 | 2857 | 0.034 | 0.843 |
| 0309 | 0.383 | 0.729 | 1184 | 0.015 | 0.814 | 2159 | 0.228 | 0.7 | 2859 | 0.111 | 0.3 |
| 0317 | 0.082 | 0.214 | 1189 | 0.097 | 0.757 | 2171 | 0.2 | 0.7 | 2860 | 0.075 | 0.214 |
| 0331 | 0.2 | 0.286 | 1192 | 0.115 | 0.3 | 2176 | 0.036 | 0.771 | 2891 | 0.18 | 0.286 |
| 0334 | 0.155 | 0.757 | 1204 | 0.19 | 0.7 | 2177 | 0.335 | 0.714 | 2916 | 0.101 | 0.257 |
| 0343 | 0.119 | 0.743 | 1207 | 0.016 | 0.829 | 2192 | 0.285 | 0.729 | 2920 | 0.084 | 0.229 |
| 0359 | 0.081 | 0.257 | 1213 | 0.008 | 0.086 | 2202 | 0.173 | 0.3 | 2922 | 0.126 | 0.186 |
| 0373 | 0.209 | 0.714 | 1222 | 0.068 | 0.214 | 2204 | 0.122 | 0.243 | 2924 | 0.034 | 0.829 |
| 0393 | 0.175 | 0.271 | 1237 | 0.059 | 0.186 | 2205 | 0.154 | 0.743 | 2928 | 0.268 | 0.7 |
| 0394 | 0.041 | 0.157 | 1241 | 0.22 | 0.3 | 2217 | 0.195 | 0.286 | 2930 | 0.247 | 0.257 |
| 0395 | 0.096 | 0.729 | 1242 | 0.347 | 0.257 | 2226 | 0.12 | 0.729 | 2933 | 0.081 | 0.229 |
| 0398 | 0.32 | 0.714 | 1268 | 0.06 | 0.757 | 2227 | 0.024 | 0.157 | 2956 | 0.113 | 0.271 |

TABLE 21-continued

List of 467 lncRNAs which are differentially expressed and/or have an AUC > 0.7 or < 0.3 between the low LVEF group (LVEF ≤ 45) and the high LVEF group (LVEF > 45)

| lncRNA (SEQ ID NO:) | p-value | AUC | lncRNA (SEQ ID NO:) | p-value | AUC | lncRNA (SEQ ID NO:) | p-value | AUC | lncRNA (SEQ ID NO:) | p-value | AUC |
| --- | --- | --- | --- | --- | --- | --- | --- | --- | --- | --- | --- |
| 0405 | 0.168 | 0.286 | 1270 | 0.121 | 0.257 | 2234 | 0.16 | 0.257 | 2957 | 0.091 | 0.286 |
| 0412 | 0.522 | 0.229 | 1273 | 0.147 | 0.257 | 2235 | 0.065 | 0.214 | 2959 | 0.885 | 0.7 |
| 0425 | 0.284 | 0.714 | 1291 | 0.067 | 0.257 | 2244 | 0.63 | 0.7 | 2961 | 0.014 | 0.186 |
| 0426 | 0.119 | 0.7 | 1300 | 0.097 | 0.8 | 2252 | 0.006 | 0.9 | 2963 | 0.128 | 0.714 |
| 0427 | 0.128 | 0.757 | 1304 | 0.216 | 0.714 | 2264 | 0.206 | 0.3 | 2967 | 0.134 | 0.257 |
| 0434 | 0.381 | 0.7 | 1310 | 0.022 | 0.157 | 2268 | 0.013 | 0.086 | 2972 | 0.378 | 0.743 |
| 0440 | 0.15 | 0.714 | 1321 | 0.081 | 0.257 | 2270 | 0.146 | 0.257 | 2974 | 0.169 | 0.743 |
| 0441 | 0.122 | 0.243 | 1328 | 0.129 | 0.3 | 2273 | 0.026 | 0.857 | 2977 | 0.043 | 0.129 |
| 0467 | 0.201 | 0.7 | 1336 | 0.047 | 0.743 | 2279 | 0.121 | 0.3 | 2978 | 0.261 | 0.271 |
| 0474 | 0.252 | 0.757 | 1343 | 0.132 | 0.714 | 2281 | 0.108 | 0.714 | 2986 | 0.062 | 0.229 |
| 0479 | 0.073 | 0.214 | 1345 | 0.188 | 0.286 | 2289 | 0.145 | 0.7 | 2988 | 0.141 | 0.257 |
| 0482 | 0.231 | 0.714 | 1350 | 0.118 | 0.3 | 2294 | 0.082 | 0.729 | 2993 | 0.026 | 0.171 |
| 0490 | 0.13 | 0.714 | 1354 | 0.181 | 0.714 | 2297 | 0.619 | 0.714 | 2995 | 0.152 | 0.286 |
| 0493 | 0.142 | 0.714 | 1369 | 0.141 | 0.271 | 2305 | 0.082 | 0.757 | 2996 | 0.197 | 0.3 |
| 0494 | 0.095 | 0.743 | 1378 | 0.28 | 0.286 | 2309 | 0.117 | 0.757 | 2997 | 0.054 | 0.243 |
| 0501 | 0.093 | 0.271 | 1379 | 0.181 | 0.743 | 2318 | 0.066 | 0.714 | 2998 | 0.089 | 0.243 |
| 0502 | 0.178 | 0.7 | 1381 | 0.757 | 0.286 | 2319 | 0.264 | 0.3 | 3009 | 0.224 | 0.3 |
| 0510 | 0.108 | 0.3 | 1384 | 0.095 | 0.271 | 2321 | 0.021 | 0.771 | 3017 | 0.168 | 0.271 |
| 0515 | 0.085 | 0.229 | 1398 | 0.468 | 0.3 | 2326 | 0.126 | 0.743 | 3027 | 0.389 | 0.3 |
| 0534 | 0.43 | 0.743 | 1403 | 0.096 | 0.757 | 2334 | 0.285 | 0.257 | 3030 | 0.165 | 0.271 |
| 0536 | 0.074 | 0.743 | 1406 | 0.108 | 0.271 | 2336 | 0.085 | 0.757 | 3040 | 0.036 | 0.8 |
| 0538 | 0.259 | 0.7 | 1409 | 0.218 | 0.229 | 2339 | 0.15 | 0.729 | 3042 | 0.214 | 0.186 |
| 0540 | 0.038 | 0.2 | 1411 | 0.091 | 0.757 | 2347 | 0.043 | 0.743 | 3054 | 0.188 | 0.243 |
| 0542 | 0.021 | 0.857 | 1426 | 0.165 | 0.714 | 2355 | 0.207 | 0.3 | 3058 | 0.091 | 0.757 |
| 0547 | 0.12 | 0.729 | 1433 | 0.006 | 0.129 | 2375 | 0.349 | 0.3 | 3064 | 0.171 | 0.714 |
| 0549 | 0.104 | 0.743 | 1439 | 0.056 | 0.229 | 2379 | 0.036 | 0.857 | 3067 | 0.148 | 0.286 |
| 0550 | 0.137 | 0.743 | 1440 | 0.198 | 0.3 | 2382 | 0.072 | 0.229 | 3069 | 0.291 | 0.3 |
| 0552 | 0.151 | 0.743 | 1445 | 0.229 | 0.7 | 2386 | 0.172 | 0.257 | 3077 | 0.212 | 0.3 |
| 0571 | 0.415 | 0.271 | 1458 | 0.149 | 0.771 | 2388 | 0.289 | 0.271 | 3078 | 0.057 | 0.786 |
| 0574 | 0.168 | 0.3 | 1474 | 0.092 | 0.257 | 2389 | 0.015 | 0.171 | 3079 | 0.031 | 0.186 |
| 0581 | 0.081 | 0.729 | 1478 | 0.27 | 0.3 | 2392 | 0.189 | 0.243 | 3083 | 0.171 | 0.286 |
| 0596 | 0.208 | 0.229 | 1490 | 0.223 | 0.3 | 2393 | 0.124 | 0.257 | 3092 | 0.283 | 0.243 |
| 0598 | 0.352 | 0.3 | 1491 | 0.195 | 0.3 | 2395 | 0.068 | 0.714 | 3102 | 0.209 | 0.3 |
| 0603 | 0.238 | 0.286 | 1493 | 0.042 | 0.2 | 2402 | 0.438 | 0.714 | 3111 | 0.303 | 0.286 |
| 0615 | 0.231 | 0.257 | 1495 | 0.185 | 0.3 | 2405 | 0.001 | 0.929 | 3119 | 0.042 | 0.229 |
| 0617 | 0.174 | 0.714 | 1504 | 0.211 | 0.271 | 2406 | 0.049 | 0.186 | 3124 | 0.04 | 0.829 |
| 0620 | 0.06 | 0.257 | 1508 | 0.115 | 0.157 | 2408 | 0.22 | 0.257 | 3126 | 0.158 | 0.714 |
| 0635 | 0.089 | 0.214 | 1515 | 0.251 | 0.257 | 2409 | 0.045 | 0.829 | 3129 | 0.152 | 0.271 |
| 0636 | 0.148 | 0.743 | 1516 | 0.21 | 0.729 | 2420 | 0.102 | 0.257 | 3140 | 0.185 | 0.271 |
| 0659 | 0.005 | 0.914 | 1536 | 0.066 | 0.229 | 2420 | 0.08 | 0.743 | 3141 | 0.036 | 0.214 |
| 0677 | 0.081 | 0.757 | 1537 | 0.127 | 0.7 | 2427 | 0.038 | 0.8 | 3142 | 0.015 | 0.157 |
| 0698 | 0.048 | 0.771 | 1539 | 0.168 | 0.729 | 2429 | 0.082 | 0.186 | 3144 | 0.145 | 0.243 |
| 0702 | 0.074 | 0.757 | 1548 | 0.183 | 0.3 | 2433 | 0.105 | 0.257 | 3147 | 0.037 | 0.171 |
| 0707 | 0.092 | 0.757 | 1558 | 0.079 | 0.229 | 2437 | 0.058 | 0.757 | 3148 | 0.19 | 0.714 |
| 0709 | 0.137 | 0.286 | 1570 | 0.014 | 0.171 | 2440 | 0.157 | 0.257 | 3154 | 0.302 | 0.714 |
| 0716 | 0.017 | 0.186 | 1573 | 0.107 | 0.271 | 2450 | 0.101 | 0.229 | 3156 | 0.09 | 0.257 |
| 0724 | 0.048 | 0.814 | 1576 | 0.044 | 0.786 | 2454 | 0.058 | 0.771 | 3157 | 0.092 | 0.243 |
| 0731 | 0.108 | 0.2 | 1587 | 0.009 | 0.9 | 2459 | 0.03 | 0.8 | 3169 | 0.005 | 0.914 |
| 0748 | 0.11 | 0.286 | 1591 | 0.192 | 0.714 | 2472 | 0.2 | 0.271 | 3170 | 0.428 | 0.286 |
| 0750 | 0.009 | 0.143 | 1592 | 0.24 | 0.743 | 2475 | 0.303 | 0.286 | 3176 | 0.032 | 0.771 |
| 0751 | 0.102 | 0.2 | 1593 | 0.032 | 0.814 | 2487 | 0.115 | 0.786 | 3178 | 0.017 | 0.2 |
| 0766 | 0.16 | 0.714 | 1594 | 0.147 | 0.286 | 2492 | 0.147 | 0.3 | 3179 | 0.235 | 0.3 |
| 0772 | 0.134 | 0.286 | 1599 | 0.101 | 0.729 | 2497 | 0.149 | 0.729 | 3182 | 0.064 | 0.786 |
| 0779 | 0.716 | 0.714 | 1609 | 0.059 | 0.186 | 2501 | 0.138 | 0.743 | 3183 | 0.059 | 0.743 |
| 0805 | 0.504 | 0.714 | 1623 | 0.153 | 0.271 | 2503 | 0.122 | 0.7 | 3186 | 0.092 | 0.2 |
| 0806 | 0.16 | 0.3 | 1638 | 0.1 | 0.3 | 2511 | 0.314 | 0.286 | 3207 | 0.123 | 0.257 |
| 0833 | 0.067 | 0.214 | 1647 | 0.181 | 0.7 | 2513 | 0.048 | 0.857 | 3208 | 0.138 | 0.3 |
| 0839 | 0.178 | 0.714 | 1649 | 0.054 | 0.229 | 2518 | 0.075 | 0.243 | 3209 | 0.11 | 0.257 |
| 0851 | 0.103 | 0.743 | 1656 | 0.102 | 0.271 | 2521 | 0.153 | 0.286 | 3210 | 0.055 | 0.757 |
| 0852 | 0.122 | 0.243 | 1660 | 0.067 | 0.786 | 2529 | 0.099 | 0.271 | 3213 | 0.052 | 0.157 |
| 0862 | 0.023 | 0.843 | 1671 | 0.421 | 0.257 | 2532 | 0.164 | 0.714 | 3221 | 0.207 | 0.3 |
| 0864 | 0.174 | 0.257 | 1678 | 0.148 | 0.286 | 2533 | 0.02 | 0.157 | 3222 | 0.092 | 0.229 |
| 0866 | 0.095 | 0.7 | 1691 | 0.223 | 0.7 | 2552 | 0.107 | 0.214 | 3228 | 0.265 | 0.3 |
| 0874 | 0.152 | 0.7 | 1692 | 0.207 | 0.7 | 2555 | 0.504 | 0.3 | | | |

Correlation Between LncRNA and Left Ventricular Ejection Fraction

LncRNAs expression level can be considered as a continuous value. Spearman correlation factor is calculated to measure the correlation between LVEF value at one month and expression level. When a threshold of (+ or −) 0.45 for correlation factor is applied, the expression of 159 lncRNAs is positively or negatively correlated with prediction of LVEF at 1 month. Among these 159 lncRNAs, 94 have a positive correlation factor whereas 65 have a negative correlation factor (Table 22).

TABLE 22

List of 159 lncRNAs with spearman correlation factor higher than 0.45 (absolute value)

| LncRNA (SEQ ID NO:) | correlation | LncRNA (SEQ ID NO:) | correlation | LncRNA (SEQ ID NO:) | correlation | LncRNA (SEQ ID NO:) | correlation |
|---|---|---|---|---|---|---|---|
| 0002 | −0.522 | 0958 | −0.482 | 1899 | 0.564 | 2647 | 0.452 |
| 0005 | −0.477 | 0966 | −0.545 | 1935 | 0.55 | 2660 | 0.483 |
| 0008 | 0.565 | 0980 | 0.456 | 1962 | 0.473 | 2692 | 0.603 |
| 0068 | 0.461 | 0986 | −0.651 | 2021 | 0.49 | 2740 | 0.52 |
| 0104 | 0.454 | 1055 | −0.455 | 2031 | 0.475 | 2742 | −0.475 |
| 0108 | −0.581 | 1057 | 0.585 | 2062 | 0.546 | 2745 | −0.531 |
| 0111 | 0.67 | 1065 | 0.667 | 2082 | −0.542 | 2767 | −0.484 |
| 0134 | 0.729 | 1075 | 0.474 | 2094 | 0.648 | 2785 | 0.457 |
| 0139 | −0.489 | 1093 | 0.461 | 2161 | 0.565 | 2827 | −0.493 |
| 0155 | −0.511 | 1207 | −0.591 | 2176 | −0.686 | 2843 | 0.473 |
| 0168 | 0.522 | 1208 | 0.543 | 2177 | −0.467 | 2857 | −0.459 |
| 0210 | −0.458 | 1213 | 0.541 | 2192 | −0.554 | 2860 | 0.572 |
| 0219 | −0.476 | 1222 | 0.466 | 2204 | 0.461 | 2865 | −0.517 |
| 0246 | 0.523 | 1270 | 0.516 | 2205 | −0.566 | 2886 | −0.493 |
| 0292 | 0.585 | 1299 | −0.479 | 2225 | 0.569 | 2920 | 0.453 |
| 0343 | −0.47 | 1343 | −0.593 | 2227 | 0.573 | 2961 | 0.467 |
| 0394 | 0.497 | 1354 | −0.47 | 2230 | 0.569 | 2974 | −0.575 |
| 0443 | −0.573 | 1403 | −0.463 | 2263 | 0.532 | 2978 | 0.555 |
| 0462 | 0.452 | 1412 | −0.524 | 2303 | 0.618 | 2993 | 0.453 |
| 0487 | 0.456 | 1433 | 0.564 | 2309 | −0.527 | 3006 | −0.476 |
| 0510 | 0.504 | 1440 | 0.575 | 2326 | −0.481 | 3029 | 0.606 |
| 0536 | −0.481 | 1465 | 0.632 | 2346 | −0.533 | 3046 | −0.483 |
| 0596 | 0.544 | 1477 | 0.553 | 2390 | 0.521 | 3058 | −0.474 |
| 0624 | 0.493 | 1508 | 0.667 | 2392 | 0.567 | 3079 | 0.487 |
| 0635 | 0.503 | 1558 | 0.57 | 2405 | −0.499 | 3086 | 0.468 |
| 0639 | 0.482 | 1560 | 0.567 | 2406 | 0.617 | 3108 | 0.576 |
| 0659 | −0.486 | 1573 | 0.525 | 2444 | 0.472 | 3124 | −0.487 |
| 0677 | −0.519 | 1587 | −0.465 | 2450 | 0.451 | 3128 | 0.577 |
| 0681 | −0.547 | 1594 | 0.499 | 2459 | −0.656 | 3141 | 0.527 |
| 0698 | −0.666 | 1598 | −0.496 | 2487 | −0.497 | 3142 | 0.604 |
| 0701 | 0.455 | 1660 | −0.47 | 2492 | 0.557 | 3156 | 0.517 |
| 0716 | 0.529 | 1678 | 0.507 | 2497 | −0.496 | 3169 | −0.675 |
| 0731 | 0.518 | 1682 | 0.451 | 2513 | −0.525 | 3176 | −0.457 |
| 0766 | −0.476 | 1687 | −0.49 | 2542 | −0.536 | 3178 | 0.46 |
| 0772 | 0.524 | 1698 | −0.53 | 2576 | 0.542 | 3183 | −0.582 |
| 0833 | 0.471 | 1723 | −0.581 | 2586 | 0.524 | 3200 | 0.543 |
| 0841 | −0.527 | 1740 | −0.533 | 2611 | 0.452 | 3207 | 0.451 |
| 0884 | 0.472 | 1794 | 0.517 | 2636 | 0.493 | 3209 | 0.533 |
| 0914 | 0.454 | 1852 | −0.541 | 2642 | 0.514 | 3213 | 0.665 |
| 0946 | −0.451 | 1854 | −0.534 | 2645 | 0.471 | | |

Comparison of the Total RNA-Seq and FiMICS Analysis

Figure 6:
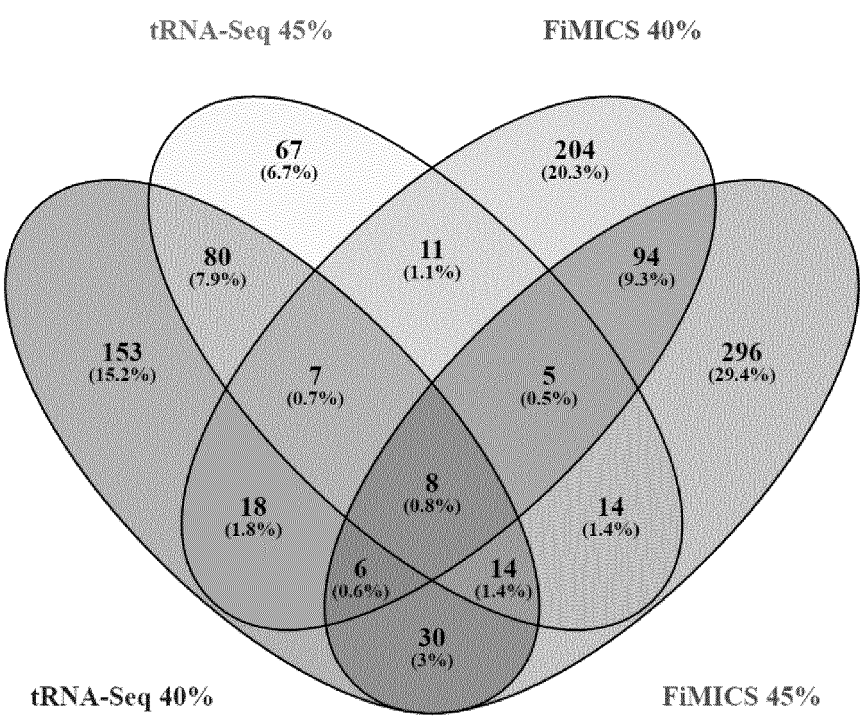
FIG. 6 shows Venn diagram of the significantly expressed lncRNAs from analysis of RNASeq and FiMICS data generated in serum samples collected at D3 of patients with AMI for the prediction of ventricular remodeling measured by the Echocardiography at month 1 post PCI. Low LVEF corresponding to the ventricular remodeling is grouped using two thresholds: either LVEF<40% or 45%.

Detection level and performance of the lncRNAs can vary in function of the method and number of samples used. FIG. 6 represent the Venn diagram for each analysis using a threshold of LVEF at 40% and 45% for total RNA-Sequencing and FiMICS test. For the comparison of the 4 conditions, 8 lncRNAs are common to all conditions (SEQ ID NO: 1204, SEQ ID NO: 2454, SEQ ID NO: 0334, SEQ ID NO: 1403, SEQ ID NO: 1089, SEQ ID NO: 2692, SEQ ID NO: 2273, and SEQ ID NO: 0502).

An example of probes sequences designed on FiMICS for the first lncRNA (SEQ ID NO: 1204) includes the below sequences;

| FIMICS Probe sequence | lncRNA |
|---|---|
| GTTCTACTCAAAGGGTCAGTTTAGGGCATAATTAAAGTCAAT TACTTTCTGAAAGGCCATCAGGACAACTGTTAGAGAAAATGA TAGCAGCCCCGCACTTGCTGTAGGAATTATTAGCTT (SEQ ID NO: 3247) | SEQ NO: ID 1204 |
| CAGGACAACTGTTAGAGAAAATGATAGCAGCCCCGCACTTGC TGTAGGAATTATTAGCTTGTCAGCCTCCAGGCTTATGGAGAC AAAGGATCAAAAAGTTAGAGAGATCCAGGTGTTCAC (SEQ ID NO: 3248) | SEQ NO: ID 1204 |
| GTCAGCCTCCAGGCTTATGGAGACAAAGGATCAAAAAGTTAG AGAGATCCAGGTGTTCACCTATTTGTTCACTAATTCTTTTATT GTGAGTGTGCATGTGTGTGGGTGGGTGTGACATTT (SEQ ID NO: 3249) | SEQ NO: ID 1204 |
| CTATTTGTTCACTAATTCTTTTATTGTGAGTGTGCATGTGTGTG GGTGGGTGTGACATTTATTATGAACCAGAGGGCAGGAGCCAG TGACACAGTGGTCAGAGAATAATCATATTCCCT (SEQ ID NO: 3250) | SEQ NO: ID 1204 |
| ATTATGAACCAGAGGGCAGGAGCCAGTGACACAGTGGTGCA GAGAATAATCATATTCCCTGCCTTCCTGGGGTCATACAGCTTG GTGGAGGACACAGATGTGAATTCGGTAATCACTCCA (SEQ ID NO: 3251) | SEQ NO: ID 1204 |
| GCCTTCCTGGGGTCATACAGCTTGGTGGAGGACACAGATGTG AATTCGGTAATCACTCCAATAAATATTCTCCTACAGATGAAG AAAGATGATACGATGTGATGGACAACAGAGACTTAT (SEQ ID NO: 3252) | SEQ NO: ID 1204 |
| ATAAATATTCTCCTACAGATGAAGAAAGATGATACGATGTGA TGGACAACAGAGACTTATATGGTGGGGTCTGGGCTGGTCTTT CTGAAGCTAAGACTGGCAGGATGAGCAGGAGTTTGC (SEQ ID NO: 3253) | SEQ NO: ID 1204 |

| FIMICS Probe sequence | lncRNA |
|---|---|
| ATGGTGGGGTCTGGGCTGGTCTTTCTGAAGCTAAGACTGGCA<br>GGATGAGCAGGAGTTTGCCAGACAAAGAGGAGTGGAGTTGT<br>TTTCCAAACACATCTCAGCACAAAGTGTTGTCTTTGC<br>(SEQ ID NO: 3254) | SEQ<br>NO:<br>ID<br>1204 |
| CAGACAAAGAGGAGTGGAGTTGTTTTCCAAACACATCTCAGC<br>ACAAAGTGTTGTCTTTGCTGGGAGCTGAAAAAAGATAGTGTG<br>GGCAGAGACCATTAGGTGAGACGCTTGATATGAGAT<br>(SEQ ID NO: 3255) | SEQ<br>NO:<br>ID<br>1204 |
| TGGGAGCTGAAAAAAGATAGTGTGGGCAGAGACCATTAGGT<br>GAGACGCTTGATATGAGATACAACCTCAACAGGTGGAAGAA<br>GATCATGAGAGATGAAGAGAGGAATATAGTACAGCAGA<br>(SEQ ID NO: 3256) | SEQ<br>NO:<br>ID<br>1204 |
| ACAACCTCAACAGGTGGAAGAAGATCATGAGAGATGAAGAG<br>AGGAATATAGTACAGCAGAGAGGACACAGAAGCTGACGTCA<br>GGGTGTCTCAGTTTGAAACCAGTGGCCACCCTGTTCCT<br>(SEQ ID NO: 3257) | SEQ<br>NO:<br>ID<br>1204 |
| GAGGACACAGAAGCTGACGTCAGGGTGTCTCAGTTTGAAACC<br>AGTGGCCACCCTGTTCCTCTCCCATGTGGTCCCATCATGGGCC<br>TCTAGGGTCTGGGATAAGAGGTTAATGAATATCTC<br>(SEQ ID NO: 3258) | SEQ<br>NO:<br>ID<br>1204 |
| CTCCCATGTGGTCCCATCATGGGCCTCTAGGGTCTGGGATAA<br>GAGGTTAATGAATATCTCATACCCTAAGCAGGGGTGGTCCCT<br>GCACTTTAGCAAAAAGTTAAGGAACTAGGGAAAAGA<br>(SEQ ID NO: 3259) | SEQ<br>NO:<br>ID<br>1204 |
| ATACCCTAAGCAGGGGTGGTCCCTGCACTTTAGCAAAAAGTT<br>AAGGAACTAGGGAAAAGAGATGGAAATAATAAAGAGATGGG<br>ACAAAGACTTTGAAGACCAAAGCCCCTGGGCTATTCT<br>(SEQ ID NO: 3260) | SEQ<br>NO:<br>ID<br>1204 |
| GATGGAAATAATAAAGAGATGGGACAAAGACTTTGAAGACC<br>AAAGCCCCTGGGCTATTCTCTTTTTTAAATTTTTTTATTTAAAT<br>TTTCATTTATTTTTATCAAGATAGGGTCTCACTAT<br>(SEQ ID NO: 3261) | SEQ<br>NO:<br>ID<br>1204 |
| CTTTTTTAAATTTTTTTATTTAAATTTTCATTTATTTTTATCAA<br>GATAGGGTCTCACTATGTTGCCCAGGTTGGTCTCAAACTTTTG<br>GCCTAAAGCAATCCTCCCACCTTGGCCTCCCAA<br>(SEQ ID NO: 3262) | SEQ<br>NO:<br>ID<br>1204 |
| GTTGCCCAGGTTGGTCTCAAACTTTTGGCCTAAAGCAATCCTC<br>CCACCTTGGCCTCCCAATGTGCTGGGATTACAATGTGAGCCA<br>CCACGTCCAGCCTCCTGGGATATTTCTCAATGAAA<br>(SEQ ID NO: 3263) | SEQ<br>NO:<br>ID<br>1204 |
| TGTGCTGGGATTACAATGTGAGCCACCACGTCCAGCCTCCTG<br>GGATATTTCTCAATGAAACATTGGATGCCAAGATTGGTTTTGT<br>GCCACATGCCAATTTCACAGAAGCCAGTCTATGAG<br>(SEQ ID NO: 3264) | SEQ<br>NO:<br>ID<br>1204 |
| CATTGGATGCCAAGATTGGTTTTGTGCCACATGCCAATTTCAC<br>AGAAGCCAGTCTATGAGCCACCAGCTCTACTCAGCAATTACA<br>GTTTCTGGAACTTTGGCTAAATTCCTGTAGATGCA<br>(SEQ ID NO: 3265) | SEQ<br>NO:<br>ID<br>1204 |
| CCACCAGCTCTACTCAGCAATTACAGTTTCTGGAACTTTGGCT<br>AAATTCCTGTAGATGCACCACTGCTTGTGGCCTGACTCTTTGC<br>CACCCAAGTGCGCTCAGCCTCCCCTGGGGAGTCT<br>(SEQ ID NO: 3266) | SEQ<br>NO:<br>ID<br>1204 |
| CCACTGCTTGTGGCCTGACTCTTTGCCACCCAAGTGCGCTCAG<br>CCTCCCCTGGGGAGTCTGCCAGGCTTGCATGGCTCCCACTGC<br>ACTTGCTGTGCTGGGACCGAAAACAGTTTTTGTGC<br>(SEQ ID NO: 3267) | SEQ<br>NO:<br>ID<br>1204 |
| GCCAGGCTTGCATGGCTCCCACTGCACTTGCTGTGCTGGGAC<br>CGAAAACAGTTTTTGTGCCCCTAGCTTAACTCCACTGGATTCA<br>TAGAGGCTTTGGCCTCCTCAATGGCTGTCCTGGGA<br>(SEQ ID NO: 3268) | SEQ<br>NO:<br>ID<br>1204 |
| CCCTAGCTTAACTCCACTGGATTCATAGAGGCTTTGGCCTCCT<br>CAATGGCTGTCCTGGGACAGGGAGGCTGGTTAGCACAATTAA<br>CACAACCTGGTCATGCAAGGCATTGATGGTCCGTA<br>(SEQ ID NO: 3269) | SEQ<br>NO:<br>ID<br>1204 |
| CAGGGAGGCTGGTTAGCACAATTAACACAACCTGGTCATGCA<br>AGGCATTGATGGTCCGTAACATGAACTTTGACCAGTAGGAGA<br>CAGAGAATGGAAAAAAGCCAGCAGATAAATCATCTG<br>(SEQ ID NO: 3270) | SEQ<br>NO:<br>ID<br>1204 |
| ACATGAACTTTGACCAGTAGGAGACAGAGAATGGAAAAAAG<br>CCAGCAGATAAATCATCTGGCCTTCCTCCCCTATGACAGACT<br>GTTCTGAGCCACAGTGTTTCACATGTCTTCCTGGAGA<br>(SEQ ID NO: 3271) | SEQ<br>NO:<br>ID<br>1204 |
| GCCTTCCTCCCCTATGACAGACTGTTCTGAGCCACAGTGTTTC<br>ACATGTCTTCCTGGAGATGTCCCACATGACTTGAGCAACCAG<br>CTGGAGCTCTGGAGAAACTGTGGCCATCCTGGTAA<br>(SEQ ID NO: 3272) | SEQ<br>NO:<br>ID<br>1204 |
| TGTCCCACATGACTTGAGCAACCAGCTGGAGCTCTGGAGAAA<br>CTGTGGCCATCCTGGTAACATATGACCTTGTATTTGCTTTCTC<br>TCCTTCCTGCTTTATTTCCCTATGTCCCTTACTTT<br>(SEQ ID NO: 3273) | SEQ<br>NO:<br>ID<br>1204 |
| CTGTGGCCATCCTGGTAACATATGACCTTGTATTTGCTTTCTC<br>TCCTTCCTGCTTTATTTCCCTATGTCCCTTACTTTGGTTGTTGG<br>GATTGCACCTCCCAATAAAGCATTAGCATGTCC<br>(SEQ ID NO: 3274) | SEQ<br>NO:<br>ID<br>1204 |

Example 5: LncRNA Detection in PAXgene Samples Using a mRNA-Seq Protocol

Material and Methods:

Paxgene samples collected at discharge of patient between D3 and D5 from 57 patients with AMI from the MitoCare cohort are used for lncRNA profiling. Mitocare is a multicenter, randomized, double-blind, placebo controlled study. The study population includes AMI patients undergoing PCI, older than 18 years. The primary endpoint is the level of left ventricular ejection fraction (LVEF) less than 40% at 1 month. Demographics data are presented in Table 23.

TABLE 23

Demographic data of patients used from Mitocare study

| | Group 1 | Group 2 | Group 3 |
|---|---|---|---|
| EF | <40 | 41-50 | >50 |
| Nb | 8 | 20 | 29 |
| Age | 68.9 | 60.5 | 60.0 |
| Male | 88% | 95% | 81% |
| BMI | 27.0 | 28.1 | 26.6 |
| Systolic Blood Pressure | 103.0 | 119.4 | 116.9 |
| Diastolic Blood Pressure | 66.0 | 71.9 | 69.6 |
| Heart Rate | 82.3 | 72.9 | 66.9 |

RNA extraction, preparation of sequencing libraires and sequencing are performed as described in Example 3.

Results:

Comparison Between Low LVEF (LVEF≤40) and High LVEF (LVEF>40)

In this analysis, the 57 samples AMI were grouped into 2 groups using the threshold of 40% LVEF: low LVEF (LVEF≤40) and high LVEF (LVEF>40). The volcano plot showed the differential expression of lncRNA. 102 lncRNA are differentially expressed and among them, 19 lncRNA have a fold change>2 or <0.5, which are shown in Table 24. 171 lncRNAs with P<0.05 and/or individual AUC>0.7 or <0.3 are listed in Table 25.

TABLE 24

List of 19 lncRNAs which are differentially expressed with a fold change >2 or <0.5 between the low LVEF group (LVEF ≤ 40) and the high LVEF group (LVEF > 40)

| lncRNA | P-value | Fold change | Individual AUC |
|---|---|---|---|
| SEQ ID NO: 0822 | 0.0003 | 0.119 | 0.717 |
| SEQ ID NO: 1170 | 0.0012 | 0.446 | 0.744 |
| SEQ ID NO: 1755 | 0.0014 | 0.434 | 0.75 |
| SEQ ID NO: 0058 | 0.0024 | 0.244 | 0.709 |
| SEQ ID NO: 2007 | 0.0027 | 0.289 | 0.744 |
| SEQ ID NO: 0430 | 0.0039 | 0.394 | 0.717 |
| SEQ ID NO: 0110 | 0.0053 | 0.33 | 0.745 |
| SEQ ID NO: 1331 | 0.0071 | 0.202 | 0.712 |

TABLE 24-continued

List of 19 lncRNAs which are differentially expressed with a fold change >2 or <0.5 between the low LVEF group (LVEF ≤ 40) and the high LVEF group (LVEF > 40)

| lncRNA | P-value | Fold change | Individual AUC |
|---|---|---|---|
| SEQ ID NO: 0388 | 0.0104 | 0.294 | 0.699 |
| SEQ ID NO: 0585 | 0.0156 | 2.091 | 0.194 |
| SEQ ID NO: 0117 | 0.0174 | 0.356 | 0.673 |
| SEQ ID NO: 0415 | 0.0204 | 0.407 | 0.653 |
| SEQ ID NO: 1263 | 0.0223 | 0.471 | 0.672 |
| SEQ ID NO: 0383 | 0.0269 | 0.38 | 0.708 |
| SEQ ID NO: 0187 | 0.0281 | 0.436 | 0.741 |
| SEQ ID NO: 0611 | 0.0310 | 0.355 | 0.656 |
| SEQ ID NO: 2446 | 0.0364 | 0.363 | 0.663 |
| SEQ ID NO: 0548 | 0.0389 | 0.488 | 0.592 |
| SEQ ID NO: 0074 | 0.0461 | 12.549 | 0.221 |

TABLE 25

List of 171 lncRNA, which are differentially expressed and/or have an AUC > 0.7 or < 0.3 between the low LVEF group (LVEF ≤ 40) and the high LVEF group (LVEF > 40)

| LncRNA (SEQ ID NO:) | P-value | AUC | LncRNA (SEQ ID NO:) | P-value | AUC | LncRNA (SEQ ID NO:) | P-value | AUC | LncRNA (SEQ ID NO:) | P-value | AUC |
|---|---|---|---|---|---|---|---|---|---|---|---|
| 0007 | 0.0583 | 0.268 | 0690 | 0.0004 | 0.23 | 1483 | 0.0008 | 0.176 | 2487 | 0.036 | 0.712 |
| 0016 | 0.0542 | 0.263 | 0720 | 0.1176 | 0.73 | 1507 | 0.0098 | 0.293 | 2490 | 0.0171 | 0.268 |
| 0058 | 0.0024 | 0.709 | 0749 | 0.0645 | 0.263 | 1510 | 0.0003 | 0.765 | 2506 | 0.4184 | 0.704 |
| 0069 | 0.0124 | 0.196 | 0756 | 0.0586 | 0.273 | 1511 | 0.0166 | 0.212 | 2522 | 0.0929 | 0.281 |
| 0074 | 0.0461 | 0.221 | 0784 | 0.1568 | 0.283 | 1519 | 0.0066 | 0.681 | 2540 | 0.0604 | 0.27 |
| 0110 | 0.0053 | 0.745 | 0802 | 0.0345 | 0.745 | 1531 | 0.0143 | 0.694 | 2563 | 0.0566 | 0.217 |
| 0113 | 0.0656 | 0.26 | 0803 | 0.0922 | 0.288 | 1533 | 0.0079 | 0.699 | 2571 | 0.0761 | 0.189 |
| 0114 | 0.0453 | 0.661 | 0807 | 0.0841 | 0.281 | 1536 | 0.011 | 0.196 | 2579 | 0.0415 | 0.263 |
| 0117 | 0.0174 | 0.673 | 0816 | 0.0431 | 0.633 | 1591 | 0.0256 | 0.661 | 2588 | 0.0888 | 0.296 |
| 0163 | 0.0042 | 0.158 | 0822 | 0.0003 | 0.717 | 1632 | 0.0308 | 0.283 | 2647 | 0.0615 | 0.283 |
| 0169 | 0.0956 | 0.296 | 0845 | 0.0437 | 0.671 | 1638 | 0.0316 | 0.24 | 2651 | 0.1479 | 0.286 |
| 0187 | 0.0281 | 0.741 | 0914 | 0.0473 | 0.635 | 1669 | 0.0466 | 0.247 | 2672 | 0.0525 | 0.255 |
| 0211 | 0.107 | 0.276 | 0957 | 0.0172 | 0.783 | 1705 | 0.1096 | 0.288 | 2675 | 0.0735 | 0.286 |
| 0240 | 0.0145 | 0.293 | 0968 | 0.0541 | 0.27 | 1755 | 0.0014 | 0.75 | 2692 | 0.0639 | 0.298 |
| 0244 | 0.0702 | 0.291 | 0982 | 0.0477 | 0.607 | 1777 | 0.0585 | 0.255 | 2697 | 0.0147 | 0.237 |
| 0246 | 0.1547 | 0.758 | 0997 | 0.0532 | 0.199 | 1795 | 0.0046 | 0.199 | 2701 | 0.0295 | 0.245 |
| 0265 | 0.2273 | 0.763 | 1023 | 0.0664 | 0.263 | 1809 | 0.041 | 0.265 | 2720 | 0.0434 | 0.255 |
| 0321 | 0.0044 | 0.727 | 1025 | 0.028 | 0.204 | 1822 | 0.0575 | 0.268 | 2727 | 0.0337 | 0.24 |
| 0329 | 0.0702 | 0.26 | 1036 | 0.0415 | 0.281 | 1826 | 0.101 | 0.298 | 2755 | 0.1095 | 0.709 |
| 0334 | 0.3913 | 0.782 | 1047 | 0.0529 | 0.702 | 1885 | 0.0416 | 0.577 | 2779 | 0.0642 | 0.291 |
| 0336 | 0.1104 | 0.276 | 1065 | 0.008 | 0.255 | 1936 | 0.0348 | 0.263 | 2783 | 0.0001 | 0.839 |
| 0348 | 0.0269 | 0.314 | 1066 | 0.0476 | 0.27 | 1949 | 0.0036 | 0.676 | 2794 | 0.0636 | 0.298 |
| 0359 | 0.0171 | 0.237 | 1110 | 0.0596 | 0.263 | 1973 | 0.0075 | 0.148 | 2803 | 0.1414 | 0.293 |
| 0360 | 0.0816 | 0.263 | 1116 | 0.0118 | 0.23 | 1976 | 0.0367 | 0.643 | 2814 | 0.1279 | 0.298 |
| 0367 | 0.0418 | 0.666 | 1151 | 0.0542 | 0.255 | 2003 | 0.0712 | 0.714 | 2855 | 0.022 | 0.217 |
| 0383 | 0.0269 | 0.708 | 1170 | 0.0012 | 0.744 | 2007 | 0.0027 | 0.744 | 2863 | 0.0823 | 0.298 |
| 0388 | 0.0104 | 0.699 | 1209 | 0.0023 | 0.184 | 2025 | 0.028 | 0.676 | 2878 | 0.0148 | 0.191 |
| 0409 | 0.0056 | 0.73 | 1211 | 0.0298 | 0.758 | 2042 | 0.0214 | 0.704 | 2887 | 0.082 | 0.298 |
| 0415 | 0.0204 | 0.653 | 1252 | 0.0275 | 0.222 | 2057 | 0.025 | 0.245 | 2928 | 0.0927 | 0.286 |
| 0430 | 0.0039 | 0.717 | 1263 | 0.0223 | 0.672 | 2070 | 0.0208 | 0.714 | 2967 | 0.0218 | 0.296 |
| 0435 | 0.0126 | 0.214 | 1265 | 0.1112 | 0.291 | 2084 | 0.0164 | 0.23 | 2992 | 0.0096 | 0.209 |
| 0459 | 0.093 | 0.733 | 1285 | 0.0491 | 0.626 | 2095 | 0.082 | 0.288 | 3011 | 0.0128 | 0.189 |
| 0460 | 0.0418 | 0.676 | 1290 | 0.0851 | 0.288 | 2150 | 0.0561 | 0.224 | 3029 | 0.0721 | 0.268 |
| 0477 | 0.0012 | 0.156 | 1300 | 0.0452 | 0.625 | 2229 | 0.5132 | 0.707 | 3080 | 0.0223 | 0.24 |
| 0493 | 0.0178 | 0.722 | 1319 | 0.0549 | 0.273 | 2254 | 0.0465 | 0.714 | 3118 | 0.0086 | 0.194 |
| 0534 | 0.0453 | 0.656 | 1325 | 0.0718 | 0.288 | 2277 | 0.0804 | 0.276 | 3128 | 0.0276 | 0.224 |
| 0548 | 0.0389 | 0.592 | 1331 | 0.0071 | 0.712 | 2291 | 0.0315 | 0.27 | 3154 | 0.0255 | 0.288 |
| 0559 | 0.0698 | 0.273 | 1386 | 0.0312 | 0.676 | 2325 | 0.0406 | 0.651 | 3160 | 0.02 | 0.247 |
| 0566 | 0.0805 | 0.263 | 1406 | 0.0161 | 0.689 | 2369 | 0.0483 | 0.296 | 3184 | 0.1028 | 0.26 |
| 0585 | 0.0156 | 0.194 | 1421 | 0.1131 | 0.264 | 2371 | 0.3109 | 0.745 | 3186 | 0.0802 | 0.291 |
| 0598 | 0.0505 | 0.263 | 1451 | 0.0196 | 0.709 | 2387 | 0.1645 | 0.296 | 3203 | 0.0226 | 0.235 |
| 0608 | 0.0648 | 0.714 | 1458 | 0.0329 | 0.635 | 2436 | 0.0619 | 0.247 | 3235 | 0.0114 | 0.232 |
| 0611 | 0.031 | 0.656 | 1460 | 0.1292 | 0.298 | 2446 | 0.0364 | 0.663 | | | |

For this classification, the variable selection was performed by using a Random Forest model. A combination of 20 pre-selected lncRNA through a Random Forest Classifier (Table 26) is the best predictive model obtained here. The lncRNAs were selected using a random forest algorithm. The model was produced with Naives Bayes algorithm. This model has an area under the receiver-operating characteristic curve (AUC) of 0.834, an accuracy of 0.895, a sensitivity of 0.918, a specificity of 0.75, a Positive Predictive Value (PPV) of 0.957 and Negative Predictive Value (PNV) of 0.6. The confusion matrix is presented in Table 27.

TABLE 26

List of 20 pre-selected lncRNA through a Random Forest Classifier for the classification low LVEF (LVEF ≤ 40) and high LVEF (LVEF > 40)

| lncRNA | Rank in the model |
|---|---|
| SEQ ID NO: 0190 | 1 |
| SEQ ID NO: 0359 | 2 |
| SEQ ID NO: 0776 | 3 |
| SEQ ID NO: 1421 | 4 |
| SEQ ID NO: 1795 | 5 |
| SEQ ID NO: 0477 | 6 |
| SEQ ID NO: 1511 | 7 |
| SEQ ID NO: 0435 | 8 |
| SEQ ID NO: 1418 | 9 |
| SEQ ID NO: 1025 | 10 |
| SEQ ID NO: 0265 | 11 |
| SEQ ID NO: 1311 | 12 |
| SEQ ID NO: 2540 | 13 |
| SEQ ID NO: 2323 | 14 |
| SEQ ID NO: 3011 | 15 |
| SEQ ID NO: 2447 | 16 |
| SEQ ID NO: 2863 | 17 |
| SEQ ID NO: 2697 | 18 |
| SEQ ID NO: 3128 | 19 |
| SEQ ID NO: 2265 | 20 |

TABLE 27

Confusion matrix of the best model for this classification

| | Low LVEF predicted | High LVEF predicted |
|---|---|---|
| Low LVEF True | 6 | 2 |
| High LVEF True | 4 | 45 |

Comparison Between Low LVEF (LVEF≤45) and High LVEF (LVEF>45)

In this analysis, the 57 samples AMI were grouped into 2 groups using the threshold of 45% LVEF: low LVEF (LVEF≤45) and high LVEF (LVEF>45). The volcano plot showed the differential expression of lncRNA. 110 lncRNA are differentially expressed and among them 11 lncRNA have a fold change>2 or <0.5, which are in Table 28. 112 lncRNAs with P<0.05 and/or individual AUC>0.7 or <0.3 are listed in Table 29.

TABLE 28

List of 11 lncRNAs which are differentially expressed with a fold change >2 or <0.5 between the low LVEF group (LVEF ≤ 40) and the high LVEF group (LVEF > 40)

| lncRNA | P-Value | foldchange | AUC |
|---|---|---|---|
| SEQ ID NO: 1755 | 0.00017 | 0.460 | 0.740 |
| SEQ ID NO: 1331 | 0.00072 | 0.243 | 0.710 |
| SEQ ID NO: 1372 | 0.00560 | 0.437 | 0.695 |
| SEQ ID NO: 1341 | 0.01608 | 0.364 | 0.664 |
| SEQ ID NO: 0173 | 0.02953 | 0.481 | 0.654 |
| SEQ ID NO: 0611 | 0.03193 | 0.434 | 0.645 |
| SEQ ID NO: 1602 | 0.03198 | 2.164 | 0.301 |
| SEQ ID NO: 0442 | 0.04288 | 0.477 | 0.635 |
| SEQ ID NO: 0117 | 0.04364 | 0.494 | 0.607 |
| SEQ ID NO: 0074 | 0.04683 | 7.908 | 0.346 |
| SEQ ID NO: 2168 | 0.04815 | 0.452 | 0.627 |

TABLE 29

List of 112 lncRNAs which are differentially expressed and/or have an AUC > 0.7 or < 0.3 between the low LVEF group (LVEF ≤ 40) and the high LVEF group (LVEF > 40)

| LncRNA (SEQ ID. NO:) | P-Value | AUC | LncRNA (SEQ ID. NO:) | P-Value | AUC | LncRNA (SEQ ID. NO:) | P-Value | AUC | LncRNA (SEQ ID. NO:) | P-Value | AUC |
|---|---|---|---|---|---|---|---|---|---|---|---|
| 0007 | 0.028 | 0.33 | 0627 | 0.015 | 0.70 | 1458 | 0.033 | 0.67 | 2347 | 0.019 | 0.69 |
| 0036 | 0.057 | 0.72 | 0690 | 0.019 | 0.30 | 1475 | 0.012 | 0.70 | 2369 | 0.047 | 0.34 |
| 0064 | 0.031 | 0.65 | 0709 | 0.031 | 0.64 | 1483 | 0.025 | 0.30 | 2426 | 0.030 | 0.62 |
| 0074 | 0.047 | 0.35 | 0720 | 0.008 | 0.71 | 1511 | 0.007 | 0.30 | 2436 | 0.020 | 0.29 |
| 0079 | 0.004 | 0.73 | 0749 | 0.031 | 0.29 | 1518 | 0.023 | 0.31 | 2471 | 0.007 | 0.73 |
| 0117 | 0.044 | 0.61 | 0756 | 0.023 | 0.33 | 1519 | 0.017 | 0.68 | 2502 | 0.033 | 0.33 |
| 0137 | 0.012 | 0.72 | 0762 | 0.021 | 0.31 | 1533 | 0.004 | 0.73 | 2540 | 0.008 | 0.26 |
| 0163 | 0.017 | 0.30 | 0802 | 0.019 | 0.68 | 1536 | 0.026 | 0.32 | 2647 | 0.027 | 0.31 |
| 0169 | 0.024 | 0.29 | 0845 | 0.013 | 0.68 | 1539 | 0.002 | 0.73 | 2684 | 0.028 | 0.27 |
| 0173 | 0.030 | 0.65 | 0914 | 0.039 | 0.62 | 1591 | 0.043 | 0.61 | 2697 | 0.004 | 0.28 |
| 0240 | 0.017 | 0.31 | 1025 | 0.026 | 0.31 | 1596 | 0.044 | 0.63 | 2727 | 0.008 | 0.30 |
| 0265 | 0.024 | 0.73 | 1042 | 0.012 | 0.26 | 1602 | 0.032 | 0.30 | 2783 | 0.018 | 0.68 |
| 0269 | 0.016 | 0.31 | 1047 | 0.044 | 0.66 | 1739 | 0.002 | 0.70 | 2850 | 0.045 | 0.33 |
| 0359 | 0.003 | 0.29 | 1065 | 0.011 | 0.29 | 1755 | 0.000 | 0.74 | 2863 | 0.040 | 0.32 |
| 0376 | 0.013 | 0.29 | 1117 | 0.032 | 0.70 | 1762 | 0.024 | 0.69 | 3011 | 0.007 | 0.25 |
| 0440 | 0.009 | 0.65 | 1123 | 0.028 | 0.32 | 1766 | 0.037 | 0.32 | 3049 | 0.047 | 0.59 |
| 0442 | 0.043 | 0.64 | 1150 | 0.030 | 0.66 | 1795 | 0.026 | 0.34 | 3051 | 0.015 | 0.30 |
| 0446 | 0.049 | 0.32 | 1158 | 0.032 | 0.65 | 1930 | 0.010 | 0.30 | 3069 | 0.040 | 0.61 |
| 0476 | 0.016 | 0.66 | 1211 | 0.027 | 0.64 | 1973 | 0.016 | 0.29 | 3106 | 0.035 | 0.31 |
| 0477 | 0.048 | 0.31 | 1228 | 0.011 | 0.65 | 2003 | 0.025 | 0.68 | 3118 | 0.028 | 0.33 |
| 0493 | 0.020 | 0.65 | 1290 | 0.049 | 0.30 | 2084 | 0.024 | 0.30 | 3128 | 0.007 | 0.28 |

TABLE 29-continued

List of 112 lncRNAs which are differentially expressed and/or have an AUC > 0.7 or < 0.3 between the low LVEF group (LVEF ≤ 40) and the high LVEF group (LVEF > 40)

| LncRNA (SEQ ID. NO:) | P-Value | AUC | LncRNA (SEQ ID. NO:) | P-Value | AUC | LncRNA (SEQ ID. NO:) | P-Value | AUC | LncRNA (SEQ ID. NO:) | P-Value | AUC |
|---|---|---|---|---|---|---|---|---|---|---|---|
| 0534 | 0.040 | 0.65 | 1300 | 0.024 | 0.62 | 2113 | 0.021 | 0.32 | 3137 | 0.042 | 0.62 |
| 0535 | 0.010 | 0.70 | 1331 | 0.001 | 0.71 | 2149 | 0.031 | 0.33 | 3160 | 0.015 | 0.31 |
| 0545 | 0.009 | 0.27 | 1341 | 0.016 | 0.66 | 2168 | 0.048 | 0.63 | 3184 | 0.184 | 0.30 |
| 0559 | 0.017 | 0.30 | 1372 | 0.006 | 0.70 | 2186 | 0.042 | 0.63 | 3186 | 0.035 | 0.30 |
| 0564 | 0.040 | 0.63 | 1403 | 0.010 | 0.66 | 2218 | 0.021 | 0.66 | 3193 | 0.026 | 0.32 |
| 0609 | 0.046 | 0.66 | 1406 | 0.016 | 0.68 | 2254 | 0.033 | 0.67 | 3203 | 0.031 | 0.32 |
| 0611 | 0.032 | 0.65 | 1446 | 0.032 | 0.30 | 2323 | 0.050 | 0.65 | 3235 | 0.027 | 0.31 |

For this classification, the variable selection was performed by using a Random Forest model. A combination of 11 pre-selected lncRNA through a Random Forest Classifier (Table 30) is the best predictive model obtained here. The lncRNAs were selected using a random forest algorithm. This model has an area under the receiver-operating characteristic curve (AUC) of 0.905, an accuracy of 0.807, a sensitivity of 0.927, a specificity of 0.5, a Positive Predictive Value (PPV) of 0.826 and Negative Predictive Value (PNV) of 0.727. The confusion matrix is presented in Table 31.

TABLE 30

List of 11 pre-selected lncRNA through a Random Forest Classifier for the classification low LVEF (LVEF ≤ 45) and high LVEF (LVEF > 45)

| lncRNA | Rank in the model |
|---|---|
| SEQ ID NO: 2540 | 1 |
| SEQ ID NO: 0545 | 2 |
| SEQ ID NO: 1766 | 3 |
| SEQ ID NO: 3011 | 4 |
| SEQ ID NO: 0968 | 5 |
| SEQ ID NO: 2371 | 6 |
| SEQ ID NO: 1533 | 7 |
| SEQ ID NO: 0749 | 8 |
| SEQ ID NO: 0609 | 9 |
| SEQ ID NO: 1446 | 10 |
| SEQ ID NO: 2986 | 11 |

TABLE 31

Confusion matrix of the best model for this classification

| | Low LVEF predicted | High LVEF predicted |
|---|---|---|
| Low LVEF True | 8 | 8 |
| High LVEF True | 3 | 38 |

Example 6: Analysis Control Subject Versus AMI Patients at DO Total Seq on Cardiac Enriched lncRNAs Quantification of lncRNAs in body fluids including but not limited to whole blood, serum, plasma, urine, saliva is a non-invasive way to develop a diagnostic test to use in clinics. The expression of circulating lncRNA is studied in serum samples from patients with AMI and control subjects. Serum samples collected at DO of patient with AMI from the MitoCare cohort and control subject of chronobiological study are used for lncRNA profiling. Mitocare demographics are presented in Table 3. Technical workflow is identical as described in Example 3.

Results:

Comparison Between Control Subject Versus AMI Patients at DO

First, samples are grouped into 2 group by a dichotomized variable: patients with cardiac disorder (AMI) and subjects with no cardiac disease. We found that 1736 lncRNAs are differentially expressed (p<0.05). Most of the lncRNAs are overexpressed in patient undergoing an AMI. We show here that the lncRNAs identified in heart biopsie are biomarkers for diagnosis of heart diseases. By selecting lncRNAs with p<0.01; a fold change>2 or <0.5 and an individual AUC>0.8 or <0.2, we identified a list of 288 lncRNAs that can diagnose AMI or heart diseases (Table 32).

TABLE 32 list of 288 lncRNAs differentially expressed, with a fold change > 2 or < 0.5 and an individual AUC > 0.8 or < 0.2.

| LncRNA (SEQ ID NO:) | P-Value | Fold change | auc | LncRNA (SEQ ID NO:) | P-Value | Fold change | auc | LncRNA (SEQ ID NO:) | P-Value | Fold change | auc |
|---|---|---|---|---|---|---|---|---|---|---|---|
| 0014 | 0.00009 | 0.49 | 0.19 | 0955 | 0.00023 | 0.37 | 0.16 | 1735 | 0.00000 | 0.19 | 0.04 |
| 0020 | 0.00002 | 0.35 | 0.13 | 0970 | 0.00001 | 0.46 | 0.14 | 1739 | 0.00001 | 0.33 | 0.10 |
| 0027 | 0.00005 | 0.31 | 0.16 | 0983 | 0.00000 | 0.46 | 0.11 | 1747 | 0.00001 | 0.37 | 0.15 |
| 0042 | 0.00000 | 0.50 | 0.11 | 0984 | 0.00000 | 0.12 | 0.09 | 1753 | 0.00001 | 0.43 | 0.12 |
| 0051 | 0.00315 | 10.58 | 0.85 | 0986 | 0.00017 | 0.50 | 0.20 | 1761 | 0.00057 | 0.48 | 0.19 |
| 0055 | 0.00001 | 0.42 | 0.13 | 0989 | 0.00027 | 0.32 | 0.19 | 1764 | 0.00112 | 0.32 | 0.19 |
| 0085 | 0.00001 | 0.29 | 0.13 | 0990 | 0.00000 | 0.11 | 0.11 | 1774 | 0.00028 | 0.32 | 0.19 |
| 0097 | 0.00012 | 0.49 | 0.17 | 0995 | 0.00007 | 0.31 | 0.17 | 1777 | 0.00000 | 0.43 | 0.12 |
| 0107 | 0.00009 | 0.26 | 0.16 | 1001 | 0.00004 | 0.44 | 0.17 | 1810 | 0.00010 | 0.50 | 0.17 |
| 0130 | 0.00012 | 0.24 | 0.16 | 1008 | 0.00000 | 0.47 | 0.11 | 1837 | 0.00009 | 0.34 | 0.14 |

TABLE 32-continued list of 288 lncRNAs differentially expressed, with a fold change > 2
or < 0.5 and an individual AUC > 0.8 or < 0.2.

| LncRNA (SEQ ID NO:) | P-Value | Fold change | auc | LncRNA (SEQ ID NO:) | P-Value | Fold change | auc | LncRNA (SEQ ID NO:) | P-Value | Fold change | auc |
|---|---|---|---|---|---|---|---|---|---|---|---|
| 0138 | 0.00007 | 0.47 | 0.17 | 1028 | 0.00010 | 0.31 | 0.19 | 1859 | 0.00000 | 0.43 | 0.13 |
| 0151 | 0.00000 | 0.26 | 0.09 | 1047 | 0.00005 | 0.43 | 0.19 | 1874 | 0.00030 | 0.43 | 0.20 |
| 0155 | 0.00007 | 0.32 | 0.15 | 1051 | 0.00002 | 0.49 | 0.16 | 1888 | 0.00000 | 0.34 | 0.09 |
| 0176 | 0.00025 | 0.44 | 0.17 | 1055 | 0.00000 | 0.46 | 0.03 | 1891 | 0.00006 | 0.44 | 0.18 |
| 0190 | 0.00000 | 0.34 | 0.05 | 1066 | 0.00000 | 0.48 | 0.09 | 1893 | 0.00005 | 0.06 | 0.13 |
| 0199 | 0.00030 | 0.46 | 0.19 | 1072 | 0.00000 | 0.29 | 0.07 | 1900 | 0.00041 | 0.40 | 0.20 |
| 0206 | 0.00003 | 0.40 | 0.16 | 1086 | 0.00000 | 0.31 | 0.08 | 1927 | 0.00000 | 0.48 | 0.09 |
| 0210 | 0.00001 | 0.48 | 0.12 | 1088 | 0.00001 | 0.20 | 0.15 | 1947 | 0.00000 | 0.33 | 0.12 |
| 0215 | 0.00003 | 0.27 | 0.16 | 1106 | 0.00004 | 0.40 | 0.14 | 1963 | 0.00000 | 0.40 | 0.09 |
| 0226 | 0.00000 | 0.46 | 0.02 | 1113 | 0.00000 | 0.34 | 0.13 | 1975 | 0.00024 | 0.26 | 0.18 |
| 0227 | 0.00001 | 0.46 | 0.15 | 1115 | 0.00022 | 0.43 | 0.19 | 1985 | 0.00468 | 0.46 | 0.20 |
| 0236 | 0.00009 | 0.44 | 0.17 | 1116 | 0.00000 | 0.49 | 0.03 | 1991 | 0.00000 | 0.33 | 0.10 |
| 0251 | 0.00010 | 0.26 | 0.20 | 1131 | 0.00000 | 0.25 | 0.05 | 1992 | 0.00000 | 0.47 | 0.11 |
| 0263 | 0.00032 | 0.42 | 0.20 | 1135 | 0.00024 | 0.40 | 0.19 | 1994 | 0.00000 | 0.43 | 0.06 |
| 0268 | 0.00001 | 0.43 | 0.14 | 1138 | 0.00000 | 0.25 | 0.10 | 1998 | 0.00000 | 0.48 | 0.05 |
| 0281 | 0.00003 | 0.44 | 0.14 | 1142 | 0.00037 | 7.14 | 0.97 | 1999 | 0.00002 | 0.41 | 0.13 |
| 0293 | 0.00000 | 0.12 | 0.16 | 1146 | 0.00008 | 0.38 | 0.17 | 2020 | 0.00001 | 0.39 | 0.13 |
| 0325 | 0.00100 | 0.20 | 0.18 | 1180 | 0.00005 | 0.18 | 0.17 | 2043 | 0.00001 | 0.11 | 0.10 |
| 0330 | 0.00008 | 0.27 | 0.16 | 1184 | 0.00000 | 0.36 | 0.07 | 2059 | 0.00005 | 0.38 | 0.16 |
| 0350 | 0.00000 | 0.38 | 0.10 | 1211 | 0.00000 | 0.47 | 0.02 | 2065 | 0.00000 | 0.43 | 0.02 |
| 0365 | 0.00001 | 0.47 | 0.14 | 1220 | 0.00000 | 0.41 | 0.12 | 2070 | 0.00000 | 0.32 | 0.12 |
| 0368 | 0.00022 | 0.32 | 0.20 | 1239 | 0.00001 | 0.43 | 0.14 | 2071 | 0.00001 | 0.37 | 0.13 |
| 0372 | 0.00009 | 0.35 | 0.18 | 1253 | 0.00030 | 0.28 | 0.17 | 2077 | 0.00005 | 0.10 | 0.07 |
| 0374 | 0.00032 | 0.23 | 0.17 | 1276 | 0.00164 | 0.40 | 0.19 | 2082 | 0.00000 | 0.42 | 0.12 |
| 0383 | 0.00054 | 0.49 | 0.19 | 1291 | 0.00000 | 0.38 | 0.08 | 2085 | 0.00002 | 0.28 | 0.14 |
| 0387 | 0.00006 | 0.41 | 0.18 | 1297 | 0.00000 | 0.43 | 0.02 | 2093 | 0.00000 | 0.26 | 0.10 |
| 0396 | 0.00019 | 0.34 | 0.17 | 1301 | 0.00011 | 0.25 | 0.16 | 2108 | 0.00000 | 0.21 | 0.07 |
| 0402 | 0.00021 | 0.36 | 0.20 | 1306 | 0.00015 | 0.15 | 0.17 | 2127 | 0.00322 | 0.36 | 0.16 |
| 0439 | 0.00029 | 0.45 | 0.19 | 1307 | 0.00005 | 0.30 | 0.16 | 2129 | 0.00000 | 0.47 | 0.13 |
| 0465 | 0.00000 | 0.31 | 0.05 | 1314 | 0.00001 | 0.46 | 0.14 | 2133 | 0.00061 | 0.45 | 0.19 |
| 0486 | 0.00041 | 0.46 | 0.19 | 1320 | 0.00004 | 0.18 | 0.12 | 2148 | 0.00000 | 2.04 | 0.89 |
| 0494 | 0.00003 | 0.42 | 0.16 | 1336 | 0.00006 | 0.48 | 0.17 | 2156 | 0.00010 | 0.18 | 0.16 |
| 0499 | 0.00000 | 0.38 | 0.13 | 1350 | 0.00008 | 0.48 | 0.19 | 2161 | 0.00000 | 2.05 | 0.93 |
| 0507 | 0.00001 | 0.17 | 0.13 | 1357 | 0.00008 | 0.29 | 0.13 | 2163 | 0.00000 | 0.19 | 0.05 |
| 0511 | 0.00016 | 0.44 | 0.17 | 1367 | 0.00010 | 0.34 | 0.16 | 2173 | 0.00000 | 0.46 | 0.04 |
| 0523 | 0.00000 | 0.21 | 0.01 | 1372 | 0.00063 | 0.46 | 0.19 | 2184 | 0.00006 | 0.32 | 0.14 |
| 0538 | 0.00059 | 0.29 | 0.20 | 1374 | 0.00000 | 0.48 | 0.02 | 2192 | 0.00000 | 0.47 | 0.11 |
| 0559 | 0.00016 | 0.47 | 0.19 | 1393 | 0.00000 | 0.37 | 0.12 | 2196 | 0.00005 | 0.44 | 0.16 |
| 0560 | 0.00027 | 0.34 | 0.19 | 1404 | 0.00001 | 0.42 | 0.14 | 2198 | 0.00010 | 0.49 | 0.18 |
| 0564 | 0.00000 | 0.28 | 0.08 | 1415 | 0.00000 | 0.23 | 0.06 | 2207 | 0.00004 | 0.24 | 0.13 |
| 0572 | 0.00000 | 0.21 | 0.09 | 1424 | 0.00024 | 0.31 | 0.17 | 2245 | 0.00002 | 0.38 | 0.16 |
| 0589 | 0.00018 | 0.48 | 0.19 | 1434 | 0.00005 | 0.26 | 0.17 | 2250 | 0.00000 | 0.49 | 0.05 |
| 0594 | 0.00000 | 20.93 | 1.00 | 1469 | 0.00000 | 0.45 | 0.03 | 2260 | 0.00024 | 2.31 | 0.82 |
| 0597 | 0.00009 | 0.17 | 0.09 | 1477 | 0.00000 | 2.06 | 0.90 | 2280 | 0.00012 | 0.12 | 0.12 |
| 0599 | 0.00001 | 0.40 | 0.12 | 1484 | 0.00000 | 0.42 | 0.04 | 2295 | 0.00000 | 0.41 | 0.13 |
| 0639 | 0.00005 | 2.02 | 0.85 | 1492 | 0.00007 | 0.26 | 0.18 | 2310 | 0.00002 | 0.21 | 0.16 |
| 0647 | 0.00000 | 0.43 | 0.10 | 1499 | 0.00000 | 0.37 | 0.09 | 2343 | 0.00017 | 0.33 | 0.20 |
| 0657 | 0.00000 | 0.49 | 0.08 | 1502 | 0.00004 | 0.22 | 0.17 | 2373 | 0.00000 | 0.47 | 0.03 |
| 0662 | 0.00024 | 0.31 | 0.17 | 1509 | 0.00000 | 0.32 | 0.12 | 2406 | 0.00014 | 2.65 | 0.81 |
| 0664 | 0.00001 | 0.42 | 0.15 | 1523 | 0.00027 | 0.31 | 0.16 | 2420 | 0.00001 | 0.40 | 0.12 |
| 0668 | 0.00015 | 0.29 | 0.18 | 1532 | 0.00005 | 0.17 | 0.16 | 2462 | 0.00000 | 0.36 | 0.08 |
| 0674 | 0.00000 | 0.47 | 0.13 | 1534 | 0.00000 | 0.48 | 0.00 | 2479 | 0.00063 | 0.49 | 0.19 |
| 0685 | 0.00009 | 0.46 | 0.17 | 1537 | 0.00009 | 0.40 | 0.15 | 2488 | 0.00000 | 0.40 | 0.09 |
| 0696 | 0.00010 | 0.29 | 0.16 | 1567 | 0.00012 | 0.47 | 0.16 | 2489 | 0.00018 | 2.10 | 0.81 |
| 0697 | 0.00000 | 0.23 | 0.12 | 1572 | 0.00003 | 0.43 | 0.15 | 2571 | 0.00001 | 0.36 | 0.14 |
| 0707 | 0.00000 | 0.43 | 0.05 | 1582 | 0.00026 | 0.13 | 0.17 | 2584 | 0.00000 | 0.45 | 0.07 |
| 0710 | 0.00003 | 0.40 | 0.17 | 1585 | 0.00026 | 2.17 | 0.83 | 2603 | 0.00000 | 0.42 | 0.02 |
| 0714 | 0.00002 | 0.37 | 0.11 | 1587 | 0.00000 | 0.40 | 0.10 | 2676 | 0.00000 | 0.49 | 0.12 |
| 0745 | 0.00044 | 0.38 | 0.19 | 1597 | 0.00009 | 0.19 | 0.16 | 2682 | 0.00000 | 0.46 | 0.05 |
| 0755 | 0.00000 | 0.19 | 0.08 | 1601 | 0.00001 | 6.65 | 0.88 | 2766 | 0.00001 | 0.19 | 0.12 |
| 0772 | 0.00006 | 2.32 | 0.82 | 1608 | 0.00046 | 0.44 | 0.20 | 2832 | 0.00064 | 0.45 | 0.19 |
| 0804 | 0.00012 | 0.35 | 0.20 | 1612 | 0.00000 | 0.08 | 0.10 | 2842 | 0.00011 | 0.40 | 0.19 |
| 0809 | 0.00075 | 0.20 | 0.19 | 1624 | 0.00000 | 0.41 | 0.05 | 2868 | 0.00001 | 0.16 | 0.07 |
| 0818 | 0.00000 | 0.46 | 0.01 | 1625 | 0.00000 | 0.21 | 0.05 | 2904 | 0.00242 | 0.20 | 0.14 |
| 0839 | 0.00000 | 0.42 | 0.04 | 1638 | 0.00001 | 2.06 | 0.85 | 2924 | 0.00000 | 2.10 | 0.87 |
| 0846 | 0.00000 | 0.41 | 0.03 | 1646 | 0.00000 | 0.42 | 0.08 | 2939 | 0.00000 | 0.49 | 0.13 |
| 0862 | 0.00024 | 0.32 | 0.19 | 1647 | 0.00000 | 0.44 | 0.05 | 2946 | 0.00000 | 0.41 | 0.04 |
| 0866 | 0.00000 | 0.25 | 0.11 | 1652 | 0.00539 | 0.21 | 0.15 | 2985 | 0.00000 | 0.47 | 0.03 |
| 0884 | 0.00004 | 0.44 | 0.17 | 1670 | 0.00036 | 0.34 | 0.20 | 2996 | 0.00047 | 0.15 | 0.17 |
| 0886 | 0.00001 | 0.32 | 0.12 | 1680 | 0.00003 | 0.26 | 0.13 | 3006 | 0.00002 | 0.43 | 0.16 |
| 0899 | 0.00000 | 0.38 | 0.10 | 1716 | 0.00000 | 0.12 | 0.10 | 3073 | 0.00037 | 0.37 | 0.19 |
| 0916 | 0.00000 | 0.41 | 0.03 | 1717 | 0.00062 | 0.05 | 0.15 | 3133 | 0.00000 | 0.39 | 0.02 |
| 0917 | 0.00003 | 0.33 | 0.15 | 1719 | 0.00038 | 0.30 | 0.20 | 3139 | 0.00000 | 0.28 | 0.07 |

TABLE 32-continued list of 288 lncRNAs differentially expressed, with a fold change > 2
or < 0.5 and an individual AUC > 0.8 or < 0.2.

| LncRNA (SEQ ID NO:) | P-Value | Fold change | auc | LncRNA (SEQ ID NO:) | P-Value | Fold change | auc | LncRNA (SEQ ID NO:) | P-Value | Fold change | auc |
|---|---|---|---|---|---|---|---|---|---|---|---|
| 0936 | 0.00005 | 0.45 | 0.17 | 1721 | 0.00001 | 0.37 | 0.15 | 3198 | 0.00000 | 0.46 | 0.08 |
| 0939 | 0.00009 | 0.29 | 0.19 | 1731 | 0.00000 | 0.06 | 0.09 | 3212 | 0.00000 | 0.49 | 0.09 |
| 0949 | 0.00000 | 0.45 | 0.05 | 1732 | 0.00002 | 0.45 | 0.14 | 3220 | 0.00033 | 0.41 | 0.19 |

Correlation Between lncRNA Expression at D0 and LVEF at 3 Days

In order to predict outcome of patient suffering from AMI at day 3 and recovery of the patients, LVEF at day 3 is considered as continuous value and spearman correlation is performed between lncRNA expression at D0 and LVEF at day 3. We found that 72 lncRNAs present a correlation factor over 0.45 or below −0.45 as represented in Table 33. These lncRNAs can be used as predictor of outcome 3 days after AMI to evaluate LVEF.

TABLE 33

72 lncRNAs with spearman correlation factor over
0.45 or below −0.45 wit LVEF at D3.

| LncRNA (SEQ ID NO:) | Correlation |
|---|---|
| 0026 | −0.475 |
| 0090 | −0.530 |
| 0097 | 0.453 |
| 0103 | −0.639 |
| 0131 | −0.512 |
| 0212 | −0.454 |
| 0242 | 0.517 |
| 0255 | −0.559 |
| 0266 | −0.649 |
| 0433 | −0.504 |
| 0489 | −0.454 |
| 0563 | 0.494 |
| 0573 | −0.537 |
| 0595 | −0.605 |
| 0602 | 0.557 |
| 0718 | 0.593 |
| 0721 | −0.472 |
| 0741 | −0.598 |
| 0777 | −0.617 |
| 0786 | −0.529 |
| 0900 | −0.469 |
| 0903 | −0.629 |
| 0947 | −0.473 |
| 1021 | −0.508 |
| 1034 | 0.453 |
| 1045 | −0.474 |
| 1051 | −0.499 |
| 1076 | −0.652 |
| 1176 | −0.512 |
| 1245 | −0.568 |
| 1295 | 0.599 |
| 1373 | 0.533 |
| 1391 | 0.500 |
| 1392 | −0.474 |
| 1482 | −0.492 |
| 1514 | −0.453 |
| 1571 | −0.476 |
| 1579 | 0.506 |
| 1637 | −0.469 |
| 1830 | −0.477 |
| 1847 | −0.465 |
| 1848 | 0.666 |
| 1932 | −0.531 |
| 1947 | −0.477 |
| 2091 | −0.553 |
| 2095 | −0.496 |
| 2244 | −0.458 |
| 2258 | −0.595 |
| 2273 | 0.502 |
| 2307 | −0.547 |
| 2312 | 0.574 |
| 2329 | 0.545 |
| 2371 | 0.493 |
| 2387 | 0.594 |
| 2390 | 0.644 |
| 2396 | −0.513 |
| 2429 | 0.529 |
| 2452 | 0.452 |
| 2517 | 0.531 |
| 2523 | −0.479 |
| 2549 | −0.520 |
| 2628 | −0.505 |
| 2674 | −0.492 |
| 2709 | −0.487 |
| 2827 | 0.501 |
| 2829 | 0.587 |
| 2858 | −0.457 |
| 2900 | 0.470 |
| 2907 | −0.481 |
| 2996 | −0.514 |
| 3054 | 0.455 |
| 3166 | 0.551 |

Among these lncRNA, 4 lncRNA (SEQ0097, SEQ1947, SEQ1051 and SEQ2996) are differentially expressed between controls and AMI, and are correlated to LVEF value at D3.

Example 7: Analysis of Gencode lncRNAs from Serum RNA-Seq Data

Quantification of lncRNAs in body fluids including but not limited to whole blood, serum, plasma, urine, saliva is a non-invasive way to develop a diagnostic test to use in clinics. The expression of circulating lncRNA is studied in serum samples from patients with AMI and control subjects.

Serum samples collected at D0 and D3-D5 of patient with AMI from the MitoCare cohort and control subject of chronobiological study are used for lncRNA profiling. Mitocare demographics are presented in Table 3. Technical workflow is identical as described in Example 3 and sequencing data are aligned against Gencode database from LNCipedia 5.0. Cardiac enriched lncRNAs (SEQ0001 to SEQ3238) are removed from the analysis. A threshold of 10 CPM in half of samples in one group is applied to consider the lncRNA as positive.

In this analysis, focus is done on circulating lncRNAs to be used as biomarkers for the prediction and monitoring of Left Ventricular Remodeling and development of heart failure.

Comparison Between Low LVEF (LVEF≤40%) and High LVEF (LVEF>40%) at D3-D5 Serum Samples First, samples are classified into 2 group by a dichotomized variable: 1-month LVEF<40% considered as LV dysfunction (Ventricular remodeling) and 1-month LVEF>40% considered as preserved LV function.

291 lncRNA are differentially expressed and among these, 82 lncRNA are differentially expressed and have a fold change>2 or <0.5 between the low LVEF (LVEF≤40%) and the high LVEF (LVEF>40%). The p-value and the fold-change of these lncRNA are listed in the Table 34. 468 lncRNAs which have a p<0.05 and/or an individual AUC>0.7 or <0.3 are listed in Table 35.

TABLE 34

List of 86 lncRNAs from Gencode database which are differentially expressed (p < 0.05) and have a fold change >2 or <0.5 between the low LVEF group (LVEF ≤ 40%) and the high LVEF group (LVEF > 40%)

| lncRNA | P value | foldchange |
|---|---|---|
| ENST00000491676.1 | 0.002 | 0.461 |
| ENST00000512458.1 | 0.002 | 0.211 |
| ENST00000485020.1 | 0.002 | 3.802 |
| ENST00000487814.1 | 0.002 | 2.091 |
| ENST00000515306.1 | 0.003 | 3.302 |
| ENST00000426551.1 | 0.004 | 0.244 |
| ENST00000412944.1 | 0.004 | 8.646 |
| ENST00000553319.1 | 0.004 | 0.493 |
| ENST00000421563.1 | 0.005 | 0.435 |
| ENST00000427732.1 | 0.006 | 5.310 |
| ENST00000506068.1 | 0.006 | 5.486 |
| ENST00000417420.1 | 0.006 | 5.855 |
| ENST00000514942.2 | 0.007 | 2.865 |
| ENST00000461943.1 | 0.009 | 2.816 |
| ENST00000507932.1 | 0.009 | 0.238 |
| ENST00000456255.1 | 0.010 | 0.295 |
| ENST00000519929.1 | 0.011 | 0.357 |
| ENST00000466034.1 | 0.013 | 6.486 |
| ENST00000399152.2 | 0.013 | 3.882 |
| ENST00000422417.1 | 0.014 | 0.262 |
| ENST00000503037.1 | 0.015 | 0.430 |
| ENST00000515811.1 | 0.015 | 3.365 |
| ENST00000502861.1 | 0.016 | 2.281 |
| ENST00000455541.1 | 0.016 | 0.382 |
| ENST00000424592.1 | 0.016 | 2.843 |
| ENST00000431911.1 | 0.017 | 0.422 |
| ENST00000452618.1 | 0.017 | 2.526 |
| ENST00000437488.1 | 0.018 | 0.333 |
| ENST00000443066.2 | 0.018 | 3.846 |
| ENST00000457169.1 | 0.018 | 10.873 |
| ENST00000447761.1 | 0.019 | 2.455 |
| ENST00000527035.1 | 0.019 | 0.313 |
| ENST00000522525.1 | 0.021 | 2.384 |

TABLE 34-continued

List of 86 lncRNAs from Gencode database which are differentially expressed (p < 0.05) and have a fold change >2 or <0.5 between the low LVEF group (LVEF ≤ 40%) and the high LVEF group (LVEF > 40%)

| lncRNA | P value | foldchange |
|---|---|---|
| ENST00000602445.1 | 0.022 | 13.038 |
| ENST00000431569.1 | 0.022 | 4.473 |
| ENST00000609450.1 | 0.022 | 0.498 |
| ENST00000501965.2 | 0.022 | 2.161 |
| ENST00000441026.1 | 0.022 | 2.312 |
| ENST00000432125.2 | 0.022 | 2.253 |
| ENST00000609549.1 | 0.023 | 0.393 |
| ENST00000514526.1 | 0.023 | 0.286 |
| ENST00000510946.1 | 0.024 | 3.217 |
| ENST00000521819.1 | 0.025 | 0.140 |
| ENST00000608774.1 | 0.025 | 0.481 |
| ENST00000601586.1 | 0.026 | 0.399 |
| ENST00000508847.1 | 0.026 | 0.229 |
| ENST00000421696.2 | 0.026 | 2.796 |
| ENST00000601913.1 | 0.028 | 3.766 |
| ENST00000494900.1 | 0.029 | 2.198 |
| ENST00000434207.1 | 0.030 | 2.133 |
| ENST00000452809.1 | 0.031 | 2.428 |
| ENST00000498413.1 | 0.032 | 0.321 |
| ENST00000507957.1 | 0.034 | 2.706 |
| ENST00000443562.1 | 0.034 | 0.355 |
| ENST00000577528.1 | 0.034 | 0.218 |
| ENST00000439964.1 | 0.035 | 0.367 |
| ENST00000515184.1 | 0.035 | 0.469 |
| ENST00000452795.2 | 0.035 | 0.392 |
| ENST00000427213.1 | 0.036 | 2.863 |
| ENST00000416506.1 | 0.037 | 0.411 |
| ENST00000432038.1 | 0.037 | 0.488 |
| ENST00000521805.1 | 0.037 | 0.403 |
| ENST00000498480.1 | 0.038 | 0.492 |
| ENST00000455988.1 | 0.038 | 3.218 |
| ENST00000606056.1 | 0.038 | 0.331 |
| ENST00000509057.1 | 0.038 | 0.457 |
| ENST00000465215.1 | 0.039 | 0.122 |
| ENST00000514368.1 | 0.040 | 0.349 |
| ENST00000585826.1 | 0.040 | 3.226 |
| ENST00000472821.1 | 0.041 | 3.001 |
| ENST00000588108.1 | 0.041 | 0.386 |
| ENST00000421640.1 | 0.041 | 2.670 |
| ENST00000437290.2 | 0.042 | 0.193 |
| ENST00000415629.2 | 0.043 | 0.118 |
| ENST00000489690.1 | 0.043 | 0.481 |
| ENST00000513219.1 | 0.043 | 0.416 |
| ENST00000419614.1 | 0.043 | 2.574 |
| ENST00000604677.1 | 0.044 | 3.502 |
| ENST00000440574.1 | 0.048 | 2.392 |
| ENST00000435643.1 | 0.048 | 0.212 |
| ENST00000587568.1 | 0.050 | 3.194 |
| ENST00000413525.1 | 0.050 | 4.403 |

TABLE 35

List of 468 lncRNA from Gencode database which are differentially expressed (p < 0.05) and/or have an AUC > 0.7 or < 0.3 between the low LVEF group (LVEF ≤ 40%) and the high LVEF group (LVEF > 40%)

| lncRNA | p Value | auc | lncRNA | p Value | auc | lncRNA | p Value | auc |
|---|---|---|---|---|---|---|---|---|
| ENST00000425754.1 | 00000 | 00850 | ENST00000504046.1 | 00027 | 00800 | ENST00000466225.2 | 00056 | 00255 |
| ENST00000609071.1 | 00000 | 00875 | ENST00000607662.1 | 00027 | 00705 | ENST00000510230.1 | 00057 | 00283 |
| ENST00000503929.1 | 00000 | 00825 | ENST00000487624.1 | 00027 | 00720 | ENST00000453039.1 | 00057 | 00780 |
| ENST00000562952.1 | 00001 | 00830 | ENST00000340444.1 | 00027 | 00270 | ENST00000500224.2 | 00057 | 00225 |
| ENST00000587099.1 | 00001 | 00860 | ENST00000430048.1 | 00027 | 00740 | ENST00000510198.1 | 00057 | 00275 |
| ENST00000424895.1 | 00001 | 00825 | ENST00000453665.1 | 00028 | 00280 | ENST00000515199.1 | 00058 | 00700 |
| ENST00000608537.1 | 00001 | 00810 | ENST00000607797.1 | 00028 | 00735 | ENST00000505626.1 | 00058 | 00725 |
| ENST00000414309.1 | 00002 | 00850 | ENST00000446139.1 | 00028 | 00745 | ENST00000522350.1 | 00058 | 00240 |
| ENST00000491676.1 | 00002 | 00160 | ENST00000589496.2 | 00028 | 00745 | ENST00000507236.1 | 00058 | 00265 |
| ENST00000412134.1 | 00002 | 00805 | ENST00000601913.1 | 00028 | 00580 | ENST00000417557.1 | 00058 | 00735 |
| ENST00000565538.1 | 00002 | 00810 | ENST00000431557.1 | 00029 | 00245 | ENST00000609881.1 | 00058 | 00295 |
| ENST00000508752.1 | 00002 | 00795 | ENST00000439050.1 | 00029 | 00750 | ENST00000458359.1 | 00059 | 00270 |

TABLE 35-continued

List of 468 lncRNA from Gencode database which are differentially expressed (p < 0.05) and/or have an AUC > 0.7 or < 0.3 between the low LVEF group (LVEF ≤ 40%) and the high LVEF group (LVEF > 40%)

| lncRNA | p Value | auc | lncRNA | p Value | auc | lncRNA | p Value | auc |
|---|---|---|---|---|---|---|---|---|
| ENST00000512458.1 | 00002 | 00123 | ENST00000494900.1 | 00029 | 00680 | ENST00000564748.1 | 00059 | 00710 |
| ENST00000485020.1 | 00002 | 00810 | ENST00000456687.3 | 00029 | 00260 | ENST00000427892.1 | 00059 | 00275 |
| ENST00000487814.1 | 00002 | 00820 | ENST00000505162.1 | 00029 | 00725 | ENST00000511634.1 | 00059 | 00285 |
| ENST00000598757.1 | 00002 | 00170 | ENST00000597366.1 | 00030 | 00715 | ENST00000606287.1 | 00061 | 00290 |
| ENST00000515306.1 | 00003 | 00790 | ENST00000566366.1 | 00030 | 00290 | ENST00000456469.1 | 00061 | 00270 |
| ENST00000443613.2 | 00003 | 00190 | ENST00000434207.1 | 00030 | 00715 | ENST00000418620.1 | 00062 | 00265 |
| ENST00000507344.1 | 00004 | 00815 | ENST00000609168.1 | 00030 | 00715 | ENST00000602484.1 | 00062 | 00735 |
| ENST00000426551.1 | 00004 | 00170 | ENST00000436488.1 | 00030 | 00250 | ENST00000473713.1 | 00063 | 00275 |
| ENST00000412944.1 | 00004 | 00720 | ENST00000506852.1 | 00031 | 00700 | ENST00000503321.1 | 00064 | 00290 |
| ENST00000513958.1 | 00004 | 00195 | ENST00000452809.1 | 00031 | 00675 | ENST00000432386.1 | 00065 | 00280 |
| ENST00000511064.1 | 00004 | 00790 | ENST00000442410.2 | 00031 | 00305 | ENST00000440358.1 | 00065 | 00275 |
| ENST00000448901.1 | 00004 | 00795 | ENST00000609354.1 | 00031 | 00725 | ENST00000440371.1 | 00066 | 00290 |
| ENST00000553319.1 | 00004 | 00150 | ENST00000429315.3 | 00032 | 00285 | ENST00000457364.2 | 00066 | 00300 |
| ENST00000421563.1 | 00005 | 00205 | ENST00000496488.1 | 00032 | 00215 | ENST00000510349.1 | 00066 | 00290 |
| ENST00000497573.1 | 00005 | 00140 | ENST00000421157.1 | 00032 | 00735 | ENST00000528692.1 | 00067 | 00295 |
| ENST00000456026.1 | 00005 | 00775 | ENST00000498413.1 | 00032 | 00245 | ENST00000606239.1 | 00067 | 00710 |
| ENST00000427732.1 | 00006 | 00745 | ENST00000511693.1 | 00033 | 00160 | ENST00000443928.2 | 00067 | 00295 |
| ENST00000506068.1 | 00006 | 00730 | ENST00000602433.1 | 00033 | 00775 | ENST00000453828.1 | 00067 | 00300 |
| ENST00000512712.2 | 00006 | 00200 | ENST00000507957.1 | 00034 | 00690 | ENST00000608123.1 | 00067 | 00295 |
| ENST00000417420.1 | 00006 | 00735 | ENST00000443562.1 | 00034 | 00245 | ENST00000602434.1 | 00067 | 00715 |
| ENST00000568686.1 | 00006 | 00245 | ENST00000577528.1 | 00034 | 00250 | ENST00000441870.1 | 00067 | 00295 |
| ENST00000543490.1 | 00006 | 00785 | ENST00000415706.1 | 00034 | 00675 | ENST00000449012.1 | 00068 | 00270 |
| ENST00000503815.1 | 00007 | 00185 | ENST00000439964.1 | 00035 | 00260 | ENST00000610235.1 | 00069 | 00285 |
| ENST00000565044.1 | 00007 | 00195 | ENST00000503593.1 | 00035 | 00675 | ENST00000427176.1 | 00070 | 00295 |
| ENST00000514942.2 | 00007 | 00735 | ENST00000498457.1 | 00035 | 00285 | ENST00000417324.1 | 00070 | 00300 |
| ENST00000607216.1 | 00007 | 00160 | ENST00000451992.2 | 00035 | 00205 | ENST00000610094.1 | 00071 | 00290 |
| ENST00000412294.1 | 00007 | 00785 | ENST00000608465.1 | 00035 | 00740 | ENST00000594608.1 | 00071 | 00300 |
| ENST00000430666.1 | 00007 | 00205 | ENST00000244820.2 | 00035 | 00720 | ENST00000607338.1 | 00071 | 00295 |
| ENST00000415330.2 | 00007 | 00200 | ENST00000413304.2 | 00035 | 00275 | ENST00000606696.1 | 00073 | 00700 |
| ENST00000429666.1 | 00008 | 00215 | ENST00000515184.1 | 00035 | 00260 | ENST00000513926.1 | 00073 | 00285 |
| ENST00000499713.2 | 00008 | 00220 | ENST00000452795.2 | 00035 | 00243 | ENST00000596887.1 | 00074 | 00705 |
| ENST00000608574.1 | 00008 | 00170 | ENST00000427213.1 | 00036 | 00750 | ENST00000433084.1 | 00074 | 00290 |
| ENST00000420365.1 | 00008 | 00220 | ENST00000424451.1 | 00036 | 00665 | ENST00000600928.1 | 00074 | 00240 |
| ENST00000421998.1 | 00008 | 00240 | ENST00000503403.1 | 00036 | 00700 | ENST00000606233.1 | 00075 | 00280 |
| ENST00000424244.1 | 00009 | 00265 | ENST00000416506.1 | 00037 | 00240 | ENST00000439795.1 | 00076 | 00280 |
| ENST00000552220.1 | 00009 | 00795 | ENST00000432038.1 | 00037 | 00255 | ENST00000310916.3 | 00076 | 00710 |
| ENST00000428156.1 | 00009 | 00770 | ENST00000521805.1 | 00037 | 00255 | ENST00000457079.1 | 00077 | 00295 |
| ENST00000429725.1 | 00009 | 00780 | ENST00000425914.2 | 00037 | 00285 | ENST00000443093.2 | 00078 | 00255 |
| ENST00000461943.1 | 00009 | 00715 | ENST00000604716.1 | 00037 | 00260 | ENST00000443237.1 | 00078 | 00300 |
| ENST00000508572.1 | 00009 | 00225 | ENST00000507565.1 | 00037 | 00720 | ENST00000424628.1 | 00079 | 00290 |
| ENST00000507932.1 | 00009 | 00205 | ENST00000367716.3 | 00037 | 00255 | ENST00000587162.1 | 00079 | 00300 |
| ENST00000418602.1 | 00010 | 00250 | ENST00000514239.1 | 00037 | 00270 | ENST00000609900.1 | 00080 | 00705 |
| ENST00000505680.1 | 00010 | 00755 | ENST00000498480.1 | 00038 | 00270 | ENST00000608069.1 | 00081 | 00775 |
| ENST00000419578.1 | 00010 | 00785 | ENST00000512435.1 | 00038 | 00270 | ENST00000600062.1 | 00081 | 00700 |
| ENST00000475939.1 | 00010 | 00195 | ENST00000455988.1 | 00038 | 00660 | ENST00000566840.1 | 00081 | 00295 |
| ENST00000456255.1 | 00010 | 00193 | ENST00000606056.1 | 00038 | 00220 | ENST00000507776.1 | 00082 | 00250 |
| ENST00000610058.1 | 00011 | 00775 | ENST00000509057.1 | 00038 | 00240 | ENST00000453732.1 | 00083 | 00290 |
| ENST00000607786.1 | 00011 | 00735 | ENST00000608511.1 | 00038 | 00240 | ENST00000452553.1 | 00083 | 00295 |
| ENST00000439898.1 | 00011 | 00255 | ENST00000452212.1 | 00039 | 00315 | ENST00000504250.1 | 00084 | 00285 |
| ENST00000519929.1 | 00011 | 00185 | ENST00000510302.1 | 00039 | 00780 | ENST00000417926.1 | 00084 | 00710 |
| ENST00000447181.1 | 00011 | 00275 | ENST00000511602.1 | 00039 | 00695 | ENST00000512035.1 | 00084 | 00285 |
| ENST00000504287.1 | 00012 | 00745 | ENST00000515186.1 | 00039 | 00705 | ENST00000515286.1 | 00084 | 00270 |
| ENST00000435552.1 | 00012 | 00260 | ENST00000412092.2 | 00039 | 00330 | ENST00000587306.1 | 00085 | 00280 |
| ENST00000366441.2 | 00012 | 00745 | ENST00000413828.2 | 00039 | 00280 | ENST00000557729.1 | 00086 | 00245 |
| ENST00000441790.1 | 00012 | 00780 | ENST00000465215.1 | 00039 | 00375 | ENST00000610091.1 | 00086 | 00715 |
| ENST00000505018.1 | 00012 | 00755 | ENST00000606582.1 | 00040 | 00680 | ENST00000602919.1 | 00086 | 00300 |
| ENST00000496733.2 | 00012 | 00730 | ENST00000417786.1 | 00040 | 00275 | ENST00000441773.1 | 00086 | 00295 |
| ENST00000440322.1 | 00012 | 00770 | ENST00000514368.1 | 00040 | 00258 | ENST00000589150.1 | 00087 | 00300 |
| ENST00000514600.1 | 00012 | 00725 | ENST00000585826.1 | 00040 | 00680 | ENST00000589487.1 | 00087 | 00258 |
| ENST00000441272.2 | 00013 | 00265 | ENST00000441245.1 | 00041 | 00295 | ENST00000503589.1 | 00087 | 00280 |
| ENST00000466034.1 | 00013 | 00525 | ENST00000472821.1 | 00041 | 00595 | ENST00000414765.1 | 00090 | 00295 |
| ENST00000587085.1 | 00013 | 00750 | ENST00000427439.1 | 00041 | 00725 | ENST00000433186.1 | 00090 | 00278 |
| ENST00000399543.1 | 00013 | 00230 | ENST00000588108.1 | 00041 | 00210 | ENST00000427804.1 | 00091 | 00295 |
| ENST00000595732.1 | 00013 | 00220 | ENST00000441504.1 | 00041 | 00683 | ENST00000439246.1 | 00091 | 00265 |
| ENST00000399152.2 | 00013 | 00705 | ENST00000494582.1 | 00041 | 00675 | ENST00000431268.1 | 00091 | 00260 |
| ENST00000414128.1 | 00014 | 00215 | ENST00000506465.1 | 00041 | 00280 | ENST00000510637.1 | 00091 | 00745 |
| ENST00000502934.1 | 00014 | 00765 | ENST00000511385.1 | 00041 | 00320 | ENST00000446029.1 | 00092 | 00288 |
| ENST00000441053.1 | 00014 | 00255 | ENST00000421640.1 | 00041 | 00610 | ENST00000503488.2 | 00092 | 00705 |
| ENST00000422417.1 | 00014 | 00253 | ENST00000437290.2 | 00042 | 00255 | ENST00000462835.1 | 00093 | 00285 |
| ENST00000422038.1 | 00014 | 00765 | ENST00000602108.1 | 00042 | 00260 | ENST00000435557.1 | 00093 | 00290 |
| ENST00000607723.1 | 00015 | 00750 | ENST00000416349.1 | 00042 | 00705 | ENST00000515405.1 | 00093 | 00240 |
| ENST00000503037.1 | 00015 | 00195 | ENST00000445180.2 | 00042 | 00235 | ENST00000423921.1 | 00093 | 00190 |
| ENST00000515811.1 | 00015 | 00815 | ENST00000511592.1 | 00042 | 00675 | ENST00000515842.1 | 00094 | 00295 |
| ENST00000424215.1 | 00015 | 00230 | ENST00000477246.1 | 00042 | 00300 | ENST00000599448.1 | 00094 | 00235 |
| ENST00000482381.1 | 00015 | 00240 | ENST00000512155.1 | 00042 | 00310 | ENST00000605698.1 | 00095 | 00300 |

TABLE 35-continued

List of 468 lncRNA from Gencode database which are differentially expressed (p < 0.05) and/or have an
AUC > 0.7 or < 0.3 between the low LVEF group (LVEF ≤ 40%) and the high LVEF group (LVEF > 40%)

| lncRNA | p Value | auc | lncRNA | p Value | auc | lncRNA | p Value | auc |
|---|---|---|---|---|---|---|---|---|
| ENST00000410830.1 | 00015 | 00235 | ENST00000608077.1 | 00042 | 00290 | ENST00000510753.1 | 00095 | 00715 |
| ENST00000513572.1 | 00016 | 00760 | ENST00000415629.2 | 00043 | 00275 | ENST00000414634.1 | 00097 | 00293 |
| ENST00000594898.1 | 00016 | 00783 | ENST00000424474.2 | 00043 | 00280 | ENST00000517934.1 | 00098 | 00270 |
| ENST00000479610.1 | 00016 | 00255 | ENST00000605740.1 | 00043 | 00730 | ENST00000510850.1 | 00099 | 00700 |
| ENST00000502861.1 | 00016 | 00790 | ENST00000489690.1 | 00043 | 00283 | ENST00000414688.1 | 00099 | 00710 |
| ENST00000455541.1 | 00016 | 00205 | ENST00000607950.1 | 00043 | 00285 | ENST00000273083.3 | 00099 | 00290 |
| ENST00000459861.1 | 00016 | 00235 | ENST00000513219.1 | 00043 | 00265 | ENST00000552418.1 | 00099 | 00285 |
| ENST00000424592.1 | 00016 | 00720 | ENST00000419614.1 | 00043 | 00675 | ENST00000436248.3 | 00100 | 00275 |
| ENST00000424246.1 | 00017 | 00750 | ENST00000413234.1 | 00043 | 00285 | ENST00000439893.1 | 00102 | 00250 |
| ENST00000492209.1 | 00017 | 00265 | ENST00000420549.1 | 00043 | 00720 | ENST00000427354.1 | 00102 | 00235 |
| ENST00000448134.1 | 00017 | 00230 | ENST00000458698.2 | 00043 | 00290 | ENST00000517299.1 | 00103 | 00295 |
| ENST00000510853.2 | 00017 | 00240 | ENST00000482019.1 | 00043 | 00310 | ENST00000569711.1 | 00104 | 00280 |
| ENST00000431911.1 | 00017 | 00200 | ENST00000509984.1 | 00044 | 00270 | ENST00000453347.1 | 00106 | 00300 |
| ENST00000451711.1 | 00017 | 00215 | ENST00000501927.2 | 00044 | 00285 | ENST00000507373.1 | 00107 | 00295 |
| ENST00000452618.1 | 00017 | 00705 | ENST00000439024.1 | 00044 | 00658 | ENST00000453155.1 | 00108 | 00295 |
| ENST00000568928.1 | 00017 | 00765 | ENST00000511993.1 | 00044 | 00215 | ENST00000465946.1 | 00108 | 00300 |
| ENST00000563320.1 | 00018 | 00775 | ENST00000515128.1 | 00044 | 00665 | ENST00000515086.1 | 00109 | 00280 |
| ENST00000437488.1 | 00018 | 00240 | ENST00000604677.1 | 00044 | 00665 | ENST00000449086.1 | 00110 | 00745 |
| ENST00000443066.2 | 00018 | 00743 | ENST00000606180.1 | 00045 | 00250 | ENST00000540997.1 | 00111 | 00705 |
| ENST00000445791.1 | 00018 | 00745 | ENST00000579914.1 | 00045 | 00290 | ENST00000572124.1 | 00111 | 00705 |
| ENST00000457169.1 | 00018 | 00685 | ENST00000440900.1 | 00045 | 00690 | ENST00000508986.1 | 00120 | 00288 |
| ENST00000417260.1 | 00018 | 00765 | ENST00000431311.1 | 00046 | 00295 | ENST00000505028.1 | 00120 | 00295 |
| ENST00000448977.1 | 00018 | 00705 | ENST00000484076.1 | 00047 | 00665 | ENST00000426444.1 | 00122 | 00285 |
| ENST00000509745.1 | 00019 | 00230 | ENST00000451101.1 | 00047 | 00265 | ENST00000507916.2 | 00124 | 00700 |
| ENST00000420272.2 | 00019 | 00250 | ENST00000381078.1 | 00047 | 00290 | ENST00000514265.1 | 00126 | 00725 |
| ENST00000447761.1 | 00019 | 00720 | ENST00000609423.1 | 00047 | 00250 | ENST00000510632.1 | 00126 | 00295 |
| ENST00000449845.1 | 00019 | 00220 | ENST00000513955.1 | 00048 | 00730 | ENST00000597651.1 | 00127 | 00295 |
| ENST00000527035.1 | 00019 | 00215 | ENST00000450070.1 | 00048 | 00720 | ENST00000443800.1 | 00132 | 00300 |
| ENST00000484765.2 | 00020 | 00255 | ENST00000440574.1 | 00048 | 00720 | ENST00000508255.1 | 00134 | 00295 |
| ENST00000428891.1 | 00020 | 00240 | ENST00000435643.1 | 00048 | 00260 | ENST00000607847.1 | 00137 | 00705 |
| ENST00000450325.1 | 00021 | 00255 | ENST00000609657.1 | 00048 | 00720 | ENST00000430904.1 | 00140 | 00295 |
| ENST00000430542.1 | 00021 | 00785 | ENST00000512464.1 | 00048 | 00725 | ENST00000594622.1 | 00142 | 00700 |
| ENST00000522525.1 | 00021 | 00735 | ENST00000411509.1 | 00048 | 00635 | ENST00000436121.1 | 00144 | 00710 |
| ENST00000507582.1 | 00021 | 00240 | ENST00000607412.1 | 00049 | 00675 | ENST00000503757.1 | 00145 | 00280 |
| ENST00000505877.1 | 00021 | 00775 | ENST00000430520.1 | 00049 | 00260 | ENST00000507011.1 | 00146 | 00270 |
| ENST00000602445.1 | 00022 | 00525 | ENST00000512882.2 | 00049 | 00665 | ENST00000609270.1 | 00146 | 00735 |
| ENST00000431569.1 | 00022 | 00668 | ENST00000511327.1 | 00049 | 00735 | ENST00000500526.1 | 00147 | 00290 |
| ENST00000609450.1 | 00022 | 00225 | ENST00000436885.1 | 00049 | 00275 | ENST00000429230.1 | 00151 | 00300 |
| ENST00000501965.2 | 00022 | 00710 | ENST00000604215.1 | 00049 | 00685 | ENST00000601684.1 | 00155 | 00290 |
| ENST00000441026.1 | 00022 | 00725 | ENST00000443205.1 | 00049 | 00610 | ENST00000434306.1 | 00155 | 00705 |
| ENST00000431500.2 | 00022 | 00735 | ENST00000504869.1 | 00049 | 00255 | ENST00000602820.1 | 00164 | 00250 |
| ENST00000432125.2 | 00022 | 00765 | ENST00000587568.1 | 00050 | 00690 | ENST00000425449.1 | 00168 | 00730 |
| ENST00000505668.1 | 00023 | 00720 | ENST00000608154.1 | 00050 | 00320 | ENST00000433377.1 | 00169 | 00295 |
| ENST00000609549.1 | 00023 | 00250 | ENST00000510570.1 | 00050 | 00698 | ENST00000424528.2 | 00172 | 00710 |
| ENST00000505736.1 | 00023 | 00755 | ENST00000451289.1 | 00050 | 00720 | ENST00000597871.1 | 00176 | 00300 |
| ENST00000523648.1 | 00023 | 00255 | ENST00000458155.1 | 00050 | 00710 | ENST00000593876.1 | 00177 | 00760 |
| ENST00000458254.1 | 00023 | 00215 | ENST00000606186.1 | 00050 | 00295 | ENST00000412674.1 | 00184 | 00280 |
| ENST00000508719.1 | 00023 | 00750 | ENST00000413525.1 | 00050 | 00650 | ENST00000432658.1 | 00195 | 00718 |
| ENST00000514526.1 | 00023 | 00175 | ENST00000438158.1 | 00050 | 00295 | ENST00000588796.1 | 00207 | 00290 |
| ENST00000601486.1 | 00023 | 00225 | ENST00000483840.1 | 00050 | 00760 | ENST00000430540.1 | 00212 | 00300 |
| ENST00000461864.1 | 00023 | 00755 | ENST00000604448.1 | 00051 | 00725 | ENST00000565748.1 | 00215 | 00715 |
| ENST00000502100.2 | 00023 | 00210 | ENST00000414086.1 | 00051 | 00250 | ENST00000415543.1 | 00215 | 00275 |
| ENST00000510946.1 | 00024 | 00655 | ENST00000457440.1 | 00052 | 00280 | ENST00000485338.1 | 00216 | 00293 |
| ENST00000417481.1 | 00024 | 00255 | ENST00000503998.1 | 00052 | 00720 | ENST00000436706.1 | 00232 | 00300 |
| ENST00000504436.1 | 00024 | 00250 | ENST00000603884.1 | 00052 | 00735 | ENST00000431691.1 | 00235 | 00715 |
| ENST00000508352.1 | 00024 | 00235 | ENST00000444649.1 | 00052 | 00280 | ENST00000522762.1 | 00241 | 00290 |
| ENST00000509416.1 | 00024 | 00780 | ENST00000504249.1 | 00052 | 00280 | ENST00000506086.2 | 00254 | 00300 |
| ENST00000521819.1 | 00025 | 00245 | ENST00000433876.2 | 00053 | 00270 | ENST00000596220.1 | 00258 | 00278 |
| ENST00000455929.1 | 00025 | 00810 | ENST00000607946.1 | 00053 | 00265 | ENST00000468859.1 | 00262 | 00700 |
| ENST00000507361.1 | 00025 | 00250 | ENST00000508696.1 | 00053 | 00708 | ENST00000511241.1 | 00268 | 00290 |
| ENST00000460796.1 | 00025 | 00265 | ENST00000503009.1 | 00054 | 00275 | ENST00000457387.1 | 00276 | 00285 |
| ENST00000608774.1 | 00025 | 00243 | ENST00000488287.1 | 00054 | 00705 | ENST00000451707.1 | 00307 | 00715 |
| ENST00000449783.1 | 00025 | 00735 | ENST00000504989.1 | 00055 | 00295 | ENST00000524210.1 | 00317 | 00720 |
| ENST00000444037.1 | 00026 | 00250 | ENST00000431999.1 | 00055 | 00250 | ENST00000458182.1 | 00323 | 00280 |
| ENST00000601586.1 | 00026 | 00248 | ENST00000513871.1 | 00055 | 00265 | ENST00000447880.1 | 00324 | 00300 |
| ENST00000508847.1 | 00026 | 00255 | ENST00000450709.1 | 00055 | 00255 | ENST00000508000.1 | 00380 | 00720 |
| ENST00000421696.1 | 00026 | 00660 | ENST00000416395.1 | 00055 | 00275 | ENST00000432558.1 | 00463 | 00265 |
| ENST00000601500.1 | 00026 | 00710 | ENST00000568817.1 | 00056 | 00700 | ENST00000465347.1 | 00474 | 00300 |
| ENST00000432981.1 | 00027 | 00200 | ENST00000437267.2 | 00056 | 00245 | ENST00000514802.1 | 00571 | 00295 |

First, samples are grouped into 2 group by a dichotomized variable: 1-month LVEF<45% and 1-month LVEF>45%.

277 lncRNA are differentially expressed and among these, 70 lncRNA are differentially expressed and have a fold change>2 or <0.5 between the low LVEF (LVEF≤45%) and the high LVEF (LVEF>45%) groups. The p-value and the fold-change of these lncRNA are listed in the Table 36. 369 lncRNAs which have a p<0.05 and/or an individual AUC>0.7 or <0.3 are listed in Table 37.

TABLE 36

List of 70 lncRNA from Gencode database which are differentially expressed (p < 0.05) and have a fold change >2 or <0.5 between the low LVEF group (LVEF ≤ 45%) and the high LVEF group (LVEF > 45%)

| lncRNA | p Value | Fold change |
|---|---|---|
| ENST00000437488.1 | 0.000 | 0.072 |
| ENST00000507236.1 | 0.001 | 0.477 |
| ENST00000505848.1 | 0.001 | 0.315 |
| ENST00000509416.1 | 0.002 | 2.150 |
| ENST00000451894.2 | 0.003 | 2.266 |
| ENST00000477805.1 | 0.003 | 0.236 |
| ENST00000562054.1 | 0.004 | 0.456 |
| ENST00000502757.1 | 0.004 | 2.498 |
| ENST00000609549.1 | 0.005 | 0.289 |
| ENST00000519929.1 | 0.006 | 0.354 |
| ENST00000515286.1 | 0.006 | 0.244 |
| ENST00000427825.1 | 0.006 | 0.479 |
| ENST00000457815.1 | 0.007 | 2.063 |
| ENST00000512458.1 | 0.007 | 0.254 |
| ENST00000514724.2 | 0.007 | 0.148 |
| ENST00000513219.1 | 0.008 | 0.271 |
| ENST00000456255.1 | 0.010 | 0.286 |
| ENST00000503037.1 | 0.011 | 0.450 |
| ENST00000427732.1 | 0.011 | 4.147 |
| ENST00000506292.2 | 0.011 | 0.321 |
| ENST00000357876.5 | 0.012 | 0.209 |
| ENST00000588108.1 | 0.013 | 0.260 |
| ENST00000514877.1 | 0.013 | 0.427 |
| ENST00000426551.1 | 0.013 | 0.283 |
| ENST00000440516.1 | 0.013 | 2.510 |
| ENST00000422996.1 | 0.015 | 0.494 |
| ENST00000587306.1 | 0.016 | 0.482 |
| ENST00000439878.1 | 0.017 | 0.484 |
| ENST00000506068.1 | 0.018 | 3.665 |
| ENST00000431650.1 | 0.018 | 0.366 |

TABLE 36-continued

List of 70 lncRNA from Gencode database which are differentially expressed (p < 0.05) and have a fold change >2 or <0.5 between the low LVEF group (LVEF ≤ 45%) and the high LVEF group (LVEF > 45%)

| lncRNA | p Value | Fold change |
|---|---|---|
| ENST00000421498.1 | 0.021 | 3.747 |
| ENST00000507011.1 | 0.022 | 0.282 |
| ENST00000507932.1 | 0.022 | 0.289 |
| ENST00000515405.1 | 0.024 | 0.256 |
| ENST00000432978.1 | 0.024 | 0.453 |
| ENST00000452809.1 | 0.024 | 2.386 |
| ENST00000509999.1 | 0.025 | 2.321 |
| ENST00000515184.1 | 0.026 | 0.456 |
| ENST00000517934.1 | 0.027 | 0.288 |
| ENST00000590186.1 | 0.028 | 0.248 |
| ENST00000510632.1 | 0.028 | 0.389 |
| ENST00000429352.1 | 0.028 | 0.497 |
| ENST00000514368.1 | 0.029 | 0.335 |
| ENST00000451607.1 | 0.029 | 0.252 |
| ENST00000435580.1 | 0.030 | 0.343 |
| ENST00000429230.1 | 0.030 | 0.213 |
| ENST00000426716.1 | 0.031 | 3.178 |
| ENST00000510261.1 | 0.031 | 4.086 |
| ENST00000599448.1 | 0.032 | 0.324 |
| ENST00000436121.1 | 0.033 | 2.086 |
| ENST00000600693.1 | 0.036 | 0.359 |
| ENST00000521819.1 | 0.036 | 0.195 |
| ENST00000508968.1 | 0.036 | 0.314 |
| ENST00000598349.1 | 0.037 | 2.579 |
| ENST00000453568.1 | 0.037 | 0.410 |
| ENST00000443800.1 | 0.037 | 0.396 |
| ENST00000435023.1 | 0.037 | 0.487 |
| ENST00000431569.1 | 0.038 | 3.721 |
| ENST00000439893.1 | 0.038 | 0.390 |
| ENST00000508847.1 | 0.038 | 0.256 |
| ENST00000587568.1 | 0.040 | 3.573 |
| ENST00000418620.1 | 0.041 | 0.248 |
| ENST00000509497.1 | 0.041 | 0.337 |
| ENST00000527035.1 | 0.042 | 0.369 |
| ENST00000498480.1 | 0.042 | 0.447 |
| ENST00000415629.2 | 0.043 | 0.145 |
| ENST00000514661.1 | 0.044 | 2.482 |
| ENST00000465215.1 | 0.046 | 0.179 |
| ENST00000416453.2 | 0.048 | 2.769 |
| ENST00000505339.1 | 0.048 | 3.529 |

TABLE 37

List of 369 lncRNA from Gencode database which are differentially expressed (p < 0.05) and/or have an AUC > 0.7 or < 0.3 between the low LVEF group (LVEF ≤ 45%) and the high LVEF group (LVEF > 45%)

| lncRNA | p Value | auc | lncRNA | p Value | auc | lncRNA | p Value | auc |
|---|---|---|---|---|---|---|---|---|
| ENST00000437488.1 | 0.000 | 0.147 | ENST00000450746.1 | 0.023 | 0.707 | ENST00000607541.1 | 0.045 | 0.293 |
| ENST00000441790.1 | 0.000 | 0.862 | ENST00000456687.3 | 0.023 | 0.267 | ENST00000432386.1 | 0.045 | 0.298 |
| ENST00000587085.1 | 0.000 | 0.849 | ENST00000609354.1 | 0.024 | 0.716 | ENST00000508799.1 | 0.045 | 0.284 |
| ENST00000451711.1 | 0.001 | 0.156 | ENST00000515405.1 | 0.024 | 0.249 | ENST00000605698.1 | 0.045 | 0.311 |
| ENST00000507236.1 | 0.001 | 0.164 | ENST00000432978.1 | 0.024 | 0.258 | ENST00000399543.1 | 0.045 | 0.262 |
| ENST00000513955.1 | 0.001 | 0.849 | ENST00000452809.1 | 0.024 | 0.698 | ENST00000513540.1 | 0.045 | 0.733 |
| ENST00000505848.1 | 0.001 | 0.173 | ENST00000417795.1 | 0.025 | 0.284 | ENST00000427819.1 | 0.046 | 0.716 |
| ENST00000598757.1 | 0.001 | 0.191 | ENST00000509999.1 | 0.025 | 0.713 | ENST00000509548.2 | 0.046 | 0.676 |
| ENST00000417926.1 | 0.001 | 0.867 | ENST00000553319.1 | 0.025 | 0.276 | ENST00000424689.1 | 0.046 | 0.298 |
| ENST00000441053.1 | 0.001 | 0.209 | ENST00000441272.2 | 0.025 | 0.271 | ENST00000465215.1 | 0.046 | 0.458 |
| ENST00000444037.1 | 0.002 | 0.187 | ENST00000445180.2 | 0.026 | 0.284 | ENST00000512637.1 | 0.046 | 0.311 |
| ENST00000509416.1 | 0.002 | 0.844 | ENST00000452840.1 | 0.026 | 0.724 | ENST00000436207.2 | 0.046 | 0.771 |
| ENST00000435552.1 | 0.002 | 0.191 | ENST00000515153.1 | 0.026 | 0.244 | ENST00000508696.1 | 0.046 | 0.711 |
| ENST00000416930.2 | 0.002 | 0.213 | ENST00000606696.1 | 0.026 | 0.733 | ENST00000609881.1 | 0.046 | 0.298 |
| ENST00000438158.1 | 0.003 | 0.200 | ENST00000515184.1 | 0.026 | 0.280 | ENST00000515243.1 | 0.046 | 0.276 |
| ENST00000565044.1 | 0.003 | 0.196 | ENST00000596887.1 | 0.027 | 0.769 | ENST00000438414.1 | 0.047 | 0.338 |
| ENST00000451894.2 | 0.003 | 0.796 | ENST00000450944.1 | 0.027 | 0.271 | ENST00000458007.2 | 0.047 | 0.271 |
| ENST00000477805.1 | 0.003 | 0.222 | ENST00000510935.1 | 0.027 | 0.284 | ENST00000424748.1 | 0.047 | 0.293 |
| ENST00000450713.1 | 0.003 | 0.800 | ENST00000565538.1 | 0.027 | 0.800 | ENST00000508959.1 | 0.047 | 0.302 |
| ENST00000562054.1 | 0.004 | 0.191 | ENST00000517934.1 | 0.027 | 0.284 | ENST00000596329.1 | 0.047 | 0.364 |

TABLE 37-continued

List of 369 lncRNA from Gencode database which are differentially expressed (p < 0.05) and/or have an
AUC > 0.7 or < 0.3 between the low LVEF group (LVEF ≤ 45%) and the high LVEF group (LVEF > 45%)

| lncRNA | p Value | auc | lncRNA | p Value | auc | lncRNA | p Value | auc |
|---|---|---|---|---|---|---|---|---|
| ENST00000412228.1 | 0.004 | 0.227 | ENST00000569860.1 | 0.027 | 0.742 | ENST00000446521.1 | 0.048 | 0.284 |
| ENST00000417324.1 | 0.004 | 0.209 | ENST00000415628.1 | 0.027 | 0.293 | ENST00000512965.1 | 0.048 | 0.704 |
| ENST00000513767.3 | 0.004 | 0.178 | ENST00000607831.1 | 0.027 | 0.258 | ENST00000416453.2 | 0.048 | 0.658 |
| ENST00000502757.1 | 0.004 | 0.804 | ENST00000594798.1 | 0.027 | 0.271 | ENST00000505339.1 | 0.048 | 0.578 |
| ENST00000608574.1 | 0.004 | 0.200 | ENST00000497573.1 | 0.028 | 0.253 | ENST00000417563.1 | 0.049 | 0.713 |
| ENST00000456026.1 | 0.005 | 0.756 | ENST00000416689.1 | 0.028 | 0.249 | ENST00000440322.1 | 0.049 | 0.716 |
| ENST00000609549.1 | 0.005 | 0.276 | ENST00000507424.1 | 0.028 | 0.293 | ENST00000596632.1 | 0.049 | 0.298 |
| ENST00000608077.1 | 0.005 | 0.253 | ENST00000566527.1 | 0.028 | 0.720 | ENST00000451289.1 | 0.049 | 0.716 |
| ENST00000589496.2 | 0.005 | 0.782 | ENST00000590186.1 | 0.028 | 0.236 | ENST00000437267.2 | 0.049 | 0.276 |
| ENST00000568384.1 | 0.005 | 0.213 | ENST00000510632.1 | 0.028 | 0.298 | ENST00000520443.1 | 0.049 | 0.671 |
| ENST00000440371.1 | 0.005 | 0.236 | ENST00000429352.1 | 0.028 | 0.280 | ENST00000523648.1 | 0.049 | 0.316 |
| ENST00000366187.2 | 0.005 | 0.791 | ENST00000510175.1 | 0.029 | 0.738 | ENST00000449140.2 | 0.049 | 0.284 |
| ENST00000607068.1 | 0.006 | 0.213 | ENST00000514368.1 | 0.029 | 0.304 | ENST00000594351.1 | 0.051 | 0.293 |
| ENST00000519929.1 | 0.006 | 0.213 | ENST00000451607.1 | 0.029 | 0.244 | ENST00000506660.1 | 0.051 | 0.293 |
| ENST00000504246.1 | 0.006 | 0.209 | ENST00000448786.1 | 0.030 | 0.700 | ENST00000608881.1 | 0.051 | 0.711 |
| ENST00000515286.1 | 0.006 | 0.218 | ENST00000435580.1 | 0.030 | 0.320 | ENST00000463978.1 | 0.051 | 0.720 |
| ENST00000427825.1 | 0.006 | 0.236 | ENST00000429230.1 | 0.030 | 0.236 | ENST00000507782.1 | 0.051 | 0.293 |
| ENST00000412294.1 | 0.006 | 0.778 | ENST00000508752.1 | 0.030 | 0.707 | ENST00000436475.2 | 0.051 | 0.720 |
| ENST00000512882.2 | 0.007 | 0.791 | ENST00000426716.1 | 0.031 | 0.713 | ENST00000512464.1 | 0.052 | 0.720 |
| ENST00000424246.1 | 0.007 | 0.769 | ENST00000423600.1 | 0.031 | 0.271 | ENST00000599387.1 | 0.052 | 0.702 |
| ENST00000457815.1 | 0.007 | 0.769 | ENST00000417976.1 | 0.031 | 0.707 | ENST00000441587.2 | 0.052 | 0.716 |
| ENST00000512458.1 | 0.007 | 0.251 | ENST00000510261.1 | 0.031 | 0.711 | ENST00000504765.1 | 0.052 | 0.716 |
| ENST00000510795.1 | 0.007 | 0.791 | ENST00000442864.1 | 0.031 | 0.698 | ENST00000430542.1 | 0.053 | 0.720 |
| ENST00000422038.1 | 0.007 | 0.756 | ENST00000442956.1 | 0.031 | 0.276 | ENST00000549744.1 | 0.053 | 0.284 |
| ENST00000428156.1 | 0.007 | 0.813 | ENST00000458698.2 | 0.031 | 0.284 | ENST00000441459.1 | 0.053 | 0.298 |
| ENST00000514724.2 | 0.007 | 0.267 | ENST00000506305.1 | 0.032 | 0.280 | ENST00000453988.1 | 0.055 | 0.249 |
| ENST00000418602.1 | 0.008 | 0.244 | ENST00000599448.1 | 0.032 | 0.258 | ENST00000414634.1 | 0.056 | 0.278 |
| ENST00000506892.1 | 0.008 | 0.258 | ENST00000505347.1 | 0.032 | 0.293 | ENST00000515842.1 | 0.056 | 0.289 |
| ENST00000513219.1 | 0.008 | 0.240 | ENST00000436121.1 | 0.033 | 0.760 | ENST00000456897.1 | 0.057 | 0.284 |
| ENST00000420365.1 | 0.008 | 0.249 | ENST00000606217.1 | 0.033 | 0.284 | ENST00000449673.1 | 0.057 | 0.276 |
| ENST00000602528.1 | 0.009 | 0.778 | ENST00000608360.1 | 0.033 | 0.298 | ENST00000511091.1 | 0.057 | 0.702 |
| ENST00000430666.1 | 0.009 | 0.218 | ENST00000439024.1 | 0.033 | 0.667 | ENST00000449783.1 | 0.057 | 0.733 |
| ENST00000508486.2 | 0.009 | 0.773 | ENST00000414030.1 | 0.033 | 0.276 | ENST00000414938.1 | 0.058 | 0.253 |
| ENST00000607216.1 | 0.010 | 0.227 | ENST00000437798.1 | 0.034 | 0.329 | ENST00000515811.1 | 0.058 | 0.716 |
| ENST00000456255.1 | 0.010 | 0.233 | ENST00000449845.1 | 0.034 | 0.284 | ENST00000589853.1 | 0.060 | 0.711 |
| ENST00000424895.1 | 0.011 | 0.747 | ENST00000566840.1 | 0.034 | 0.262 | ENST00000476125.1 | 0.061 | 0.707 |
| ENST00000565428.1 | 0.011 | 0.258 | ENST00000460574.1 | 0.034 | 0.280 | ENST00000451992.2 | 0.062 | 0.262 |
| ENST00000503037.1 | 0.011 | 0.240 | ENST00000438553.1 | 0.034 | 0.729 | ENST00000562191.1 | 0.062 | 0.724 |
| ENST00000503929.1 | 0.011 | 0.773 | ENST00000605571.1 | 0.034 | 0.267 | ENST00000505572.1 | 0.062 | 0.716 |
| ENST00000427732.1 | 0.011 | 0.769 | ENST00000439186.1 | 0.034 | 0.727 | ENST00000434572.1 | 0.062 | 0.262 |
| ENST00000427804.1 | 0.011 | 0.209 | ENST00000412369.1 | 0.034 | 0.298 | ENST00000454348.1 | 0.064 | 0.271 |
| ENST00000506292.2 | 0.011 | 0.244 | ENST00000412483.1 | 0.035 | 0.262 | ENST00000482609.1 | 0.064 | 0.262 |
| ENST00000452738.1 | 0.011 | 0.738 | ENST00000607830.1 | 0.035 | 0.284 | ENST00000511241.1 | 0.064 | 0.213 |
| ENST00000420549.1 | 0.012 | 0.804 | ENST00000505348.1 | 0.035 | 0.729 | ENST00000504263.1 | 0.070 | 0.716 |
| ENST00000445523.1 | 0.012 | 0.769 | ENST00000600693.1 | 0.036 | 0.267 | ENST00000418925.1 | 0.071 | 0.298 |
| ENST00000357876.5 | 0.012 | 0.249 | ENST00000438002.1 | 0.036 | 0.293 | ENST00000417482.1 | 0.071 | 0.271 |
| ENST00000513572.1 | 0.012 | 0.751 | ENST00000431435.1 | 0.036 | 0.716 | ENST00000514265.1 | 0.072 | 0.742 |
| ENST00000443613.2 | 0.012 | 0.240 | ENST00000521819.1 | 0.036 | 0.331 | ENST00000467438.1 | 0.072 | 0.244 |
| ENST00000600062.1 | 0.012 | 0.764 | ENST00000569502.1 | 0.036 | 0.293 | ENST00000608069.1 | 0.073 | 0.711 |
| ENST00000479610.1 | 0.012 | 0.267 | ENST00000508968.1 | 0.036 | 0.287 | ENST00000587696.1 | 0.076 | 0.293 |
| ENST00000588108.1 | 0.013 | 0.200 | ENST00000413304.2 | 0.037 | 0.320 | ENST00000609583.1 | 0.076 | 0.300 |
| ENST00000446139.1 | 0.013 | 0.791 | ENST00000562952.1 | 0.037 | 0.724 | ENST00000446411.1 | 0.076 | 0.738 |
| ENST00000510381.2 | 0.013 | 0.773 | ENST00000598349.1 | 0.037 | 0.649 | ENST00000443093.2 | 0.077 | 0.253 |
| ENST00000514877.1 | 0.013 | 0.233 | ENST00000453568.1 | 0.037 | 0.280 | ENST00000431759.1 | 0.077 | 0.289 |
| ENST00000426551.1 | 0.013 | 0.284 | ENST00000482019.1 | 0.037 | 0.324 | ENST00000418387.1 | 0.078 | 0.733 |
| ENST00000507361.1 | 0.013 | 0.244 | ENST00000418244.1 | 0.037 | 0.269 | ENST00000419609.1 | 0.079 | 0.716 |
| ENST00000504046.1 | 0.013 | 0.769 | ENST00000443800.1 | 0.037 | 0.271 | ENST00000466225.2 | 0.079 | 0.280 |
| ENST00000462431.1 | 0.013 | 0.787 | ENST00000435023.1 | 0.037 | 0.307 | ENST00000513926.1 | 0.081 | 0.298 |
| ENST00000491676.1 | 0.013 | 0.244 | ENST00000440545.1 | 0.037 | 0.724 | ENST00000437631.1 | 0.082 | 0.760 |
| ENST00000440516.1 | 0.013 | 0.764 | ENST00000452509.1 | 0.037 | 0.724 | ENST00000430520.1 | 0.082 | 0.296 |
| ENST00000609900.1 | 0.014 | 0.800 | ENST00000431569.1 | 0.038 | 0.611 | ENST00000506852.1 | 0.084 | 0.751 |
| ENST00000589150.1 | 0.014 | 0.258 | ENST00000439893.1 | 0.038 | 0.187 | ENST00000510753.1 | 0.085 | 0.707 |
| ENST00000596829.1 | 0.014 | 0.227 | ENST00000508847.1 | 0.038 | 0.311 | ENST00000447389.1 | 0.089 | 0.716 |
| ENST00000601955.1 | 0.014 | 0.271 | ENST00000453128.1 | 0.039 | 0.267 | ENST00000436262.1 | 0.091 | 0.271 |
| ENST00000608482.1 | 0.015 | 0.244 | ENST00000458254.1 | 0.039 | 0.267 | ENST00000496242.1 | 0.091 | 0.280 |
| ENST00000457489.1 | 0.015 | 0.747 | ENST00000594189.1 | 0.039 | 0.253 | ENST00000453324.1 | 0.092 | 0.280 |
| ENST00000422996.1 | 0.015 | 0.249 | ENST00000502934.1 | 0.040 | 0.711 | ENST00000602108.1 | 0.096 | 0.267 |
| ENST00000495228.1 | 0.015 | 0.253 | ENST00000587568.1 | 0.040 | 0.720 | ENST00000505538.1 | 0.099 | 0.298 |
| ENST00000477539.2 | 0.016 | 0.756 | ENST00000431985.1 | 0.040 | 0.302 | ENST00000606056.1 | 0.101 | 0.280 |
| ENST00000503616.1 | 0.016 | 0.262 | ENST00000507344.1 | 0.040 | 0.738 | ENST00000508719.1 | 0.102 | 0.702 |
| ENST00000587306.1 | 0.016 | 0.244 | ENST00000471990.2 | 0.041 | 0.702 | ENST00000512370.1 | 0.107 | 0.271 |
| ENST00000608123.1 | 0.016 | 0.267 | ENST00000597543.1 | 0.041 | 0.702 | ENST00000427421.1 | 0.107 | 0.293 |
| ENST00000439878.1 | 0.017 | 0.238 | ENST00000418620.1 | 0.041 | 0.302 | ENST00000609097.1 | 0.108 | 0.711 |
| ENST00000607002.1 | 0.017 | 0.249 | ENST00000443205.1 | 0.041 | 0.684 | ENST00000602433.1 | 0.116 | 0.720 |
| ENST00000466291.1 | 0.017 | 0.747 | ENST00000483840.1 | 0.041 | 0.716 | ENST00000512090.1 | 0.117 | 0.298 |

TABLE 37-continued

List of 369 lncRNA from Gencode database which are differentially expressed (p < 0.05) and/or have an
AUC > 0.7 or < 0.3 between the low LVEF group (LVEF ≤ 45%) and the high LVEF group (LVEF > 45%)

| lncRNA | p Value | auc | lncRNA | p Value | auc | lncRNA | p Value | auc |
|---|---|---|---|---|---|---|---|---|
| ENST00000424244.1 | 0.018 | 0.253 | ENST00000509497.1 | 0.041 | 0.302 | ENST00000588944.1 | 0.118 | 0.702 |
| ENST00000455929.1 | 0.018 | 0.796 | ENST00000412134.1 | 0.042 | 0.742 | ENST00000426519.1 | 0.119 | 0.716 |
| ENST00000512417.1 | 0.018 | 0.284 | ENST00000511517.1 | 0.042 | 0.311 | ENST00000506454.1 | 0.121 | 0.720 |
| ENST00000506068.1 | 0.018 | 0.769 | ENST00000503267.1 | 0.042 | 0.311 | ENST00000515337.1 | 0.126 | 0.271 |
| ENST00000431650.1 | 0.018 | 0.276 | ENST00000607662.1 | 0.042 | 0.724 | ENST00000505371.2 | 0.127 | 0.296 |
| ENST00000607723.1 | 0.018 | 0.773 | ENST00000507517.1 | 0.042 | 0.307 | ENST00000503685.1 | 0.131 | 0.289 |
| ENST00000417765.1 | 0.019 | 0.742 | ENST00000527035.1 | 0.042 | 0.282 | ENST00000503163.1 | 0.132 | 0.271 |
| ENST00000607540.1 | 0.019 | 0.747 | ENST00000498480.1 | 0.042 | 0.276 | ENST00000504829.1 | 0.136 | 0.707 |
| ENST00000502467.1 | 0.019 | 0.693 | ENST00000507251.1 | 0.042 | 0.711 | ENST00000431856.1 | 0.136 | 0.716 |
| ENST00000589024.1 | 0.019 | 0.738 | ENST00000417651.1 | 0.042 | 0.280 | ENST00000607164.1 | 0.138 | 0.738 |
| ENST00000433219.1 | 0.019 | 0.276 | ENST00000415629.2 | 0.043 | 0.333 | ENST00000503113.1 | 0.141 | 0.293 |
| ENST00000426881.2 | 0.019 | 0.258 | ENST00000417805.1 | 0.043 | 0.711 | ENST00000503320.1 | 0.150 | 0.298 |
| ENST00000443928.2 | 0.019 | 0.244 | ENST00000606069.1 | 0.043 | 0.298 | ENST00000356684.3 | 0.156 | 0.702 |
| ENST00000567904.1 | 0.020 | 0.258 | ENST00000431362.1 | 0.043 | 0.253 | ENST00000565748.1 | 0.156 | 0.702 |
| ENST00000439479.1 | 0.020 | 0.276 | ENST00000610091.1 | 0.043 | 0.729 | ENST00000423921.1 | 0.158 | 0.276 |
| ENST00000473001.1 | 0.020 | 0.276 | ENST00000515422.1 | 0.044 | 0.698 | ENST00000462835.1 | 0.158 | 0.289 |
| ENST00000429666.1 | 0.020 | 0.247 | ENST00000514661.1 | 0.044 | 0.644 | ENST00000512185.1 | 0.158 | 0.298 |
| ENST00000421498.1 | 0.021 | 0.676 | ENST00000608605.1 | 0.044 | 0.311 | ENST00000513591.1 | 0.162 | 0.298 |
| ENST00000455038.1 | 0.021 | 0.280 | ENST00000414625.2 | 0.044 | 0.316 | ENST00000366278.2 | 0.165 | 0.711 |
| ENST00000433175.2 | 0.022 | 0.267 | ENST00000514600.1 | 0.044 | 0.787 | ENST00000505018.1 | 0.166 | 0.760 |
| ENST00000451101.1 | 0.022 | 0.267 | ENST00000416209.2 | 0.044 | 0.293 | ENST00000453370.1 | 0.166 | 0.716 |
| ENST00000608777.1 | 0.022 | 0.267 | ENST00000597366.1 | 0.044 | 0.707 | ENST00000502100.2 | 0.178 | 0.289 |
| ENST00000602919.1 | 0.022 | 0.253 | ENST00000417695.1 | 0.044 | 0.293 | ENST00000416221.1 | 0.190 | 0.720 |
| ENST00000507011.1 | 0.022 | 0.242 | ENST00000448901.1 | 0.044 | 0.760 | ENST00000596220.1 | 0.195 | 0.267 |
| ENST00000360083.3 | 0.022 | 0.760 | ENST00000424612.1 | 0.045 | 0.311 | ENST00000593876.1 | 0.291 | 0.742 |
| ENST00000420272.2 | 0.022 | 0.280 | ENST00000606287.1 | 0.045 | 0.289 | ENST00000602972.1 | 0.335 | 0.284 |
| ENST00000507932.1 | 0.022 | 0.298 | ENST00000607594.1 | 0.045 | 0.689 | ENST00000456146.1 | 0.346 | 0.718 |
| ENST00000417644.1 | 0.023 | 0.258 | ENST00000367716.3 | 0.045 | 0.293 | ENST00000607769.1 | 0.539 | 0.293 |

First, samples are grouped into 2 groups by a dichotomized variable: 1-month LVEF<40% and 1-month LVEF>40%.

273 lncRNA are differentially expressed and among these, 83 lncRNA are differentially expressed and have a fold change>2 or <0.5 between the low LVEF (LVEF≤40%) and the high LVEF (LVEF>40%). 3 lncRNAs are common to D3 samples (ENST00000421563.1, ENST00000443562.1, ENST00000455988.1). The p-value and the fold-change of these lncRNA are listed in the Table 38. In Table 39, 235 lncRNAs which have a p<0.05 and an individual AUC>0.7 or <0.3 are listed in Table 39.

TABLE 38

List of 83 lncRNA from Gencode database which are
differentially expressed (p < 0.05) and
have a fold change >2 or <0.5 between the low
LVEF group (LVEF ≤ 40%) and the
high LVEF group (LVEF > 40%)

| lncRNA | p Value | fold change |
|---|---|---|
| ENST00000510165.1 | 0.000 | 0.454 |
| ENST00000449154.1 | 0.001 | 3.668 |
| ENST00000523354.1 | 0.001 | 2.383 |
| ENST00000598798.1 | 0.001 | 3.678 |
| ENST00000421563.1 | 0.001 | 2.688 |
| ENST00000513851.1 | 0.002 | 2.445 |
| ENST00000515842.1 | 0.002 | 0.453 |
| ENST00000508845.1 | 0.004 | 2.084 |
| ENST00000506338.1 | 0.004 | 3.476 |
| ENST00000453015.1 | 0.006 | 0.491 |
| ENST00000505997.1 | 0.006 | 12.552 |
| ENST00000507435.1 | 0.007 | 4.142 |
| ENST00000504368.1 | 0.007 | 2.362 |
| ENST00000420672.1 | 0.008 | 7.02E+28 |
| ENST00000504165.1 | 0.008 | 2.796 |
| ENST00000412311.1 | 0.009 | 6.569 |
| ENST00000454183.1 | 0.009 | 4.501 |
| ENST00000422253.1 | 0.010 | 3.571 |

TABLE 38-continued

List of 83 lncRNA from Gencode database which are
differentially expressed (p < 0.05) and
have a fold change >2 or <0.5 between the low
LVEF group (LVEF ≤ 40%) and the
high LVEF group (LVEF > 40%)

| lncRNA | p Value | fold change |
|---|---|---|
| ENST00000490497.1 | 0.011 | 6.17E+13 |
| ENST00000402410.2 | 0.011 | 9.911 |
| ENST00000513660.2 | 0.012 | 3.751 |
| ENST00000511222.1 | 0.012 | 2.305 |
| ENST00000439239.2 | 0.013 | 2.069 |
| ENST00000549878.1 | 0.013 | 2.466 |
| ENST00000444217.1 | 0.013 | 2.075 |
| ENST00000435548.1 | 0.014 | 5.647 |
| ENST00000607026.1 | 0.014 | 0.480 |
| ENST00000515111.1 | 0.048 | 2.667 |
| ENST00000503093.1 | 0.014 | 4.916 |
| ENST00000443670.1 | 0.014 | 2.095 |
| ENST00000429608.1 | 0.015 | 2.188 |
| ENST00000518276.1 | 0.016 | 2.734 |
| ENST00000420418.1 | 0.016 | 4.067 |
| ENST00000511419.1 | 0.017 | 3.308 |
| ENST00000431130.2 | 0.017 | 2.765 |
| ENST00000412171.2 | 0.020 | 988.115 |
| ENST00000419531.2 | 0.021 | 0.003 |
| ENST00000442384.1 | 0.022 | 2.042 |
| ENST00000446102.1 | 0.022 | 0.481 |
| ENST00000414102.1 | 0.022 | 0.365 |
| ENST00000507963.1 | 0.022 | 4.620 |
| ENST00000609843.1 | 0.024 | 2.273 |
| ENST00000449124.1 | 0.025 | 3.322 |
| ENST00000425192.1 | 0.025 | 2.64E+12 |
| ENST00000514377.1 | 0.025 | 4.851 |
| ENST00000515680.2 | 0.027 | 2.330 |
| ENST00000423168.1 | 0.028 | 4.270 |
| ENST00000429230.1 | 0.028 | 3.757 |
| ENST00000604660.1 | 0.029 | 2.349 |
| ENST00000421298.1 | 0.029 | 3.474 |
| ENST00000492209.1 | 0.030 | 2.082 |

TABLE 38-continued

List of 83 lncRNA from Gencode database which are differentially expressed (p < 0.05) and have a fold change >2 or <0.5 between the low LVEF group (LVEF ≤ 40%) and the high LVEF group (LVEF > 40%)

| lncRNA | p Value | fold change |
|---|---|---|
| ENST00000523311.1 | 0.031 | 2.078 |
| ENST00000434796.1 | 0.031 | 2.290 |
| ENST00000447876.1 | 0.031 | 0.287 |
| ENST00000576302.1 | 0.032 | 3.094 |
| ENST00000457686.1 | 0.049 | 0.231 |
| ENST00000588145.1 | 0.032 | 13.047 |
| ENST00000602470.1 | 0.032 | 2.968 |
| ENST00000497379.2 | 0.033 | 0.330 |
| ENST00000506100.1 | 0.033 | 2.451 |
| ENST00000609352.1 | 0.034 | 2.228 |
| ENST00000507476.1 | 0.034 | 3.547 |
| ENST00000415202.1 | 0.035 | 6.887 |
| ENST00000599781.1 | 0.036 | 0.075 |
| ENST00000497551.2 | 0.037 | 2.235 |
| ENST00000597654.1 | 0.037 | 0.037 |
| ENST00000439606.1 | 0.038 | 7.846 |
| ENST00000455988.1 | 0.038 | 2.302 |
| ENST00000597904.1 | 0.039 | 2.634 |
| ENST00000505972.2 | 0.039 | 0.466 |
| ENST00000609140.1 | 0.040 | 68.930 |
| ENST00000443284.1 | 0.041 | 2.225 |
| ENST00000502812.2 | 0.042 | 0.359 |
| ENST00000552026.1 | 0.043 | 2.692 |
| ENST00000522300.1 | 0.043 | 0.468 |
| ENST00000440038.2 | 0.044 | 7.706 |
| ENST00000413841.1 | 0.044 | 2.153 |
| ENST00000443562.1 | 0.044 | 2.013 |
| ENST00000457941.1 | 0.045 | 17.472 |
| ENST00000605147.1 | 0.046 | 0.409 |
| ENST00000456803.1 | 0.047 | 0.465 |
| ENST00000578974.2 | 0.048 | 0.387 |
| ENST00000509212.1 | 0.048 | 0.492 |

TABLE 39

List of 235 lncRNA from Gencode database, which are differentially expressed (p < 0.05) and have an AUC > 0.7 or < 0.3 between the low LVEF group (LVEF ≤ 40%) and the high LVEF group (LVEF > 40%)

| lncRNA | p Value | auc | lncRNA | p Value | auc | lncRNA | p Value | auc |
|---|---|---|---|---|---|---|---|---|
| ENST00000510165.1 | 0.000 | 0.034 | ENST00000496154.2 | 0.017 | 0.179 | ENST00000608777.1 | 0.035 | 0.231 |
| ENST00000431244.1 | 0.001 | 0.085 | ENST00000511419.1 | 0.017 | 0.761 | ENST00000499292.2 | 0.035 | 0.162 |
| ENST00000449154.1 | 0.001 | 0.868 | ENST00000431130.2 | 0.017 | 0.765 | ENST00000415202.1 | 0.035 | 0.821 |
| ENST00000414199.1 | 0.001 | 0.880 | ENST00000487657.2 | 0.017 | 0.786 | ENST00000610144.1 | 0.035 | 0.231 |
| ENST00000523354.1 | 0.001 | 0.829 | ENST00000514241.1 | 0.017 | 0.214 | ENST00000515188.1 | 0.035 | 0.778 |
| ENST00000454595.1 | 0.001 | 0.863 | ENST00000604571.1 | 0.017 | 0.162 | ENST00000599781.1 | 0.036 | 0.111 |
| ENST00000598798.1 | 0.001 | 0.859 | ENST00000428624.1 | 0.018 | 0.162 | ENST00000497551.2 | 0.037 | 0.726 |
| ENST00000421563.1 | 0.001 | 0.872 | ENST00000592948.1 | 0.018 | 0.222 | ENST00000597654.1 | 0.037 | 0.188 |
| ENST00000417926.1 | 0.001 | 0.863 | ENST00000418335.1 | 0.018 | 0.171 | ENST00000505364.1 | 0.037 | 0.744 |
| ENST00000513851.1 | 0.002 | 0.863 | ENST00000435895.1 | 0.018 | 0.171 | ENST00000514427.1 | 0.038 | 0.265 |
| ENST00000515842.1 | 0.002 | 0.094 | ENST00000322353.3 | 0.019 | 0.744 | ENST00000604680.1 | 0.038 | 0.752 |
| ENST00000444672.1 | 0.002 | 0.880 | ENST00000512464.1 | 0.019 | 0.803 | ENST00000512546.1 | 0.038 | 0.239 |
| ENST00000420071.1 | 0.002 | 0.880 | ENST00000448713.1 | 0.019 | 0.778 | ENST00000455988.1 | 0.038 | 0.786 |
| ENST00000420350.1 | 0.002 | 0.128 | ENST00000467240.1 | 0.019 | 0.786 | ENST00000597904.1 | 0.039 | 0.752 |
| ENST00000512417.1 | 0.003 | 0.855 | ENST00000444647.1 | 0.019 | 0.239 | ENST00000505972.2 | 0.039 | 0.248 |
| ENST00000608111.1 | 0.004 | 0.846 | ENST00000425974.1 | 0.020 | 0.769 | ENST00000512873.1 | 0.039 | 0.761 |
| ENST00000508845.1 | 0.004 | 0.829 | ENST00000452176.1 | 0.020 | 0.778 | ENST00000607459.1 | 0.039 | 0.231 |
| ENST00000506338.1 | 0.004 | 0.803 | ENST00000510416.1 | 0.020 | 0.761 | ENST00000584829.1 | 0.039 | 0.744 |
| ENST00000430897.1 | 0.004 | 0.162 | ENST00000503188.1 | 0.020 | 0.197 | ENST00000471626.1 | 0.039 | 0.718 |
| ENST00000601136.1 | 0.005 | 0.872 | ENST00000509559.1 | 0.021 | 0.188 | ENST00000514265.1 | 0.039 | 0.231 |
| ENST00000430520.1 | 0.005 | 0.137 | ENST00000508255.1 | 0.021 | 0.214 | ENST00000451362.1 | 0.039 | 0.265 |
| ENST00000522312.1 | 0.005 | 0.137 | ENST00000419531.2 | 0.021 | 0.128 | ENST00000595232.1 | 0.039 | 0.214 |
| ENST00000451396.2 | 0.005 | 0.838 | ENST00000430471.1 | 0.021 | 0.786 | ENST00000473798.1 | 0.039 | 0.769 |
| ENST00000453015.1 | 0.006 | 0.179 | ENST00000442384.1 | 0.022 | 0.761 | ENST00000427748.1 | 0.040 | 0.239 |
| ENST00000397645.2 | 0.006 | 0.838 | ENST00000446102.1 | 0.022 | 0.188 | ENST00000607389.1 | 0.040 | 0.769 |
| ENST00000449586.1 | 0.006 | 0.821 | ENST00000414102.1 | 0.022 | 0.179 | ENST00000602316.1 | 0.040 | 0.197 |
| ENST00000356684.3 | 0.006 | 0.162 | ENST00000428651.1 | 0.022 | 0.231 | ENST00000439601.1 | 0.040 | 0.205 |
| ENST00000505997.1 | 0.006 | 0.761 | ENST00000507963.1 | 0.022 | 0.726 | ENST00000462176.2 | 0.040 | 0.248 |
| ENST00000508619.1 | 0.007 | 0.829 | ENST00000473595.1 | 0.023 | 0.761 | ENST00000512519.1 | 0.040 | 0.197 |
| ENST00000507435.1 | 0.007 | 0.786 | ENST00000326734.1 | 0.023 | 0.256 | ENST00000609140.1 | 0.040 | 0.752 |
| ENST00000510254.1 | 0.007 | 0.197 | ENST00000435692.2 | 0.023 | 0.863 | ENST00000512527.1 | 0.041 | 0.239 |
| ENST00000440104.1 | 0.007 | 0.829 | ENST00000513812.1 | 0.023 | 0.726 | ENST00000514010.1 | 0.041 | 0.726 |
| ENST00000504368.1 | 0.007 | 0.786 | ENST00000609843.1 | 0.024 | 0.752 | ENST00000444043.2 | 0.041 | 0.726 |
| ENST00000438506.1 | 0.008 | 0.829 | ENST00000449124.1 | 0.025 | 0.795 | ENST00000429871.1 | 0.041 | 0.291 |
| ENST00000420672.1 | 0.008 | 0.859 | ENST00000433108.1 | 0.025 | 0.778 | ENST00000443284.1 | 0.041 | 0.795 |
| ENST00000412313.1 | 0.008 | 0.128 | ENST00000425192.1 | 0.025 | 0.726 | ENST00000461448.1 | 0.041 | 0.231 |
| ENST00000504165.1 | 0.008 | 0.803 | ENST00000514377.1 | 0.025 | 0.752 | ENST00000609969.1 | 0.041 | 0.769 |
| ENST00000511234.1 | 0.008 | 0.179 | ENST00000444346.1 | 0.025 | 0.239 | ENST00000458097.1 | 0.041 | 0.222 |
| ENST00000510879.1 | 0.009 | 0.872 | ENST00000513770.1 | 0.026 | 0.778 | ENST00000446073.1 | 0.042 | 0.769 |
| ENST00000412311.1 | 0.009 | 0.722 | ENST00000448431.1 | 0.026 | 0.214 | ENST00000431691.1 | 0.042 | 0.752 |
| ENST00000439795.1 | 0.009 | 0.222 | ENST00000440404.1 | 0.026 | 0.197 | ENST00000502812.2 | 0.042 | 0.239 |
| ENST00000434094.1 | 0.009 | 0.179 | ENST00000560688.1 | 0.026 | 0.248 | ENST00000508470.1 | 0.043 | 0.761 |
| ENST00000454183.1 | 0.009 | 0.774 | ENST00000428176.1 | 0.026 | 0.248 | ENST00000552026.1 | 0.043 | 0.735 |
| ENST00000504207.1 | 0.009 | 0.179 | ENST00000515680.2 | 0.027 | 0.765 | ENST00000458007.2 | 0.043 | 0.256 |
| ENST00000504297.1 | 0.010 | 0.846 | ENST00000446136.1 | 0.027 | 0.769 | ENST00000522300.1 | 0.043 | 0.248 |

TABLE 39-continued

List of 235 lncRNA from Gencode database, which are differentially expressed (p < 0.05) and have an AUC > 0.7 or < 0.3 between the low LVEF group (LVEF ≤ 40%) and the high LVEF group (LVEF > 40%)

| lncRNA | p Value | auc | lncRNA | p Value | auc | lncRNA | p Value | auc |
|---|---|---|---|---|---|---|---|---|
| ENST00000503568.1 | 0.010 | 0.821 | ENST00000511279.1 | 0.028 | 0.752 | ENST00000366441.2 | 0.043 | 0.795 |
| ENST00000412357.1 | 0.010 | 0.803 | ENST00000423168.1 | 0.028 | 0.838 | ENST00000429269.1 | 0.043 | 0.778 |
| ENST00000460597.1 | 0.010 | 0.821 | ENST00000429230.1 | 0.028 | 0.744 | ENST00000595268.1 | 0.044 | 0.744 |
| ENST00000422253.1 | 0.010 | 0.803 | ENST00000421437.1 | 0.029 | 0.265 | ENST00000440038.2 | 0.044 | 0.778 |
| ENST00000506655.1 | 0.011 | 0.812 | ENST00000504728.1 | 0.029 | 0.752 | ENST00000413841.1 | 0.044 | 0.752 |
| ENST00000526176.1 | 0.011 | 0.821 | ENST00000569928.1 | 0.029 | 0.239 | ENST00000489011.1 | 0.044 | 0.735 |
| ENST00000402410.2 | 0.011 | 0.761 | ENST00000421298.1 | 0.029 | 0.778 | ENST00000443562.1 | 0.044 | 0.795 |
| ENST00000455121.3 | 0.012 | 0.162 | ENST00000445565.1 | 0.030 | 0.769 | ENST00000512349.1 | 0.045 | 0.231 |
| ENST00000513660.2 | 0.012 | 0.769 | ENST00000598710.1 | 0.030 | 0.231 | ENST00000505736.1 | 0.045 | 0.231 |
| ENST00000602411.1 | 0.012 | 0.778 | ENST00000492209.1 | 0.030 | 0.786 | ENST00000442020.1 | 0.045 | 0.761 |
| ENST00000511222.1 | 0.012 | 0.752 | ENST00000492300.1 | 0.030 | 0.735 | ENST00000440862.1 | 0.045 | 0.205 |
| ENST00000607594.1 | 0.013 | 0.812 | ENST00000508484.1 | 0.030 | 0.248 | ENST00000464242.1 | 0.045 | 0.718 |
| ENST00000450500.1 | 0.013 | 0.786 | ENST00000415174.1 | 0.030 | 0.188 | ENST00000499900.2 | 0.045 | 0.231 |
| ENST00000439239.2 | 0.013 | 0.795 | ENST00000432505.1 | 0.031 | 0.761 | ENST00000457941.1 | 0.045 | 0.718 |
| ENST00000549878.1 | 0.013 | 0.761 | ENST00000523311.1 | 0.031 | 0.756 | ENST00000470263.1 | 0.045 | 0.761 |
| ENST00000418015.1 | 0.013 | 0.821 | ENST00000434796.1 | 0.031 | 0.735 | ENST00000512581.1 | 0.045 | 0.735 |
| ENST00000444217.1 | 0.013 | 0.786 | ENST00000440266.2 | 0.031 | 0.778 | ENST00000464428.2 | 0.045 | 0.752 |
| ENST00000435548.1 | 0.014 | 0.795 | ENST00000447876.1 | 0.031 | 0.239 | ENST00000523745.1 | 0.046 | 0.222 |
| ENST00000607026.1 | 0.014 | 0.188 | ENST00000506070.1 | 0.031 | 0.274 | ENST00000522173.1 | 0.046 | 0.214 |
| ENST00000503093.1 | 0.014 | 0.739 | ENST00000426083.1 | 0.032 | 0.248 | ENST00000585718.1 | 0.046 | 0.248 |
| ENST00000509184.1 | 0.014 | 0.821 | ENST00000576302.1 | 0.032 | 0.761 | ENST00000605147.1 | 0.046 | 0.188 |
| ENST00000443670.1 | 0.014 | 0.769 | ENST00000607950.1 | 0.032 | 0.778 | ENST00000509496.1 | 0.047 | 0.735 |
| ENST00000486767.1 | 0.015 | 0.786 | ENST00000588145.1 | 0.032 | 0.701 | ENST00000449298.1 | 0.047 | 0.769 |
| ENST00000457402.1 | 0.015 | 0.188 | ENST00000503259.1 | 0.032 | 0.761 | ENST00000456803.1 | 0.047 | 0.226 |
| ENST00000515789.1 | 0.015 | 0.197 | ENST00000454380.1 | 0.032 | 0.205 | ENST00000509212.1 | 0.048 | 0.256 |
| ENST00000429608.1 | 0.015 | 0.782 | ENST00000608925.1 | 0.032 | 0.239 | ENST00000442036.1 | 0.048 | 0.735 |
| ENST00000592182.1 | 0.016 | 0.786 | ENST00000608442.1 | 0.032 | 0.214 | ENST00000564300.1 | 0.048 | 0.239 |
| ENST00000422259.1 | 0.016 | 0.231 | ENST00000602470.1 | 0.032 | 0.739 | ENST00000426504.1 | 0.048 | 0.231 |
| ENST00000442200.1 | 0.016 | 0.786 | ENST00000514011.1 | 0.033 | 0.239 | ENST00000457686.1 | 0.049 | 0.205 |
| ENST00000432733.1 | 0.016 | 0.214 | ENST00000605589.1 | 0.033 | 0.735 | ENST00000515542.1 | 0.049 | 0.735 |
| ENST00000518276.1 | 0.016 | 0.744 | ENST00000497379.2 | 0.033 | 0.171 | ENST00000429469.1 | 0.050 | 0.701 |
| ENST00000420418.1 | 0.016 | 0.761 | ENST00000609352.1 | 0.034 | 0.752 | ENST00000443008.1 | 0.050 | 0.265 |
| ENST00000297163.3 | 0.016 | 0.744 | ENST00000507476.1 | 0.034 | 0.726 | ENST00000427524.1 | 0.034 | 0.778 |
| ENST00000453155.1 | 0.016 | 0.821 | | | | | | |

First, samples are grouped into 2 groups by a dichotomized variable: 1-month LVEF<45% and 1-month LVEF>45%.

243 lncRNA are differentially expressed and among these, 69 lncRNA are differentially expressed and have a fold change>2 or <0.5 between the low LVEF (LVEF≤45%) and the high LVEF (LVEF>45%). 2 lncRNAs are common to D3 samples (ENST00000429230.1, ENST00000599448.1). The p-value and the fold-change of these lncRNA are listed in the Table 40. 211 lncRNAs which have a p<0.05 and an individual AUC>0.7 or ≤0.3 are listed in Table 41.

TABLE 40

List of 76 lncRNA from Gencode database which are differentially expressed (p < 0.05) and have a fold change >2 or <0.5 between the low LVEF group (LVEF ≤ 45%) and the high LVEF group (LVEF > 45%)

| lncRNA | p Value | foldchange |
|---|---|---|
| ENST00000449154.1 | 0.000 | 3.558 |
| ENST00000523354.1 | 0.000 | 2.334 |
| ENST00000453015.1 | 0.000 | 0.356 |
| ENST00000435895.1 | 0.000 | 0.486 |
| ENST00000552026.1 | 0.001 | 3.770 |
| ENST00000415543.1 | 0.001 | 0.237 |
| ENST00000436488.1 | 0.001 | 0.431 |
| ENST00000599448.1 | 0.003 | 0.203 |
| ENST00000441345.2 | 0.005 | 0.117 |
| ENST00000430555.1 | 0.005 | 2.363 |
| ENST00000608111.1 | 0.006 | 17.287 |
| ENST00000607026.1 | 0.006 | 0.439 |
| ENST00000435643.1 | 0.006 | 0.249 |

TABLE 40-continued

List of 76 lncRNA from Gencode database which are differentially expressed (p < 0.05) and have a fold change >2 or <0.5 between the low LVEF group (LVEF ≤ 45%) and the high LVEF group (LVEF > 45%)

| lncRNA | p Value | foldchange |
|---|---|---|
| ENST00000597904.1 | 0.006 | 3.537 |
| ENST00000496733.2 | 0.007 | 0.488 |
| ENST00000607985.1 | 0.007 | 0.109 |
| ENST00000465283.1 | 0.007 | 0.082 |
| ENST00000429230.1 | 0.008 | 4.740 |
| ENST00000443562.1 | 0.008 | 2.248 |
| ENST00000461448.1 | 0.010 | 0.467 |
| ENST00000507698.1 | 0.010 | 2.574 |
| ENST00000594976.1 | 0.011 | 0.206 |
| ENST00000606468.1 | 0.011 | 2.875 |
| ENST00000431130.2 | 0.011 | 2.733 |
| ENST00000605147.1 | 0.012 | 0.351 |
| ENST00000469289.1 | 0.013 | 5.727 |
| ENST00000427042.1 | 0.013 | 2.802 |
| ENST00000413525.1 | 0.013 | 0.248 |
| ENST00000461864.1 | 0.014 | 0.440 |
| ENST00000439745.1 | 0.016 | 0.470 |
| ENST00000402410.2 | 0.017 | 6.982 |
| ENST00000507476.1 | 0.017 | 4.500 |
| ENST00000421563.1 | 0.018 | 2.113 |
| ENST00000515263.1 | 0.019 | 0.304 |
| ENST00000433475.1 | 0.019 | 9.721 |
| ENST00000436293.2 | 0.021 | 4.454 |
| ENST00000509057.1 | 0.022 | 2.111 |
| ENST00000457686.1 | 0.023 | 0.198 |
| ENST00000523895.1 | 0.024 | 0.435 |
| ENST00000419531.2 | 0.025 | 0.000 |

TABLE 40-continued

List of 76 lncRNA from Gencode database which are differentially expressed (p < 0.05) and have a fold change >2 or <0.5 between the low LVEF group (LVEF ≤ 45%) and the high LVEF group (LVEF > 45%)

| lncRNA | p Value | foldchange |
|---|---|---|
| ENST00000444361.1 | 0.025 | 0.254 |
| ENST00000601854.1 | 0.026 | 5.663 |
| ENST00000441036.1 | 0.026 | 2.509 |
| ENST00000505149.1 | 0.027 | 0.448 |
| ENST00000435492.1 | 0.030 | 0.316 |
| ENST00000512401.1 | 0.031 | 0.057 |
| ENST00000507842.1 | 0.032 | 2.843 |
| ENST00000510648.1 | 0.032 | 3.873 |
| ENST00000606314.1 | 0.033 | 3.833 |
| ENST00000474250.1 | 0.034 | 4.009 |
| ENST00000509105.1 | 0.034 | 8.823 |
| ENST00000588145.1 | 0.035 | 13.232 |
| ENST00000470860.1 | 0.035 | 0.238 |
| ENST00000485020.1 | 0.037 | 0.412 |
| ENST00000447876.1 | 0.037 | 0.323 |
| ENST00000426892.1 | 0.037 | 2.191 |
| ENST00000512603.1 | 0.039 | 0.433 |
| ENST00000602528.1 | 0.040 | 0.441 |
| ENST00000424788.1 | 0.040 | 0.169 |
| ENST00000424084.1 | 0.044 | 6.957 |
| ENST00000507639.1 | 0.044 | 3.312 |
| ENST00000426178.1 | 0.044 | 0.170 |
| ENST00000417516.1 | 0.044 | 2.784 |
| ENST00000416279.1 | 0.044 | 2.637 |
| ENST00000443270.1 | 0.044 | 3.375 |
| ENST00000469846.2 | 0.045 | 0.256 |
| ENST00000508998.1 | 0.047 | 3.937 |
| ENST00000598740.1 | 0.047 | 2.006 |
| ENST00000597654.1 | 0.047 | 0.068 |

TABLE 41

List of 211 lncRNA from Gencode database, which are differentially expressed (p < 0.05) and have an AUC > 0.7 or < 0.3 between the low LVEF group (LVEF ≤ 45%) and the high LVEF group (LVEF > 45%)

| lncRNA | p Value | auc | lncRNA | p Value | auc | lncRNA | p Value | auc |
|---|---|---|---|---|---|---|---|---|
| ENST00000449154.1 | 0.000 | 0.923 | ENST00000424748.1 | 0.016 | 0.803 | ENST00000471248.1 | 0.034 | 0.239 |
| ENST00000523354.1 | 0.000 | 0.897 | ENST00000514201.1 | 0.016 | 0.769 | ENST00000448379.1 | 0.034 | 0.735 |
| ENST00000453015.1 | 0.000 | 0.068 | ENST00000592948.1 | 0.017 | 0.214 | ENST00000543656.1 | 0.034 | 0.761 |
| ENST00000435895.1 | 0.000 | 0.068 | ENST00000450500.1 | 0.017 | 0.795 | ENST00000416080.1 | 0.034 | 0.752 |
| ENST00000552026.1 | 0.001 | 0.889 | ENST00000402410.2 | 0.017 | 0.821 | ENST00000474250.1 | 0.034 | 0.744 |
| ENST00000415543.1 | 0.001 | 0.128 | ENST00000417926.1 | 0.017 | 0.778 | ENST00000509105.1 | 0.034 | 0.744 |
| ENST00000436488.1 | 0.001 | 0.103 | ENST00000564407.1 | 0.017 | 0.222 | ENST00000608740.1 | 0.035 | 0.769 |
| ENST00000492300.1 | 0.002 | 0.872 | ENST00000507476.1 | 0.017 | 0.821 | ENST00000456327.1 | 0.035 | 0.744 |
| ENST00000506655.1 | 0.002 | 0.872 | ENST00000432711.1 | 0.018 | 0.795 | ENST00000588145.1 | 0.035 | 0.803 |
| ENST00000588227.1 | 0.002 | 0.838 | ENST00000421563.1 | 0.018 | 0.812 | ENST00000452901.1 | 0.035 | 0.786 |
| ENST00000432210.1 | 0.002 | 0.889 | ENST00000415342.1 | 0.019 | 0.222 | ENST00000499583.1 | 0.036 | 0.248 |
| ENST00000442020.1 | 0.002 | 0.872 | ENST00000430471.1 | 0.019 | 0.786 | ENST00000509559.1 | 0.036 | 0.256 |
| ENST00000414065.1 | 0.002 | 0.829 | ENST00000515263.1 | 0.019 | 0.205 | ENST00000514608.1 | 0.036 | 0.214 |
| ENST00000599448.1 | 0.003 | 0.188 | ENST00000433475.1 | 0.019 | 0.872 | ENST00000485020.1 | 0.037 | 0.291 |
| ENST00000496154.2 | 0.004 | 0.137 | ENST00000507056.1 | 0.019 | 0.248 | ENST00000447876.1 | 0.037 | 0.282 |
| ENST00000444672.1 | 0.004 | 0.872 | ENST00000428647.1 | 0.019 | 0.786 | ENST00000608851.1 | 0.037 | 0.265 |
| ENST00000440786.1 | 0.005 | 0.829 | ENST00000492307.1 | 0.020 | 0.803 | ENST00000426892.1 | 0.037 | 0.752 |
| ENST00000356133.3 | 0.005 | 0.855 | ENST00000507781.1 | 0.020 | 0.291 | ENST00000606200.1 | 0.037 | 0.752 |
| ENST00000514010.1 | 0.005 | 0.855 | ENST00000522173.1 | 0.020 | 0.205 | ENST00000425176.1 | 0.037 | 0.295 |
| ENST00000441345.2 | 0.005 | 0.111 | ENST00000521803.1 | 0.020 | 0.795 | ENST00000601136.1 | 0.037 | 0.829 |
| ENST00000603264.1 | 0.005 | 0.162 | ENST00000448129.1 | 0.021 | 0.197 | ENST00000438978.1 | 0.038 | 0.761 |
| ENST00000602433.1 | 0.005 | 0.205 | ENST00000436293.2 | 0.021 | 0.855 | ENST00000510254.1 | 0.038 | 0.214 |
| ENST00000430555.1 | 0.005 | 0.846 | ENST00000506425.1 | 0.021 | 0.214 | ENST00000423410.1 | 0.038 | 0.752 |
| ENST00000428083.1 | 0.006 | 0.838 | ENST00000422841.1 | 0.021 | 0.222 | ENST00000512603.1 | 0.039 | 0.265 |
| ENST00000608111.1 | 0.006 | 0.915 | ENST00000431244.1 | 0.022 | 0.222 | ENST00000414120.1 | 0.040 | 0.282 |
| ENST00000607026.1 | 0.006 | 0.248 | ENST00000509057.1 | 0.022 | 0.786 | ENST00000602528.1 | 0.040 | 0.265 |
| ENST00000435643.1 | 0.006 | 0.188 | ENST00000430520.1 | 0.023 | 0.222 | ENST00000414625.2 | 0.040 | 0.239 |
| ENST00000597904.1 | 0.006 | 0.880 | ENST00000457686.1 | 0.023 | 0.282 | ENST00000502410.1 | 0.040 | 0.778 |
| ENST00000496733.2 | 0.007 | 0.188 | ENST00000429315.3 | 0.023 | 0.744 | ENST00000601940.1 | 0.041 | 0.239 |
| ENST00000446520.1 | 0.007 | 0.188 | ENST00000523895.1 | 0.024 | 0.222 | ENST00000505162.1 | 0.041 | 0.744 |
| ENST00000607985.1 | 0.007 | 0.235 | ENST00000504728.1 | 0.024 | 0.752 | ENST00000492209.1 | 0.041 | 0.786 |
| ENST00000465283.1 | 0.007 | 0.261 | ENST00000607148.1 | 0.025 | 0.214 | ENST00000427748.1 | 0.042 | 0.239 |
| ENST00000421933.1 | 0.007 | 0.162 | ENST00000326734.1 | 0.025 | 0.248 | ENST00000522975.1 | 0.042 | 0.726 |
| ENST00000499346.2 | 0.007 | 0.812 | ENST00000428624.1 | 0.025 | 0.222 | ENST00000606855.1 | 0.042 | 0.744 |
| ENST00000429230.1 | 0.008 | 0.786 | ENST00000419531.2 | 0.025 | 0.214 | ENST00000508031.1 | 0.043 | 0.744 |
| ENST00000443562.1 | 0.008 | 0.846 | ENST00000564261.1 | 0.026 | 0.769 | ENST00000609032.1 | 0.043 | 0.231 |
| ENST00000435692.2 | 0.009 | 0.846 | ENST00000601854.1 | 0.026 | 0.735 | ENST00000446073.1 | 0.043 | 0.761 |
| ENST00000461448.1 | 0.010 | 0.179 | ENST00000566904.1 | 0.026 | 0.812 | ENST00000424084.1 | 0.044 | 0.778 |
| ENST00000522312.1 | 0.010 | 0.197 | ENST00000441036.1 | 0.026 | 0.812 | ENST00000507639.1 | 0.044 | 0.718 |
| ENST00000425776.1 | 0.010 | 0.872 | ENST00000442036.1 | 0.026 | 0.786 | ENST00000413531.1 | 0.044 | 0.274 |
| ENST00000512349.1 | 0.010 | 0.162 | ENST00000594101.1 | 0.026 | 0.239 | ENST00000434346.1 | 0.044 | 0.299 |
| ENST00000507698.1 | 0.010 | 0.816 | ENST00000335577.4 | 0.026 | 0.786 | ENST00000417516.1 | 0.044 | 0.803 |
| ENST00000425896.1 | 0.010 | 0.769 | ENST00000607594.1 | 0.027 | 0.778 | ENST00000416279.1 | 0.044 | 0.795 |
| ENST00000594976.1 | 0.011 | 0.299 | ENST00000510165.1 | 0.027 | 0.214 | ENST00000443270.1 | 0.044 | 0.795 |
| ENST00000606468.1 | 0.011 | 0.812 | ENST00000505149.1 | 0.027 | 0.282 | ENST00000436262.1 | 0.045 | 0.222 |
| ENST00000517595.1 | 0.011 | 0.205 | ENST00000507681.1 | 0.027 | 0.222 | ENST00000503179.1 | 0.046 | 0.231 |
| ENST00000431130.2 | 0.011 | 0.821 | ENST00000417636.1 | 0.027 | 0.795 | ENST00000510240.1 | 0.046 | 0.256 |

TABLE 41-continued

List of 211 lncRNA from Gencode database, which are differentially expressed (p < 0.05) and have an
AUC > 0.7 or < 0.3 between the low LVEF group (LVEF ≤ 45%) and the high LVEF group (LVEF > 45%)

| lncRNA | p Value | auc | lncRNA | p Value | auc | lncRNA | p Value | auc |
|---|---|---|---|---|---|---|---|---|
| ENST00000507627.1 | 0.011 | 0.812 | ENST00000605082.1 | 0.028 | 0.752 | ENST00000607744.1 | 0.046 | 0.231 |
| ENST00000515842.1 | 0.012 | 0.179 | ENST00000438623.1 | 0.028 | 0.222 | ENST00000512428.1 | 0.046 | 0.274 |
| ENST00000435880.2 | 0.012 | 0.197 | ENST00000470263.1 | 0.028 | 0.778 | ENST00000511390.1 | 0.046 | 0.774 |
| ENST00000432267.2 | 0.012 | 0.812 | ENST00000509641.2 | 0.029 | 0.752 | ENST00000456519.1 | 0.046 | 0.274 |
| ENST00000528818.1 | 0.012 | 0.205 | ENST00000607804.1 | 0.029 | 0.786 | ENST00000506950.1 | 0.047 | 0.265 |
| ENST00000512417.1 | 0.012 | 0.812 | ENST00000435492.1 | 0.030 | 0.226 | ENST00000598740.1 | 0.047 | 0.744 |
| ENST00000605147.1 | 0.012 | 0.171 | ENST00000431139.2 | 0.030 | 0.769 | ENST00000520041.1 | 0.047 | 0.752 |
| ENST00000469289.1 | 0.013 | 0.855 | ENST00000425275.1 | 0.030 | 0.214 | ENST00000417927.1 | 0.047 | 0.282 |
| ENST00000444721.1 | 0.013 | 0.812 | ENST00000428176.1 | 0.030 | 0.265 | ENST00000523311.1 | 0.047 | 0.756 |
| ENST00000507653.1 | 0.013 | 0.179 | ENST00000505109.1 | 0.031 | 0.769 | ENST00000432395.1 | 0.047 | 0.214 |
| ENST00000427042.1 | 0.013 | 0.829 | ENST00000504207.1 | 0.031 | 0.231 | ENST00000502467.1 | 0.047 | 0.248 |
| ENST00000584829.1 | 0.013 | 0.803 | ENST00000512401.1 | 0.031 | 0.226 | ENST00000609166.1 | 0.047 | 0.744 |
| ENST00000454595.1 | 0.013 | 0.821 | ENST00000517916.1 | 0.031 | 0.752 | ENST00000609005.1 | 0.047 | 0.761 |
| ENST00000413525.1 | 0.013 | 0.218 | ENST00000511213.1 | 0.031 | 0.778 | ENST00000444042.2 | 0.047 | 0.795 |
| ENST00000418050.1 | 0.014 | 0.821 | ENST00000567486.2 | 0.031 | 0.761 | ENST00000511616.1 | 0.048 | 0.282 |
| ENST00000453569.1 | 0.014 | 0.222 | ENST00000507842.1 | 0.032 | 0.769 | ENST00000426539.1 | 0.048 | 0.299 |
| ENST00000461864.1 | 0.014 | 0.162 | ENST00000510648.1 | 0.032 | 0.786 | ENST00000412204.2 | 0.048 | 0.735 |
| ENST00000608056.1 | 0.015 | 0.171 | ENST00000513851.1 | 0.032 | 0.752 | ENST00000436950.1 | 0.048 | 0.761 |
| ENST00000439745.1 | 0.016 | 0.226 | ENST00000430677.1 | 0.032 | 0.256 | ENST00000496220.1 | 0.048 | 0.726 |
| ENST00000470739.1 | 0.016 | 0.197 | ENST00000452283.1 | 0.032 | 0.726 | ENST00000569928.1 | 0.049 | 0.239 |
| ENST00000569694.1 | 0.016 | 0.162 | ENST00000606314.1 | 0.033 | 0.803 | ENST00000433108.1 | 0.049 | 0.752 |
| ENST00000314957.3 | 0.016 | 0.752 | ENST00000426702.1 | 0.033 | 0.256 | ENST00000507398.1 | 0.049 | 0.274 |
| ENST00000513304.1 | 0.016 | 0.179 | ENST00000451396.2 | 0.033 | 0.735 | ENST00000414199.1 | 0.049 | 0.769 |
| ENST00000452176.1 | 0.034 | 0.786 | | | | | | |

The lncRNAs listed can be used as biomarkers for the prediction of Left Ventricular Remodeling and as therapeutics targets to prevent development of Heart Failure.

SEQUENCE LISTING (3274 sequences)

SEQ ID NO: 1 - DNA, 557 bp, Homo sapiens
tgggctcaggcccagagtgccagctttgccctatcccatagcctggagccaccacaggaggggcactccactctcttgggctcctggagcctcagaggcagagccagccgggagtgcaggagggagaactttcctgtggacgtcctgtgttctccagacgcagagaaccctcatcaaccgagggggaggtcacttccgaatccacagatggcgtgtgagtgcatggcgagcgcctccaggacacacttactgttcccttgctctggccagacgccagccggaccctgtgtgtgcgcgccgtgctgctctttgcagctgcctgcaaggggttcctgcgaagaccagcaccttggggaagagcctgcggctgaacttgaactcgcagctacctgagtcagacctgtgctttttcacctctacggaagatgtcagagcgtttccctagcaatgttttagaagttacttctgtctggaaaaaaatggaaaaaatggcaaattatgttatgtataatttgataattttaaagaattaatgatgtaattattactcaaaccca

SEQ ID NO: 2 - DNA, 1001 bp, Homo sapiens
ctactcccttcctagcagaaccttgattaggtcgaggtttaaacagcaatgtgtcaaggcaggtggaccaggaggatcctaagggagggaacttgattgatctgggccaatcgtaacactcttgaacatcccttggtcagcaattggcttagaggtgggcatcctaaacttggcatatgagaaagacagtaggaatttgctgggcgctcttgggaaatattgcataaaacaattcatcaaaattggcctttcctttttgccttgacttgccatgtaagaagtaatgcctaatgctgcgacagacaaattgcaaccatcagggaaagccaggagactctgagagagaccaattattgagctgatgaatgaacccttcctgaagccacctacttcctcacttattggtgtgtccttactgtgtaaaccccttttaactgggtgttttgtttcttgcagccaaaaacaatccattgatacacttggtgacattaattgagaaaaaaacaatatggtctggccatggaggcatggtatccgtaacatcccccaaaggagctaaagaagaaatccacaatttaccatgagcatttctcgtctgaagattgccaagcgattcctccaggacattcctcaagatcaatttctgttcatccaccttgtcctgggagggacatcaatgggtttccatgtcctttggcttctggttgagttcactcagtggagaaccctggcaagaggcaggaaaaggggaggaagcctgaccggtttgaatttcaccttctgttcaccttggatgagagcagtaatcatcacgatcccagggaacagccaaaggaagagaaaaggcaaaagatttggacaagactcatgaagactaacagctcttggataattgagagaaggcagctgcgtgaacagttttgatgcaatcatgaaggcagggcccagtgcctgtggcatctgcctttttctggaaccaatccatatttccttgtggtttt

SEQ ID NO: 3 - DNA, 790 bp, Homo sapiens
ctcggcacgacccaggttccatgctacaggcctctacttgtccagacctgagggtcagattcagatggtgcaaatgtttaagacctgggtcttcaacgagatgaattatcagctatttcatagctgcagtgttggatatgccgagacgataaaagcaacagcaatcagaatcaacagttgaaacgacatggcagacgctgtgaatgctatgaactgctgtgctgagcagcaggattcctgtgtcctggcgcaatgcccatggggattcatgctttcagagggtcacgcctcaggaacacgtagaagggcaagcatttcatctggcagggcactgatttaatctgcacgcatgtttggctgtaaaactagctcctcccccttaccatttttgagtcgctgccggactcaaattccacagattctggaaggtgtccaggaactcgttgatttgtcaaacttatggctacacacagctggaatggagacggactccactgaggagactcatacaggacaggagggaattttaagaggataaccctgagattgaaaacatcaaaccaaacctgaagcactgagaggttgggtaaccagctctggtcactgagttggtgagggatggattcagaagaggtctccaattgtgacaccgcagaggacctgctcttggccactacactctaccagctctgcaagaagcgcttccacacttttcatctcagacccacagagccagtgtgtgcggctgaggtgctcagactggcaggtgaaatgacttcattagtgccct

SEQ ID NO: 4 - DNA, 768 bp, Homo sapiens
aaaatgcaatttgcagtggttagaaatgacaaaggatgggtggtaggatccagagaaaaaacagtgaaacccgatggaccttaaatagatctgagggcactgatttgattattttgggtgaaatcttttaagaaaatcttgtcagattcttcacagaaaatttggtaaagcctatatttcatcgccagcctagcaaaggcaagctggcaaacagggaaacaaggagaactgtgtgctcagccctccagagtggcacggattatgaggaggtgatggtccttccccgccaagatcctgagacactgtcactccggaatccaaaaagagattcagataccatgaaaggatttgagcgtttttttatgtgaatccaaagatgacatttacaaaaggtggagaagcagttccctactgagggacgtggatacaaaaagcagatgacacaacacatcccatagagttcccagggaagaatgaacccagattcttgacctgcagaggtggcgtactggctggagaaatctctggctggcgaccgtgctattctgtctgtccacctaactgtgggctcccagatcaccactgccatgggcagggggccgtggggtgggcctgcttggggtgacaggctagctgtgctcccatagcagaggtgggagaagggaatcacatctggtgagcagctatgtcgtgccaggcactgtgctgtgtattgcacacatctcaaaccttgtgacaaatgtgtaagatattttttatgtattacaa

SEQ ID NO: 5 - DNA, 4997 bp, Homo sapiens
ctgggaaactctcgggttccacaccctccgatcctatccttgctccgatggtgcccctgagccctgctcatgctgcttggagcacaatggctgtcctttgggtcagcccttctcaccaggcctgcccagggcctgcagccttctctacttgggccgtttgttgtggcatcatgacccaaccagaaacagactgctcaatcatagacttgttgtttgggattcccttttgggtcacgcactgagttcctagctagagtttcaggaatgcctccagctgtcagctccctagaggaatagagatgtctgtcacccttgagtccgggcacaccccaagccctcttcaggggtacctatccttgtctatgggcctgtattctctgaaatggctcaccccagaggtgaccattcactcacctagaatccatcagtaccctgttctcaccaaagacagagaggttagtggccagaacagaactgagcctttgagccctttggtatcttttccacaacaggctgcaagagctctcacacttttttttccttggcgtcacccctccacattgtccagatgcctgacagtcttccattcctccccgttcctttctctgcactgcttaggaaggtcaggttggtcccagcaggagggagagaagaaaacttccagtacccgtggaaccccagggtgctaatgaaagtcttcttttgggtacttgttacttacttaggtttcagtcctaaaaatgaagaggcagtttgataacctggcagctactctggtttttctcctggggcccttaacccactttgggaccatcgcctccctcctacatctgaatctcaactctgccactttctggcagtgtgactctcagaaacttcttagtctatgtgacccattatttcctcttgtcttatcattgctgttgcggagtttaaatgagatactgtgtatggtgcctggttcatggtgggtgctccatcaatgtcatttatcttccctgtcccttaccccgtccccttcctccaaacacagtggcaagaaaacaggctctgtctccactggggatcagtacatcaattcaaacaaccaggggacctcgcggtccctgccaccactcccagcccctaccatccactgcttatctgtgttctgaaaatagatcctctccaccctacccccaatccactcgagagaacatgagtcctttcccctcttggccacagccaaagttcattgttgtaatttcctggcctaattcctgacccctcctcaggtccttttgtcccatctctctcgctgagatgggtggatgggacaccttcctgatccagtatcatctgcaaagttaattaatgtgtcatcgggctgttgcctgcttcctgatccttatcatggatttaaataaaacgcagcagccccagttctgccccgtccatctctttcccttcatcttagtcatcagtccttgacctcagccttctggctagctcttagcttccagctgcagggctggtggccctgcttctgcccaggcctggtctgggggcagaggtggcatgcagggctttaatggaatgcagggctttaattctgcgagagaatcatggacatcaggcccttacctcaaggtcccacttccttcagggattctccctaaattttagccataagggactttaagatgccatttagtccaacatgctctttttcagataaggaaacagaggcctaaaggggttcgtgacttgtccaaactcacacatctaggaagggcagaggtgagaattcagatcctgacaatcagtggaaggtcccacagaaaggttaattgctttgtttatttatttaaatgtgtgtcaagggcctgccatgtgcaacacattcttctaggcaccggggttatagcagtgaacaaaaaggcctgcattgtcacagcttaccttctccagggcagaaacaggtaaaaaacaaacaagcaaatatgtgttgtgtccgattgtgatgtgtgttatggagaaaaatacagcagaggaaggagaacggctagcactgggagaaggggattacaatcacatacgagtgatctgggacggcttcacagggaggcgtctttcagcacaggcccaggaagtgacaggatggaccacgtggccatctgaggaagaactgtctgggtgcaaaagtcctcaggagagcatggtattcttggaagttcgaagagtaacatggaggcagagtggctggaaaggaagggaggtgacaataggagatgaagtcggagagatagtatgggaccaggtcacgggagcgctttaaaggaaatgaatgtgtccaaaagaagcaaaaaatgctgaaggctaatagtgagggaaaggccccacgacccctgagcagagccccgacctgtactaactggactgccaggccagccctgggctgcaggtaccatgtcctttcagccctcaacgcccccattcctctgctcggctctgtcatcccctgactgcagtctccttagtctttctttcacatctgagatgtcaaagaccaccaatgattcctaaactccagcctggccaaggagagacagaagtgcctccttcaagaaccataaccaagagccttctctcttcctgttgacacttgccttcgtgccaagttcctaatgagatgaatgactcttcctgctggccagcctaggagtgggaatctcccttggcctcatctctcagaaatcgctccagcaaagccagctccctcttttgtctgtggctagattgaccatgttctctcccttggcaaaaagctggtggatggtcaggttcttccaatatggtcacattctcacccatatcccgggccctgagcccaaaaatcacttgatccgcaataccgcttgccacatcctctctatttccctggattctggcaaatctccgtctagtaacatcatttctatggcctagcctaggcagtttcatgcctgagaaaaaaacatttcttcctccctctccccaccttttttggtcttccatttcatgcctcccaaaagttcccctcagttcttggctttcccttgcaacttggcatcatccggagcttcttcacatttcattcattcatccatgaatttagcaaaactactaagccaggtacagtgttcagcatgggggtggggtggtcacacagtccaaagatgaacaacacacagtccttgaagatcttacgctctgtcggggaagcagacacataaacagatgatttcaatacactgggactggtgtcatgataatggttcactctgataggaaggcacctaaatcagagtttgggggtaagtgggaaggatggggtggtgtagggaagcttcccggaggatctcagtcttctttcaggtcccacatcaataacaaaaccactaagctgctgaggactttctatgcgccaagtgctgtgctaaaggctggacatgtattatcccgttggactctaggtagagtagaactaacccagggtgctcaccagttagcctgtggggctgttcactctttgtccttttcctggaggagaaagagaaaatcccagtggcccacaggccccaggaaacaacagagcagcttggcatctctggagtatgcccagctggcttagtggaagttgtccaacccagatgacatgtccctgtgttacattctggttgcttctccttgctacagagcagagttttctggggtttggggagggatacggggagcctccatctttggattcttttggtacaggaacaacatccctccaggtgacctccacctaccatggctctgtagacgccagctcctcagcacaggacctgaggtggtgagctgggaggaaacccaccagacgtgctcttcttcctgaggtgcttagagtcaggttccacagtttcaagcatggccaacctccaccttcccctctctcagcccatccacctgattctcctttgctgttggttgaagagctcagacaaaagaccaaggctgtggctccagttccagcactgcctctccctgtgcattagaccctaagtgaatttcttaacttggctgagcctctattttcccatctgtacagtggggataatacccttctccacagagttgttgagaggatccactcgaatgtaaattatgaaaaagagctgtcctttccaaaaagccaaaagaagactgttggaggaggaggtgggcgatactcttctccttcgacaggtgaatatattatggggagacgtttctaggtggagctggaagcccggtctgaactcagtcactattcttattagatcaggtgagaagatcacacaggattcagatggctccgaggtgacaagctcaggaataatcccagcttcactgttagaaactgcattttctgggtcttaagacatggaaatctccatccaatgaggatgtagatcattgaacagatgtacaccctctgtactgcactgcatcaggagtcaggagacctggcttctagtcctggctttaacatgaggacaaagctctataacatctgcaaagtcacagcccttctctgggtcttgaagtccctgttagaaaatcaagtggtcccactagagaatccatacgatatcttcagccctaaagtgcagaagtcccaagactgtcactctgtgcaagacccacccccatctcacagctggggactgagccagggctcagcaatgctggcatgagactcaaatgcaaagatcctgcttcccgttgcctcaaagcaccagctctctcgctccatcctcccaagagcctccaaggcgccattggcttcctgggactctgagtctgccggcctcttttcctgactccagtttcttctggcctgagccaatggggcatgttctgtgactgcatttgcatctcggattgtgtttttaaacccattttctcccatatttgcctgaaaaatatatagaaactgatatacaatccaa

SEQ ID NO: 6 - DNA, 622 bp, Homo sapiens
catcagacctgaggacagaagggttcgggctgcaaggaatcctattgtgtgagagccatgacacagtgagtgggagttttgatcttgacctcctggagcattttcatggaaaaggcagttccaggattctttgtggcctcttccacaggagaaagtaaaggagctagaggcctctaaaaatttagttattgaagaactgaagttattcacagcaacctggcagaagagaatgtgaaatacgtgggtctcaggtaataggtaatatccctaattccacggtgatgctgagaagcagagggcgccctcagaagtagtttctcttaaggaatttgcagctggcctacaagaacaggaccacagaatcaggtcctgtaaaagggtatgtaaaagttgtattttttgcacatctgtcttgtattctgagtcacactcctctcattgattatccttcacaatagccgttgttttaacagcgttatggagataaagttgagatggcatataattcacccatttaaagtataagattcaatggcttttagtatattcacagagttgtacaagtgttaccacaatcaattaaaaaatgttttggttactgtagccttgtagtatagtttga

SEQ ID NO: 7 - DNA, 3979 bp, Homo sapiens
gagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccgggttagtgtgcctgacaacactgaagaaaaattgtgacattttccttccccagaattacttcgttttatacatttcacttctcttctgaaatcacagcaatgccagtttgcgccttttggtctgaggaacgcaggccctggccactaccaggaaaaaatcctttgcacatggcctgctatcaacaatcctctacaatgattctcagcatcacctagggagcttatgtaaaatctcaaattcctgggccctatccccagagtttcttatcaatttccttgatggagaactatcaaagcagtcaaagctatcaaaataaaaaagaattctgattgggtgcagtggctcacacctgtcattccagcactttgagaggccaaggtgggcagatcacatgaggccaggagttcaagaccagcctggccaacatggcagaaaccccatctctactaaaaataccaaaattagccgggcatggtggaacacacctgcaatcccagctactcgggaggctgaggcaagagaatcgcttgaacctgggaggcagaagttgcagtgaaacaagttggtgccaatgcattccagcctggatgatggagcgagactctgtctcaagaaaaaaaaaacaaaaacaaaaacagaactctgcctcatagcgtcttttaagttatacactggacctatcctttcctcactgacagacattttaaaaattttttggtaaggcctagttcatataaaatgtaatccaagccaaaagttaacaagaataaggggaggaaaggggactccaatagcagagaaaggtatttacctgggatatacactgcaagaaaatcaaagctataagaaacgtccatgaatagtagccataaggcatcagagtgataaaattcctgtccctaggagggaatattggagtttgccagagaaacagaatgagagagacagagaggtttattgtaggaattggctcatatgattacggaggctgagaagacccacgatctgccatctgcaagctggagaatcaggaaagctggaggtgtaattcagtcaagtccaatggccagagaagcaagtgtactgatatccaagagcaggagaaaatagatgtcccagaacaagcagagaggctgattttgtccttcctctgcctttttgtttcatatggggcactgaatggactgatgcccatccacattagtgagggtggatcttctttactcagtctaccagtagaaatgtcaatgacttccagaaacaccctcaccaacacacgtggaaataatgttttaccaggtatctgggcatcccttggttcactcaagttgacacaaaattaaccatcacagaaggagactggccttactctgaaattaggaaactaaagaagtgaccagaatggagactaggtagagacaactagttctctaccaaacatgtacagttattcgttggtatctgaaggggattggttccaggaactctcagggataccaaaatctgcaggtgctcaagtcatttatataaaatattacagtatttgcatataacctttgcacatcttccatatactttaaatcatctctacattacttataataatgaatgtgtaaatgctatgaaaatagttactacactattgtttatttgtatttttattgaattgttttggggtggggggcagctgtatctttcttagtaatagaacccctggttttagctgggcacatgactgccctcaataaagattaaagtaccccagccttccttgagattgtggccatgtgactgaactttagacagtgagatataagcagatatcttctgtggcagtgttaggaaactattaaagacagtaagaacattgccctttgccttctttttcctttcttcatttttctgcctggaatgcaaatgtgatggctaacaccctagcagccattttagattatgaagatgagagtcactccccaggaagggtggacctgaaagctggattctagatgtggaatgacaataccagccctggactacctacctgtaggctgtgtgtgtgtgtgtgtgattgacagagagagagagagatagataccacaagtaacacaaagcatcatacctgggactgggaaggttaatgtttaaacattttaaatgtggcattggtttgttgaagacagtcaagcagtaggtgctgcaggctttgttgaggctagaaagctgttggtctttattaggtgatggcaaaacaatggatcacattttcatgtgctgtgtcttgggaggcaaatgatgagaatgtaggattggggaaaatggtaaggaaaatccaaaatgttcatgttttctaaccccttcttgccaatcttaaaagaaggacaaacaggctagattaagcaagtctacagttacaattggaaggaaacacagccgtactaaggaagtactctgtctgtggcctgcagtctagtttgactaggtcctgtatttgagctttgaaagagtaaagaatacaagtgctcgtatacccctgaagtagttaccagcagtgactgcaaggaggtaatcttatgggatgaaactataactctgtattaaccatcatatatagcatatatgtgtatatgtatgtgtgtgtgtgtatatgtgtatataaatatatgtgtgtgtatatacacacatgtacacaccctacaacccagtgatttcaaaaaattaaacatttgtttagctcatgaatctgtgggttgggtgaacatttctattggtcttggctgggctcacctgtacccagtcagctgcagggtctagctcttcttatcttggctgggatctcacacatgtctaggatcagctgctttactagtctaggattgtcttggctgagacaggtggactactcagttctcctccactgccttatccttcagctggccagcccagaaatgttgccatgtttacagcataagagcaagcaagaaagaataatatgcaaccacttttccaagcctaaggtgaaagggcgggcagaacctgtggtgttaggaggcaactcataccagcccatgggtctaccgtttaattttcagaaatttggcaagctgattgttaacacagctgttgtttaatttatgtacttgtaattaaataatttacattaaaacaaagataataggtactcaaaa

SEQ ID NO: 8 - DNA, 2099 bp, Homo sapiens
ggcagcgggggcgggcgagaccacaggacggagggcgcgggggagcgcgccggaaacgcgcggctgcggcccgggagaaacccccccactcggcggcgggcctcgcggcgcgggcccgaagccacgcccccttccggccgaggcgcggaccgcgcggagctaagtggaatcccggttggcttggggcgcaggcttccaacttcgtactctggcctctggcgtctcggctcgtcggttgggtacccgaacccagctactgctgcttgaagagaagatggatggggactcctcgccgtcgctgcgccgccggccttccctgggcggacgtacacctttgcgaagcgtcagtgaggacccagggcccctccttggaatagctcttatttctcaagcgctgcagcgtgaagctcgctctgcgggtccgagaggcctgcgatctgaagactgaaaactgggaagagacgctctaccctgtgctcctcgccggcttcgataggagccgcaggtgcctgggattttctcaaactttgtcccaaacttcagctgtgggagtggaggaacaaacaggcctctcccagaattgtgaaagagatcgccctggtggatgaaacaaaaacaaatgcacttgacttccaccgcctgcctggcgtgtcacgcgggtttaatgtatgtgtcacatttaaattcaaagtattttcttctaagggcctggacacatttcttttctccctgtatcgtgaattggaaaataccttaggatattaaaagttatctaagataaccccctttcttctgtaagttaaatactaaacggcttaagacgaaattttggaatatagagatgatgatgcagactgcagtgaattatcaaatatgcatctcactgttctccacattaaacatatttttgttgcgtaaattcatgttaagacgtctataacaattacactttggtaaaattgttggatgttaacatctctgatagctcccaatagaaatctctgatgtactaaccagactggtaaaccattatcatgcactttgaaaatataataaaatattataattaaagctgccattaatgaaataggctgagcaacaataaatttacaaaggaaaataaaagtggatagccttgggagttctcacataaaatatggagatttcaaagttaaacttgattaattatgttagggtaaaaagtgaattaaagcaacaggactatttataaaataattagatttagaaagcagtcgtagaaatataagcctggagttgcctctgaattacatatttaacaaacctagaagctaaatcagtttgtcttttatcaaaactgcaactcctctaagttgaaagcacagtgacaagagaaagcattacaaattcttgagaaataatagaaattaaagctcttttcaaacctgtgaacaagtatagtaccagaagtataagattcagataggcccaagttgtagttcttgttatgagtcttacaaccctatggactttggacaaattacttctctgcgtctgtttcctcatctgtaaaatgaaaataatttctgtttcatacaggtatagtctaaatagggataattacacctacttcaaagttgtaaaatacacaattacaactagataggaggtataagttctagtgttctgtagcactgtaggatgactatagttaacaatattgtatagtttcaaatagctagaagaaggatattgcatgttcccaaaacaaagacataagtttttgagatgatagatatgctaattaccctaatcactatatgttatatgtattgcaacatcactatgtacccccataaatatgtacagttattgtgtattaaaatttttttaaactaaaattataagacattaaaaaaaggtatcacatgtaaagtacctgatacatagtggttactcaagtattagttgtcggccattgacagtccttgcctatggtcttttctgctttccctgagctaagggatcaagacttaatatatgtattcttacctttgttctaattctgactcttcaaaaactgtccttcaaatatacaattgtacatattttttcaaaaa

SEQ ID NO: 9 - DNA, 1684 bp, Homo sapiens
agaagcaggaataaaatgatcttttctatttccatgattttttatgtttctgtttaaatggttaaatacccaattaggttagatgctaattaaatgtaaaattactgggctgttccaatatgcatgttaaagttgtacttcttggttgtttgtaatttacctaactcttgagagatcatcagagcagcccagctgagtttaaagaaggcttccaactgcccaggatatgcatcagttcctgaacaaaaaaagaacaccccaggatcaacagaagctactatcaaatccttcaaacactacatgcaccacatgctcacatttgtcctatttttgctactatttatccacaaaaaagccaagcctgaactccttcttgaggccaaaacttaaaaatataccaaatgaatcagttcaaaattttacaaatttggtttggcttaatcataactgattcttcatactattgacaccgttgattcttcacactatagataccactcactaaaattacaactcagtcacctcttcccatataccatatttcattaaaatcaatgtaagataagaaatggttaccagatgccatcgtttcagaccaaaccatatgtcaaattttgaataaacctaacaacatctgattggttaagtagcatacctagatttattaaaatcactacactcctttaatgtctgtaggagaacatgcatgcacaagcacacacacgttgtgtgtgcatttatatatatatatatatatatatatatatatatatatgtatatgctactgcaaaattgaagagactttaccaagttctgtcattgacagggacattatatataaagaatatacatactgtaattcacctcatcaagagttaattttatggccgggcacagtggctcacacctgtaatcctaacacttcgggaggcagatcactttgagctcaggagatttgagaccagcctgggcaacgtggcaaaaacccatctctacagaaaaatacaaaaatgagctgggcgtggtgactcccgcctgtagtcccagctgtatacatgggaggctgaggctggaggattgcttgagccaggtagcagaggttgcagtgagccaagattgtaccagtgcactccgccctgggtgacagagcaagaccttgtttcaaaaaaaaaaaaaagagttaattgtaccaggaacatgtggtgtcaaaatttaaaatatgtgaactctttgacccagcaatgctattttcagggatatatcctaagatcatcaccagcaaagtatataaggatgtgcatgcaaaaatattcatcatggctttctttatacaatgaaaaattggaaataaacttctcattaatgggatgctggttaaagaaaatcattactgtaatatgcagccatctaaaagggtaatttatatgtatatatatttacataagaaaaccctcatgtcatattgctgagtaaaaagaaagatgtcaatgagtattcatgatgtgattctatttatccttgcaaatggtggaaattcaattatatggtattttctctcttttctgtttgtttttcatatatgtatatatttcctttgaaatcagaaaaaaatcaagctattttcatcagaggaaaaaaatcattactctgtatttcagtcacactaaaatagtcacccaagaa

SEQ ID NO: 10 - DNA, 543 bp, Homo sapiens
cctggccagggtcctggtcccatcccagtgggcttcctgcctgccagcctgggggagtggcgtgggctgaccccgaccagactgaccgggcctcaacatcacctgggaatcctggaaggaaacaggttcctgggccttgctccaacctaaggaacccgaatctgcatagctcacatggcgccgtatttccaacgttcagagcacattggaaagttgggaggaaggatgaggcttgtgttttcactcacaaactccctccagaagatgataatgaaagtgtctgacgcataaggaaataaataagatggttatgtgcccagctcaagggctaaggtgttggtcaagaccacacccgaggggctgccagtcacagggtggggtccaagctcctcaccagacccaacctcccctgctctgcaacctcatccttcccctgtctttcctgggttaaattttacacttagtaacactgaaaccaggcagtttcacacctccgagcctgcatctatgctcatctctttacctgaaacgtcttctctcacc

SEQ ID NO: 11 - DNA, 3889 bp, Homo sapiens
actataccattacacaagaaggacaagcctcaattcgccttctctgtgccttctattaatcagagagagcctgtctcttgtgatcaatgaaaagttttattaccccaggcatgctcaacagtcctacgttatgtcagcattttgtaggaaaagcattgaaggagcctcggaatatgttttccaccacctacatcattcattatatggataatattgttttggccactcctacagatcaagtattataccagttattcagagaaataaaatgggctttaactaaatggaatctcaaaatagctcctgaaaaggtacaaacaacctcctcataccaatacttagatactactgttactgaaaaaagtattcagcctcagaaagtagctcttcgtaagaacaaattacaaactctgaataacttaggggatattaattggctgcgcccaatgctaggtattgcttcttatcaactcactcatgtttatcaaaccctccaaggagattcttcattagattcccctcggcaacttactaaggaggcagaagctgaattacagcttgtagaaagatgcttcagcaacgacatgcctcctggctacaaccacaaaagtctttggttttgtttattcttcctaccccccattctccatcaggacttttagctcaattcatagacaaaactataatggtaatagaatggctttttttatccagtcaaacagtaaaatctttgcaagtttatcttgctttagtcacacaacttataacaataggcaggcatagatcaaaaatgcttacaggatatgatcctgataaaattattgttaccttggattcccaacaacaggctgcggcctgggagatgtccactgcatggcaaatcactttcgcagattttgtagaaataatagataaccattatccatcagacaaaattttgcagttttataaaattcacccttttattccccctgtgattgctcatcacaaacccatttcaggtggacagacctattttaccgatggctcttccaaaagccacacagccatttatggacctaaatatacttaaataataaagacccctagagtttcagctcaacactctgaattaatggcagttattcaagttttaaagctcacagctttatttcctattaatattgtctgtaattcagcctatgtcgtaaatgtagctagttgcattaaaactgccactatcaagagtgtacggaccagccccacagggtcggtgggtctctccctgtgtgcggcgacgagagagtgtagaaataaagacacaagacaaagagataaaaggcagctgggcctgggggaccactaccaccaatgcgcggagaccggtagtggccccgaatgtctggctgcgctcttatttattggatacaaagcaaaaggggcagggtaaagagtgtgagtcatctccaatgataggtaaggtcacgtgggtcatgtgtccactggtcagggggcccttccctgcctggcagccgaggcagagagggagaggagacagagagaaagacagcttacgccattatttctgcatatcagggactattagtactttcactaatttactactgctatctagaaggcagagccaggtgtacaggatggaacatgaaggcggactaggagcgtgaccactgaagcacagaatcacagggagacggttaggcctccggataactgtgggcgagcctgactaatgtcaggccctccacaagaggtggaggagcagagtcttctctaacctcccccagggaaagggagaccgccccccaccctttcccggtctgctaagtagcgggtgttgttccttgacacttttcgctaccgctagaccacggtcttcccaaacgctggcgtcaccactagaccaaggagccctctggtggccctgtctgggcataacagaaggctcgcactcttgtcttctggtcacacctcactatgtcccctcagctcctatctctgtatggcctggtttttcctaggctatgattatagagcaaggattattgtaatattggaataaaaagtaattgctacaaactaatgattaatgatattcatatataatcatatctaagatctatatctggtataactattcttgttttatattttattatactggaacagcccgtgtcctctgtctcttgcttcggcgcctggatggcttgccgcccacacaagagcaccttaaaaccagaactgcttaacctatttctgagactccaaaaagctgttcgctctcatgctgccccttttcatatttctcatatccgatctcacacacaacttcctggggccactatctctaggtaatgatagagcagataaattcatcagttctatatttcaacaagcccaagcttcccatgctttactgcatcagaacaacttgcccttactcgtatgtttcatctgcctcgcagccaggcttgagttattgtgcaagcctgccccacttgccagcatgtccctggtgttgcacctgtggaaggatgcaacccacgaggcttggctccaaatgaaatctggcagatggatgttacatatatatagcagcctttggctaactccgctatgttcatgtaatatagacacttactcccatatgttacatgccacatgccaaactggggaaacagctggtcatgtctgacgatactgtctgtcgtcatttgcccatatgggggtccctaaacaatttaaaactgacagtggactcgcttatgttagtcatgctttcccaattttttacaattgtgggcaatcaatcataaaacaggaattccatacaatccctgagggccaggcattattgagcgggtacatcaaacactacaacgcatgctgaaaaaacaaaaagggagaataggggaccaattaccacttcaaacaaaattacatttagccttgtttactttaaattgtttgactcctggtacggatggcaagaccccagcagaacgacactggcaactgctagaggaaaagaggcaagtttatccaaaagtgttatggaaatccccagaagaaggacaatggaaaggtccggtggatttgctgacgtggggacgagggtatgcttgtgtttttacaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcgtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttcaaacag

SEQ ID NO: 12 - DNA, 858 bp, Homo sapiens
agggctgggagataatacagcaaaaagcctgccatgtcctggtgacaggagcccatttcagcggccaaaaaatctttccaacagcttctgttttgctggtaaatgtctgtgtttgtgttggttgtaggaggaaacctgggaaaacaagttgggttctggatgagaaaatgggtgactttgttataggatggagcaaagagaatcacaagaaagctcaatggcatttgaccccaaatggaaaacccaaaatgacacttccattaggatattcctttgttttggaagaacagggtgagaagaagaaagacaggggcaaactttaccagacatgcccttcaccagccaggattagtaactgaagaggaaggagagaatgctgggtgcactccagctgctgggacccttctctttccatctcactgtacctttgcttctggaggaaggaaaatacattcaagtcctaggaagattctgaaggtcaaatgagggaaaggagccctgcccagcaagatgtatcatgtcaagccacctgcttctatcagtcccaaatccaccatcaccttagttcctgactgcaattagcacaactgtgttatcacctgctctaactttagagagagactgcatttaacatcaagaatgagggtgcttttgggaaaatgaaaaaaaaaaaaacaaacaaaaaacagatgaacatcatttcagaaaggaagaggaaaaatgatgatgattctccttgatatgaaataatgaacttcaagctctaaaacagaacattgcatagaacaagaggaggacagaggcagaaaaacttgcctgtgaattgaaagatatgagatagtctggtaccacaatgaa

SEQ ID NO: 13 - DNA, 751 bp, Homo sapiens
cagtttactccagagaagaaactgtgtctcataatttcttttgcatcatctggtcctccaccaaggctatgagaacagaaataaaattaagcacagtagataccagatgctcagagcagagcagccatggagctgctgggaccaaaccttgcctgacctagccaccaccacaccccagacatataaatttaaattttactgatataaagaatgcaaaacacaaaatttacaaagatcataaaacatacaatgttgtgtattgtaaattagtcacctgattctcacagaaaacttgttaatttctgctgtacgccaaagccactaatggatgaaacttacgattagttccaacatgaatattggttgacatttttgtttatgttaaagtcaaagctgaaagtgatacaatggagacttcagaacttcacttgtcagttatttgtgtaggtttctttcccaggagactgcaaactcctttgaaggcaagatcagtgctggattatccaaaaggcattctaagcttgtgcttggggaaccagagaagcaaaagcaccaaaacacgtttctgaaaagcatttaatattttcaagcatgcgtcaacatagtctgcatgagaaacatcaaagctccatggcattttcttacacttatgttgtagtttatttcaatactgttttcatttgaattgtacttgagatgggagttggagtggagaatcataatcattttgtaaataaaatgttttaatcca

SEQ ID NO: 14 - DNA, 636 bp, Homo sapiens
acaggaagcgtgtaggaagcgtggcgcctcagccacaatcgtaatcacctttaatctcttgctcaaaataacccaaagtcaagctgaccctcggtctatcttgaggccctcggctgcccccgacttgaagattctcccccgttgcgtctaagtggctgctccaagttcccgtccccgctggcatctccctgcctcaccatccgccacattcctacaccaaaagttgacgccgcattctggactcctctctttcctccccccacacctggtccaactccagcagcatctaatccacctgcagaagcatctggaatcactccactcccaccacgaccgcccaaacccacctccagcggggacgacgcccaaggtaccacctggtctcctggcacccacaatccattctccctccacagccagagggagcctcgctaaccaccaaggcggtcctgcggccccgcgcagccctgagggcgtccagtcctccacgcgtggaggagaatccggcctccagacacaatctccagggcccactggatgggcctccgctccttctcactcccagtcctctggtgcatgcccccttcctggctgaagaacctgcaccagccgcccctccgcctgggaagctccctc

SEQ ID NO: 15 - DNA, 2368 bp, Homo sapiens
agccgccacactttcccaagcccgcaggcgccccccccaacaccagcgctgcacccccgacccattccccgcggccccctccaggagaaaaaatgaaaccagactggccgaggaggggggcggcagggaccagggtgcggagcagaggtgagggagacgggacttactttgcgaggcgcggtgcagggcgccgccgacgagaaataaaggccccgatacgggctgcctggagccccccgagcgcagcaatgtcagggctccagtccgggcggcgttggcggccgcaggggacggggacgggcgcgcgtgcggcgggcgctctcgctgcgctccggctcgggccccggctccgcgcggctccgctcctggctcccctctggctcctggcaccaactccgggcagtcacatgacgccggcgccgctcgctctgcgagcctcccggggctggcgggagaataacttgtctgactaccagtattcttggatgcagaagtgctgaagatgagcacacacacgtacggagaatttctggagaattcagctgctcagaacaagaactgagatccagagagatgatgactttgcccatagaccaaacaaagaaatacatgtttcagtcctgtgtcctcctgctatgtgtgtccggaattggtgggttcttggtctcactgacttcaagaatgaagctgcggaccctcgcggaccgtgtgtgaatgcctgctctgtgagccctcagaatctactggctgaatgagtgcgtggaggaaatgtgctcagagctgctgtgtgtcatcctgtgtttgaagtgctcctgcagctatcattcatccagttaagaatttgaagaagtgtgtgcacaaagacggagtctcactctgttgcccaggctggagtgcagtggcacaatctcggctcactgcaacctctacctcctggattcaagcggttttcctgcctcagcctccagagtaacagggattacaggcatactccaccttgccctgctgattttgtatttttagtagagacaagagtttcaccatgttggccaggctggtcttgaactcctgacctcaagtgatccactgcctcagcctcccaaagtgctgggattataggcgtgagccactgcgcctggccaaatgctctactttttaatcaatgttttccaaaatagggatttttgctatgtgctttagaaattagagaacaaacggtgataatatatgctaaacttaaaattagtatgcctccttttatagacaacaagaactttgtcacttcccagtttgtcttgtcattcaggaggctcagagctacgatctgtgcccactcgtgctgcctcttcttaactttgatttcctgaagcagcgatttcatctccgtttcccctcatcacctgttcttttaactgtttaaaaacagcattacatgttgttgcaagtggcctcaaattctttttggtagaagggaaattgtaatccatgagaagaaaaaaattttcctaactattctcaggtgtgtttaagggctgcattccatgatgctatcagtgccttctttcagctcacaggatatcggccatgttaatgagtctgatgttgctagtatcacaggcaccggaaaatatgcacattatgctggagcattagaatgcaacagaaagagccctgggcttggagtatgcagaactggttcttgttacaactcctcttactagtgggctctggaagaaaacacattgaattcatgatcatggttaacctttggagagagagaggagaccaggatgaaggagccagtcgaagatcctgttcaagtgtacactgagccagcaggttcaccagaaagctattgagcgtttgctggaacacattatgcagggtgaatttcttctggaatgttgccaaggattttttatgcttctgtggcaggcatttcttgaacattgtcatttagccaagcaaagaagattttcttaaaggatagaaaatgtttaaaaatttttgtttgtttgaagataggttaaatggctatatgatctcaggataagacagagaaaatcacttatttctctaagtgatctgattaggttagtgatgttttgcctttaaacagattcatcattattcctaaagtattgctgtattaatactgtcttctagaaagtatccaccagtgcctacttttcttcgatatcattagctgtttttcgaaactgaatttgctcttcagagatttctcatatgtttgcgtataaggaactactggtaatagccaagaaaatttggaggtgcagagaacatgctgaaacagaatttttcactttcaattctagaactatgccataaaaaaaaaggaaaatgt

SEQ ID NO: 16 - DNA, 2171 bp, Homo sapiens
gtgaccctgccgtgatgggcggggcggcaggggaggaaccagactgcgagcggagaagcggagtttgcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaagtaagtgcaaaacgacaaattgtcacagaatacagagaaaaggggaaaagaaattaagaggagaaaaagagagatctagagggccggtccaggagatacaatctatgcataataggaatacctgaaactgaggacagagcaagtggagctgaaacaataaaggatctacttgaaaaaattttccagaattgaagaacgaactagatctacaaatggaaaaggctcataggatacctttaaagtttaatgaaaagaaagcagcatctagacatatccgggtgacgtttttgaatttcaaagacgaaacattttacaagcatccagtcagagaaagcaggttacttacaaaggggcaaaagtcaggctgacctcagatttttctcctgcaattctaaatgccagaagacagtggaacaatatctagagtgttaagggaaaataattttgagccaagaattatatactctgccaagttatcatttctttacaaaggaaactggaagacattcttagatatacaggggttaggaaagtatatcaaccaagaactttccctgaaaattttgctgaaggatttactgcagctaacagagaacctgaattaaaataagaatagggaggcaattgtatgaaagaactgatggtatgcattaaaactagttaaggagcattaagtttaaattgttatgtatagggcattaaaactaaatacaaaaatagaaacataagctgggtgtaaaatttcagtttacgtttaaactggaagggcataccacatgttcaatatattggacaaatactgttttatttttagcatgtagtattgtagatacaaatacgcatgttcttaagctaaacctaagtaaaagggctttgtcactgtagatttgacaaataacattctaaatgtcaaatctgacaattggaaaacagtacagttttatttcccttatttttaagtatagcaggaaaaaaataacaagtttgtccatgttactactgatactgtaaagaaacttccaaatcactggtttgggagggggtggatacatcctcattttctgtacatgatgcatggggaaaaacagtagttactgcatcatatagttccaagtaaatcatatagttccaagtaaatttgacatggaaataagtgttaactacaaaaatagaatatatacattccaatgtttggaaaagaagtggtaaaaagaaaaatagcaaaaagacactaaaattagcaaaaagtagattgacagtacagatgacctataaactggttaaatagccctattacaattgaaattgggtcaaaaatcaatctctaacctgagatacatttgtataaaacaaatgatcaaagagtttaaagataatggaaactataaatcatagaaatggcaacatttttcttaaaatctaaacataagacattttatgtaaaacatacaatataggatgtaacatttaacaaactatatggtaaataatatgacattaatatataaaatatatgttccagatcttgatgtgggtgatagttttacttatgtacatcgatatacatctatttaaaaacatgtacatttaaattgttgcattttatgtatttaaaatttattgagtaatccttctgtatgtattattaaagagaatatagcaaaaaaa

SEQ ID NO: 17 - DNA, 879 bp, Homo sapiens
cgcacataaggtgtgaccttttcattcccgttgttatggagggccacatctgccagagcctggagtctgcgaaggccgggacccggttccccggcccacagtgggggtgttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaaagttctttaagctggaaattgtaaattcctcctgaaatgttttttcatgcagttaccatgaactaatactacaataaaggatggtcttggg

SEQ ID NO: 18 - DNA, 1571 bp, Homo sapiens
gactacccggcagaagggacgtccccaaatgacactcggaggccgcctccctgggctccggtgctcggtgccgggaggagcggcacggctttctaccccgcctcaggtgcgccagcacgttttctgggcagcatctgtgtgttaggcgaccggagaggtgggttccttatagggaataagaaaactgaaactgacttccaactgcaggcagaaggaagcagtggtcattgctggaggttaaaactgttctgaccgggcgcagtggctcacgcctgtattcccagcactttgggaggctgaggcgagcagatcacgaagtcaggagatcaagaccatcctggccaacaaggtgaaaccccggctctactaaaaatacaaaaattagctgggcgtggtggcgcgcgccggaagtcccagctacttgggaggatgaggcagaagaatcgcttgaacccgggaggcggaggttgcggtgagccgagatcgcgccattgcactccagcctggcgactcagcgatactccgtccccctctccccgccccaagaaaaatctgttcagtggggagcgacaaggaaggagctttcagcccgactggggtcgcagggaagaattcaagatggcgtgtttaggagctctagctccttgacaaattagtaaaatgttagtcttaggagaagaacgaaaaggctctcctaggctaagaaacagcatacacagtgagaaacctcagaagaaataaaattcaaggaagatagcaacaacgaaaacatcagaaggaacactaaagtagtcaaatcagcctagcagaaacaaagtacgttaaccaatggaaaactgacggagagaaataaactgtttttgcacagctaaatggaaatgacttttgaattatctgctttggaagattatccatgacactgttctgccctgctctgctctaacaacatttgtaagtcactcaacagttaataataaaagtcagttttgaatattgcaggttttagacacagaacaaatgtaatgtgacactgtaggaagaatgaattctccttagtcccaaattccttttttttttcttagattcgggaataagtaaagatacaagatcctcttaaccagtatcagtataattgttccctttagatttattgctgtcaccccaatgctcttctttctttctagaggaaaggaaaagaaggaggtaataggaaaagtaatgggttgtcctgatgttactgtgtctaggatgtcattgccactggtctcctcagatcaatcattctgcctaataaacagaaaaataacatgggcagcctcacatgcaagcctttacacacactgctaaagagacctcgcttcctctgagaagtgaggatgtgagaatgaaggattgattttacagaactggatgacaggttaaattgggcatctggaggtttatattcccatctccactcaccaagtttcatcctccatttatgaccaaggataggtataacatctgatcttgatggttactgtttcaaaaaacaatctgatcttttttataaagttaaacatttacttaat

SEQ ID NO: 19 - DNA, 580 bp, Homo sapiens
ttccggaggcggtggctggtctgaggacgacgcggaggacgtcactgcgggtcggtgcttccttacaggtgccttctggaccggggtccttggcacctcccctgctcctgccctcggtgccggaccctgtgccctgggagcccgactacctcggtgtcccagccgtcccgggcttgaggcgctgagagggctgcgcggcttccagcccggaaggcagcggtcccgcgggctgcgcgcggccaagggcgactccggtgtgggaatccggcggaagggaagcacccgcagggagggctggaccccggaggctgcagagcgtcagaagcgactctagggaactagggggtggggtagggaggcggggacgtggaataaagaaagctcctgggtgccggctatgagaagtcaggtgtgcgtaggcgtggacagagtgccgatgtgggagtctggacacctggattttctggtcggggctctgtgtccttgggctaaacattcgcggttccactggctccctaacacttgaaatgatgtttgaagttgcctggaagaagtctcttccttttttctctcagaggtg

SEQ ID NO: 20 - DNA, 843 bp, Homo sapiens
ccggcgggatctggatgtggctcatgccggcggcggccgaagggatagacgggttgggccgccggcggccactgtctccgcgctcactcacgccggcctttcgctccgcgcccgcgaggtctcttcgcgcacggccccggctcacgtcgcgccgctctttggccggctctgcgtttccgggccgcgcaaccctacgctaccacggccgacctggcaccgccgccgctgtcactgggcagccgccgccgccgcggggaccgacgggcaggcgagctggacgggcggggcaggcgtcctggttgtgacgcacgccaccgcgggcgtgcgcgtccccgcttagcaccggccctcagtgcgcttgcgccactagatgacccgccccctcgggctgtcggggggtcgagacagtggagtgttcctgatgccagctcacggagggaatccagggaattagctgatgccaagagcctctttttggccagcacttactaagcaccagagacacagcgagaagcagaagcatacgagcacatcagtgtgattctgctgtgatgaagggcaagagagggctcactttccggcgtgacattcaagctagccccgaggcctgagcaggacccgcccaggggaagatctggaggaaagccatctgaacatacaacaagagcaaaggcctggtggagtcaagaccaccttggctgccaggtggaatggtggaataactcaggagtctgtcaggtctctgagatgtcaaacgggtaaggccttgtaggaagtaggcgtttgaatgagatcataatttgagagccacagacagaaaaataaatttgaaagagttcactc

SEQ ID NO: 21 - DNA, 544 bp, Homo sapiens
gtagtcctgcagccttgtggccgaagggctgggactggccatgagattacatgtcctagcatgctcagccaggcgcgcgcagctctgccccttcctccagtgatgcgcacagtccctgatccctgtgcacgctgggattgtagtcctgcagccctgcgatcacttgcaggtaacaagaaatttcagcttccggcatgatgggcgaaggcccccaccttcagcctcgctcctccatgccttcagagctgttccgccatgcagacggggagcctgcctgttctttaacctctcctacctgatgggagaggacaagctaccaggacagcttgtctcaccaagaaattgtgataccgcatcccccaacgtgctggcttcctgacttccaaagttgcgggaccattgcaatttagagacgtggccatagaattctctctggaggagtggcattgcctggacactgcacagtggaatttatatagggatgtgatgttagagaactacagacacctggtcttccttgacctttggccagagcagagcataa

SEQ ID NO: 22 - DNA, 2846 bp, Homo sapiens
ctcgcaagacctggttgtttaaaagtgggcggcaccttccccttcgctcttcctcctgctcctgccctgatgtgtctggatggtgacagatgggaatcttctccagtgaccagaatccatgccttaccttgggagcccaagctgacttctcaagctctggggatgcctcagtgatctctgatgtggaattagtggaggctggccgttgctcacctctacacagcctgctggtcgttagcgagcaggagttctgatgttcctctcatcttggatgtctttcctaggagaatatttctcacgtgtttgacagaaaacattatctgtccatcatttccatggattcctgggtctcacgggcagaaggacaaggcagatatgaggcggatctggtaaaaccataaacaccatgagatcagagcatccatctgtagactcacagagcaagaagcgtgactgccccaatcttgaatggatgagtaagatgaaaatcaatttataaacatcttgtgacaagctggaattcagttatagatcaattacagattgctcactggacaatcaaggacattattagaaaacggtttccaccactagaaattcatctacattgacatccacctaaatatccagaaggtcatccccactttcgtcgctctccacagtcagctgccgggtccaccacttcttaacttcagaaccgcaggaagccgcgtcagtcatggggttcattttgcacacgacagatttcatggttgtccttcctccaaaccgaggaacctagatcttctctgatctctgaaaaataagttcctggatatgaaaggggatactttccttggtggtagtcccagtgaagacccactgaacatcgtcagcctcaaaatgtaagctgtgctgtcatctgctttgtggaacacatatgctacacatcttctcctttcaattgggctgaagttggggcacagttaaagagcattataaagctcctgctttagcatgaacttagttatctatagaaaaaaacatgtacaaggacactgggctgtggggagcattgctctccctccattcctgagtgctcttaatgggattatcctggctttccaaaaccctatagagaagaagctcatagaagaaaattctcttactgaatcagtaaaatatggaaaataatgggactgtttattaaaggattgaatgagagaacacaagtaatgcacttagaagagtgactggcatacagtgagtactacgtgctggcttctcaaccatgatagcctgaaatgtacccggaaaatgggggctaatgtaagtcatatttagagaagttattttgggggacaatgtttttgacaagactacatttttcattatgttgctgtctgtaaacaactgtagatgcagacttgcattttgaaaggcaagacccaaaacacacaaacagagtaaatacctttaaaatgcctcgatcgctggagaaatgcctggatggacctacctgagggcagacgccactgcccaaatttcctctggggtttccctgcgtcggctgcatcttgccgacttcctcctcgatccgacagcgtggggctcaggagctgctgctggctgcttgtctgcatgggaggagaagcacacagttaccgtctttttaaccctgcgctctcctccttttactataagaaaggaaaacacatggcaggaggacaagtgggaagaacaacatggactcagagtgtccacaatggggaaaagtgaaaatgggtataaagggtcacagaagaaaaagagccaccactgcacgccctgctgaaggagacaccactcttcctgggacatcttgtcctgggtaacccccactgcttcgttcccctccatgcctgagaatgtcattgtttcccttcatatcttcgctggcaaaccagggggtaaggaaggggaactgcaggaaggaaggtggggcagtggggacgggctgggcgggggcagtctactgtcaccagcctggagatccacacttagagcttcagggaaagagttctctgcaggcaaagctgtatgatgggccctggtggaggatggagctgataacaatctaagctacagtgaaagaaagagagatgccaagacttcccacacatttcacctgttctcaggttcacctgtcacctctccctttcctaacaaaagccttggtcttcacatctctttagtatccttttttttttttttttgtcacctctttctttcttaggctttttcatctaaaaacagagggctctgaaatcatcactttccccaacctcattagccctgtctcactgtctgtcctgacttcagcctgcctccctctcccatgcgagacattgccaaccatcttcagggtgaccagtggcaaggccactgcagatgcctccccttgccccttggttgactaactccgcagaagtccctgcagtcggtggcagatgatttctaaaggctggggagcccaaaacatgagatctactgaaaactgagctatggcaccagtgggcctcctggagcaccctgctgggccgtggagccttaggcttccaaaggtactctggcccctggctgcgttgctgcacaccatggagcctggtgctgctgggggctctgcacagagcacgggatcagctccacgttgttaacctcaaatcgtaattgctgcctcataaaggggcaggtcctcccagccagctgcttctcacagcacaggactctccaggacgctgataactccttgtacttttttatatagacacatacatagagtttgaaaatgaaaatatgctgtgacttaataaatagaaactcctcaa

SEQ ID NO: 23 - DNA, 700 bp, Homo sapiens
aagcatcttgttgacacatcttcatcactttggaatttgagcaacaacatttaccccttctgaaactcacccagaggaagcggattttctgacgcatatgaagagtgagaactgtctacatctaagtcttctttgagaacaataccagctgagcggctatttacattccagcttcttttgagaatctctgaagatgattaagtcattgtcagctggcccagaaccatatcctgctccacaagcctcgtccttggcaagaagttgcacctgcccagagagaaaaccttttgaaactggcacaaaggcactggagagactggcagggccccctacttgacgatctggctcatccatctgcacactgaccacgctaagagctgtctgcagtgatggaaaccttctctagctgtgctgtcctctatagtggcaccagctgcctgtggctactgagcacttcaactgtggctgcagagactatgttaaattgtatttaatcataattaatttaattgtaaacaactacatgtggctagtggtttctgtactgggcactgcaggtgcacatttcctgctggccatggacagtaagctccataagagactaattgtgcctggtttgcttataggcttatcctcagcacctgcaccagcctagaatatgattggcactctattaattaaaagttcccaggtaaatgaa

SEQ ID NO: 24 - DNA, 2456 bp, Homo sapiens
tgtttgcaaataaaccattctgataaattatttttgttgcttaaaataagaggaggaaccgctgtgtgttagcaagaatgtccatacctgatatgaaagagtcatgttggcttcagttcctactgccctgtggacttcccattccctccttacttgagtcaaccatccactcagtactttccacaaatctaataatgaggtgctctctgtaggtaaatcctttcactatggcttgtcctcaaacctcccaagaaaaggttcaactgctcaatctcttaacctttttaattccattcccttgcaggtatcccggccctgcataacaagatgatcccaactcaaggaaaggggtttagcagtgttggatcttggcgtatgtgggatttaaccaggcagaaaggcagacaagagtaagattctaggcagagagagcaaatgcgtcgagcatgggtatgaacatgtgagggatagagaataattctgcaggaagtttgctggatggaagggccttatagggttagaaaagctggtgtcagattgtcaaggactttgaatgtcatggggcttctcttccaggaacacatgggatcaggcttagattaacccaaatgtaattgtcagagcccagagatatttcatggtccagtcctagcactgtgcagctgccaaaagtcaaagccattcaaatctgtactgaaaactgtggaaaagcaaaggagcacttaagtctctttccccatgtcttgcattctcactctcttttgcttcaaagatctgtctttacctgcccctgtccccagtcctaacaaaaagcactcccctaaatcaactcttaagttcctctcccttctcactcctttcttagtctcctctttctgtaagaagttcttgctcctgttgttaatggaagttaattaaagtagtatttcaccttgtaaggctgtaattcttggcacttgttatcctcattttctacatccaaagaccatggaccagaatatctcttaggaggtaagggagagtgaggctatcagccaaagaaaaagtctccagggggaaggggagaatcacttataatttaatactttgtggaaaaaacatctctgccacctatggccctccaataacaatggaagacagaatcaacaggtgagaaccttgggacaaaaataagttacaaagctgttgtaatccaggtaagagctattaagtttccaaacgaaggctgactgtgaggataagtgatactgatttcagaaatctttaaaaagtagaaccaacaagccttgaggtctaactctgttcaacattaaagggaagagtgagtctaagaagacttcaggtttctagcttggccaaaccaattgagctttaagtgaaatgtgcgatatggtaacagagaaggaaaaagacataacgatagatttgagctgctggtgggaaattctggtttagtgcccagctggctgtacaggctggttggactttaggagggaggtttgagctggaaaataaagatggagagttgtctttcagttttagatcatcagtgaggtcataagggtagatggagtttacctgggaaaattaagtagctattcgatttggcttattattatgttaaaataatacttctctagtgaagtacttaatatgccagatactgtgccaagcattttatatacatcctctcttttactaagccctcatagggcaggtattttgattccaatcatactgattggaactcctaagaaggtatcttgcttaaggtcccacaacgaataggtggcagatccagggtaattcaggtctgtcagaacagtgattcttaattttttccctcctcagactccaggagtcacatgaagttatgcatcctgtctgaccgaggcacaggcacaccacatttttatattccgcttccaggatatcacaaacctgaagcccatcctccatggcccagagagaaaacccaggacaaaaccttggagaagactattttcatgaagacaaatggagaaggagcagtagagtaaaaagagagcaaatccagctgcctgtacaatccatgccaccgaatgccgtaagtgagacgtaaaagttacgatactgaagagacgtaacctgaccaaggccacagagctggaaaaagaagcaaagccaagccgtttttctcatgcactgctcacaacaagcccctccttccactgactcatgaaaaacacactcataatgcccagcccgcaccctaatgaacagccctcttaagagtggtcatcagacttcaatttcacagactagaattgagaaatggaacaaaaccttgggataccagccttccattttggtagggatcatttaaaaaatggtagggatcatttaaaaaatgtgttggtgtctgaaacttactttgaagtggttaaaaaacataaaatgtatagattgtaacaagc

SEQ ID NO: 25 - DNA, 662 bp, Homo sapiens
ggaggacaggctggcagaggagggaggagggtttctagctgagagagactgcggctgtgggcctgcagcctacccctcttcaagctctccggagccgttcctgcgaaaccagcccccacaaataaggaagctgggattcagagaaattaagggacttggtgaagcagagaatgccaagggaattgattcagtagtggacggggagtccctgaagactgttgagcagtgaagagacctgatcgcatactaaaaaagtacatgcaatggcaagaagatcaactaagagattcttcttatgttgctattttaaactcctgaactcaagtgatcctcctgccttggcctcccaaagtgctgggattacaggtgtgagacactgcaccctgcccaagcacctctgctccgtgccatgctcttggctaattggagttgtgaaaggcatgaggattctggtcatggactcagctctcccatagggttctgacaccaaagcaatggtcacaacagtgaaaggaagaatccatctggccaggctcaggtggttcaaggccttcagaatctgccttgagactctcactggctttagactgaaaaccatcttggccccgtccatccgtgtaagcaatttaacgacagcttgcaaagcaccgagctttaacaga

SEQ ID NO: 26 - DNA, 771 bp, Homo sapiens
tctgtccctgaaaggccagaacaaactgcctcctagggtaacactaagtgctactgccatttgagacagacgtgtgcacagacagccctagctcacaggattgtaggtccccagcggatgaatgaactggctgtttgctgggtgccgggaagatgctttggagccacccatagatggacctgcatggggacttgcttttccaggagagatgattgattcaccatgctgacctgaccactctcccacgtggtcttcctagtgatcagatggggtatctgaaggttcagaaacagatcaaagaaaacgctgtgcacatggagtgaatgtgcggtggctcagacctgtaatcccagcactttgggaggccaaggcaagaggattacttgagctcaggagtttgagaccagcctgggggaggaaaaaagactcagagaggttaagtatccgacccaaggcacacagctgtttctcaggggagcccggattcaaacccagggactcggatcctagagcctgtgctttcacccgctgcgctgcaccatatgtgtaccaggatggtagaatcagaggtctggattccagcatttccctgccagaggctatggtgggtgtgccgagcaccaccctgagggggaagcagtatctcagcaactacacccccgaggaagaggcagtccccaatcagcgggagcaatgggacctgctgatgacaaaataagccacagaatgaatggctctgctccactggccttctctcctccctgccccctt

SEQ ID NO: 27 - DNA, 362 bp, Homo sapiens
tcaggtgtcctaggaagccgattccgagttggagatttgcatgcaaggaggttgaaatgatattcccaacacctgtggaagagtgaaagcaataggattgggcggagcaggaagtcggctggaatgcaatcactatcatggccgcagtccactctacagggatcttggtagagcaacactctggagaccttcttttgaggcatttcaccaccagagaatgatgttggaaccaatgttggtaattttgaaagtcatggagaggatttcagatgatagaagtcgggcaaatatcccaggtttaataaataagcaaatgatctccaaggttatagagggattggacatttgtgtcttcaattggc

SEQ ID NO: 28 - DNA, 2330 bp, Homo sapiens
cataagcttttttttgtttgtttttaattttattagaagtgggatctcattttgttgcccatgctggtctcaaacacctgtcttcaagtgatcctcctgcctcagcagcatcagtttaatatctagataaaatctgatgtatgtaattttacttttaagggtttttttccaaacagacgtcctgacaatgttgtttcctattccttgaacattcacctgacgcttatatactgtcattacttttatctgtcaactgatgtcagctactcaatttacacattacttttgtgcatttcatcctgtttctcagtttgacattgtcattcaaattcagagtttgacactgaaaccctgggcatggtggctcacacctgtaatcccagcacttcgggagactgcggtaagcagatcatttgaacccaggagtttgagactagccttggcaacatggtgaaaccccatctctaccaaaaaaaaaaaaaaaaaaaaagcaaaaacaaaaattaactgggcatagttgcacacacctgtagtcccagctactcaggaggctgaagtgggacgatcgcttgagcccagaaggcagaggttacggtgagtagagattgtgccactgcactccagcctggacgacagggcaagacgctgtctcaaaaataaaatattagtaaagaagagtacaatcagaatatgaaaatgtgtaaatgtgcatattctctttttttctaatttggtagcattaaaaatacttaagcatcaaagtttggctttatgaagaaggagtctgagacacctcaggtttcagcccttactaatagcgtggctcaaagagcgttaacttgcctgtgcttctgtttccttatctgtaaaatggggatgatgctgtaacatcaaagagcttataatactttccagagctggcagtactaaataagaccattcctctaaagtgccagcattttgaaaagcatcaacccatcaaccttgtgctttaaatctggcattcttaaagctatacctgtaggcagtatagagtgtttttttttatttgtttttttgttgttgtcttttgagtctcactctgtctcccaggctgtagtgcagtggcacgtcttggttcgccgcaacctccgcctcccaggttcaagcgattctcgtgcctcagccccccgcatagctggcattacaggcacacaccaccacgcccagctaatttttgtagttttagtagtatctactaaaataaacagggtttcaccatgttggccaggctggtctcaaactcctgacctcaagtgatctgcctgcctcggcctcccaaagtgctgggattacaggcgtgagtcaccatgcccggccggcagtgtatatcttctaaagttgcaatttttgttcactccagaatcacttttcaaaaagcatgcagatttaatgccaccagtttgtgttatgtatctatcccgcaaaacagctctaaaggtgatttactaaaagattaacagcatttatctctggtgggataatttttctttgcttgtttacctgtgtcttgcagattttacacagtgaacaatgactgtataattttaaaatacagatatgcacaattgtgtaatgtaaatatgctcagcttcaatacatttaagaacacatttttaacttttcgtaaggagtcttcagtttaaaagtacagtgtcattacagagtgcttattctgttacaaaattagtaaagctgattctgcctctaaatctgaagtaattcccactttttttcatgcttgagtttagttgataaatagcattttagatactaaaaatgattggatgagtatttctacattaataagttgctaattaggcaccagggtagcagatagaatgcctttctgtgtgctaggtttaaacattttacacacagtcttatttaaaacagccttgcagtttatagatgaactgattgttaggctaaccagaggtgttactataccctccaggataacccagctagtaagggcagagccaggatgattcagacccagaccagagccgggtgttttgtccacagtactgctgctgcttataccgtaacgggaaaagtacacaacagtgtcttaatatttcattcttccatgaaaaacacttttaaaatattgaaacattataggagcagaagtacatctctaaatatacttttaggtcacattgaaaacatttccaaaggatttgacctgaagttaatgttgctacattatgctcaatacagcaggctgttctgctagggaaattgttaatattttaaaaatattttcctaagctttagctttacca

SEQ ID NO: 29 - DNA, 401 bp, Homo sapiens
cctctcctccagcatggctgattctggttgctaagactctatcatccagggcagagatgaagcttcactcttgccagagggactattggctctgaaagacctctagtacaggggaaaaatagatgactaacaccttcaccatgaggaaagagtgggtggtgtgtctaccctttgtctaaactatgcattttgtccagggtcaggaaaaggttaagtcttaggattaaatacaggatattttttttcttgctgagaacagtgagagaagaccgggatagggatggggcagaactagtgtttttgttttcacattcagttctcctgaagcggtgtttggctgaaatggaacaacttctcaaagaaacagggttagattaaaagcagcctgttcctctgccaaa

SEQ ID NO: 30 - DNA, 530 bp, Homo sapiens
ctttgtggaactcttttcagaagaaaaaaagagagaaagtgggggccatacttggcactagtaacgatgcatatgcacttctgaaaagaggtgtcaatggaatttggctcagctgatgtttactggatgggctctctcctccttccttccttagcccttctggtgggatcttgacatgttacagaggaaatgctaattgaagccccagccacaaccacttctgtgctctgcttctgcctgaaggaatgaataaatagaaaaacgggaatgttattttccagtaattttttaaatggatctcagtggcgaaaagtacgttaagttagcaaacgtgcctcacatactgtggatgcctgtaagactcttacattcgtctgcctagatgtatttcagaagccaataaaagataatctgtgtttgttgaatgaatgaagaaacccagtctaccgtgggtttaccatgtgccaaatgcagagctacaaaaggaaaaatgaaaaagaaaagacctagagaatctcaagtccagtggc

SEQ ID NO: 31 - DNA, 380 bp, Homo sapiens
gagccacgttgttacggaagggctgggacccagacacagggtccagagtgtcctcgaggtatcagaagaactcctggagagcaagctgagggctgtgtcgtcgccacaccctccgtgggtccctgctcctgagttaggctgtgcccagccgcccagtgactcagaagctgtgcacacaagggtcctgctgaaggacagcggcttctgcttcctctgatcctggcagcctggaacttcctgagaggactgggcatgtggatagccatggggggggacgtcctttaaactggggaatgggctcccctagacacagtcgcttccacaggaatcttctagagcctcacccagggcagagcagacacccgcagcagcctggagtt

SEQ ID NO: 32 - DNA, 445 bp, Homo sapiens
ttggaagtaccccaaaggaatatctatctacccatctgtcctgccacaaaacagatcattctcaacagcagtggaaatagaatcagctccattgcctgggaatcattcttgtcaggagtgctttcgttctaacctaggtaaagcacaacatttacccacaattgacactagaaagtgtttgttgaattgaattgctgtgcaaagaagtacttcctttaaaagacgtaaaagaaaaagaacagtgacagctttgctgaagagaacacaatgaactgaaaagccaccagctttgatcaaaaccctgccccaggaactctccagctgctcagacatggttttctggcatctgtgggagctgtggaatctcagaaagggacaatgtgatcaggtctgagggaggaagaaaaacacaagcagaccagaggcagtgattctgcacactgta

SEQ ID NO: 33 - DNA, 3540 bp, Homo sapiens
gcggggttggagggactcagctacgcgcctggggaggccgcgggccctcgcagactaccgaacttccattctgccgccgggttttcacacctgccggccccgaggaaacaatgacgttgggattttggggggccgccccttgactcgggcgaatgggacacgaacggcgaccccttgctctcttccatccgcctgccgccgttgctgcccaccgactcctacagctcatttctcgctcctgcaggctccaggaatgcaaataatttctcactgggttttggcgggggcgcggagctgcggcgaagcgcgcgcccgacagctttcgccgcagctgggtccccgggcgctggcggctgcggcccccagatacgggcggaggctgcaatatgcacatgcggccacagtgtggtgccaggggcccgccgtgggacacgctcggagcgcgacgccccatcccatcatttacggatcaaaccaaataatctagaatcaagttgctgtgtgtgtcatactcctcctgttttttttccctaaacttttagtagagtcatttacatagttcagtttttacctcagctgttacacagtggcaggaaaatattttgtctccaaactacagcccaagtatgagagcagcgtatcctgaagctaattagtaaccagaaaatcaggaaggtaaagcaaatctctggaggcaagatctggactctatggtatcgccgcttctccccacttgaagcgtctctttgcagtgccgcacttggagatttggacttaatcgttaaacaaaaagaacagttacattctgccttcctacagggcaggggcctaggactggcagcatttttgttgtctctagaaatagaggggttatgagagagcctcaaaagagagggcaagaataacacatccatttctcatcatgagttacccccttgtatgcctagaacgcgtatggagacattctcttttagtaaagtcaaagagaaaagccatgaactaagtatcctgaacacagaggcgtgagccctctcagtctcacagtcccttaggagtcatttatctcagaagttggttgaaacaaaaacagttcatacagcatggtaggcagaattctaaaatgatcccaatgactcactcccttgcataatccccttgagtgtgggtggaacctatgacttgcttctagccaacagaatatgacaagggtgatgaaatgtcactcttgggattgctacattatgtaagactctatcttagcagtctggatggaaagtctcctcctgaacttgaagaggtaagctgccacgccaggagagggcctacaagagtgccacaaggcaagggcctctaggagctgagagtggccccccactgatgggcagcaagaaagcaggaacctcagtcctacaaccacaaagaactgaattctgccagtgaccttgtgagcctggaagagctgcaaacagaaacacagcaaagtcaacaccctaactgcagccttggaagactctcagcagagcactcagctaagctgtgatgggagtcctgacccatggaaactggaagatcttaaatgtatgttgttgctaaatttgttacacagcaatagaaaacaaatacactccaactcttgacaaatttgttaataggaccacgcatcctgagacaaacacacagaagggcaaacatccagatataaacatcctactacattgatatgaatactcacatatgtaagatcaatgatatcactagcaaaacaagctccaagtcaatgggtttttcctttcgacaaacacctctacacataaccaaaaatgcttcaactacttttcttttctccagaggcagttggtttggctaagtaaaaatggggttcttaggagactaaggcggaaaagagacaatagtgcctttttcccctccagaacttatctaagaatggaaggcaggtgtttctatgctatacatagcatgaattttacagtcatggatactgatataatgcttccaaatagaattaattctcttccctcccttattcccacccacagccagcagatgctgaaagactgcactgtccaaacactgccatctttgctttatatatccaaaagagtgggaaatgctgtcacatctccatcagaaactgtcaaacactagtaatggtagaaaatatctgaatgacacaattaataggcttgattttgtggatgctctactttagaaagaaaattcatatgcttttcaaacacacatgcaatattagaaaaattaagtgtgaactaggccacaaagcaattttcaacaaatactaatgaactgataccatgtttaacacaaattctaaccaaagtgctataacattagaaatcaataacaaaaaactaccctccaaaaaacatctaagtaattcatgaataaaataatgtataacagaaatttatgagttttaaacttaaatggtaatggtagtattatatatcaaaactcacgagatgcagcttttagcagacattactaatttcctactcaacaatcattcccctaccttcatgactttggtgtcagccatatgattagggctcgggtccaccaaccagctgcattttcttggtcttagcatatactgattaaattgaaatgactaagagtcagtgagctgcaattgaattccccatggctgactgtggcaaaacattttaaaatagggcatagacagcaccaaccaaaaatgttggtgtattgtactgtagtaaaattaacaagtcttgttcattgaaaacaaacaaaactttaatattatagtgaaaagaaaagccacagagtgggagaagatatttaagacacttgaaaaaggacttatatccagaatatataaataactcctataagtcagtaagaaaaagacagacaatagaaaaattatcaaaaagagcttacaaaaaaggatacccaaataggtaataaacgtgaaaaatggtcaatatcatagtcattagggaaatgcttaatttgcatttgtatatccaaaagagtgggaaattgtaacatacctccatcagatactgtcgaacattagtaatggtagaaaatatttgaaacatgtaaacaaaaatatccacagcattactatttgtaagtggtcaaaaccagaagcaacccgagcccctcagcagaatgggaaaatatgaaatatacagtaataagaacaaatgaacttcaatttacaacatgtatactgttcacaatcataatgttgagaaaaataaaccagacacaaaagagtacatcctgtcccataccgtagccctttatatgaagttcaaaaataggcaaaaaacctatggtgctggaagtcagtgtcaggggtggactagaaatgggcaagaaggagtttctgaggtgctggaaatgtctaaaatagatctggatgctgtttactttgaaaaaatttactgtggcgtacatttatggcttgttgtacataagttatatttcaatgaaaattcacattaaaatgtaatgtaaaaaaga

SEQ ID NO: 34 - DNA, 344 bp, Homo sapiens
gaactccagaaccatcggctctgactgaaagtgaagcggcagccgcgttgtgggaaagctggctggagtctctctcataagcaggcattctttttctccagcccgtcactgtgttggtttgggcccacgtttgtggcacattctaggcactcgccatcatgaaataaacctctggagctgtgatattacaaacgtgaaaagatgacgagcactcagcaactttcaatgaagcgaagagacaaggagcaatccaatgtgtaataaaaaaaggcagcctgaattgttgttgctgtttttgaaatttaagctggttttcaattaaattcagtaaatggtccaggact

SEQ ID NO: 35 - DNA, 453 bp, Homo sapiens
acattctttcagatgccagaggatgctatagaaaaatgcgtgccctcttgtaatactttgttcaagttctgatcagaaggatgaatgatggagcccaagaagccagagtctcattgtgttgctcaggctggaatccagtggcatgatctcggctcagtgcaacctccgcctcctgggttcaagcagttctcctagatcagcatcagcgtcccgagtagctgggattacaggcacccgccaccatgcctggctaatgttggtcaggctggctcgaactcctgacctcaagagatccacctgctttggcctcccaaagtgctcggattacaggcatgagctgccacacccagcctccaaatactttttttttaaatcaaaataatgatttcaatgactgagatctgttatgtatttcaacataatcatgtttcataaagatttagtcttctgaaa

SEQ ID NO: 36 - DNA, 519 bp, Homo sapiens
gttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttgacaagcaaagtggatcagcaaaggctgcagtcaccagcatcttttccaaccttaatgaactgtatcctcaaaagaacactatcagactggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttcttttcgtctcccatata

SEQ ID NO: 37 - DNA, 3384 bp, Homo sapiens
gggtacagactatgggaaaaaataggtggtggtaggtctttccagggtcaacgccaaggagaggcctgagaggtgcatagcaaaggctgtggcactgactccatggctcagaggagggaaatccagggaagggctgaatgctctgtgtttaagggagagatagaatggacagctgggcaaacacacacccggggactcctttctccaagaccgatgggcattgggggtggcagaggaaataccagcatggaacaacatcccagggacccgcgtcctccccaggttacagtcctgggtccctgcatggctgcatgttgtctgcaggccacatctcctcaggactcccgcactcatcactttcccattgctatggaagagaggtgtcaaggtggcacctgcctccctgtccgtagtgctcaggtgtgtggctaccagaggaaaagccactcccaacctttgccgacaaccatcccgtttctgggttcctggagaagtctgggaagctgctctgttgtagaggctgaaaggagggctggtgagagcccccagctgaaaccagccctgccccttacccttcctcacccctctaccttcactctcctcctaacactccagggttttgttttttgtttgttttttgcttttctcaccccagggctcctgcctctccagcctggagacagatttgatttgggattgttacaaaaataataataacccaaatgcagagaagccacggaaagggctgagggcaaccctcccctccccccgccctcctccctccccattccaaaccgagtacaaaaccgcacccaaagcagacattctgtacaggggggtgggtgggctggggagcaagcgggaggggcggccctgcggttgctctgtacaagtccgggttggtgacggccccagcagtccccacagggcccctggggggcgcaggaagtgggcaggcgcctctagatgaaatattccttcttgtcgtcccctcctgactgcccgccttctgcattgatgatggccgtgtccgcgtctggagcatcgtcggagccttttgcctcatgtgtcagtagtggccaaggaagatgagcatgatgagcagcaggaagacaatgaaagccacgatcccaccgatgatggcgtgtcccgcccacttaaggatattcctggaagaagatgcagtagctccttctaccaccaggcgtcagcactggaaacagacgcagtccaacaggactccctctgcctggctgttgagcacaaagcagaggggagatcagcaagataccaaccacaagggcacaagaactttctctcactgccaatcatcatcagattggtctggagagatctgggggcagagaccggagctcagtgcattgtccttgctcttggcatcctacaatagccttgttgtgctgaggcagctcccacatgctgaggtctgcccctggagtgggaatcacccatccagacattctgatcccaagaactcagacctcttatcgctgggaggcctggctcttatcccctcaactgttttaatgagtgtctcaagtaagggagcctctgatgtttccccgacaatgcatttcccctattctgagaaaagataagactttctggcgggacccacagccattgggatcttcaaaaaaatcgcccgtcaactctccataaaggggcctctgtgtcaccctgtcactactcctgaagctgggttttgtggtcacagctttgagaagaacttcagagaaggagcatcacctggtccttctagaagatatggcatctgagaaaagattctgtctcttggcatagtacaagcttctctctattttctgtccagacccagtacactgtgcttaaggtgggcagaaaaaaaaatgacagcagttgcatgcacccaatacctagtcttaggagaagcaactctgagaagagccagttagagaaggaaatgcacctgcgcctgcacttgagaggctttggggcctctgcacacagaattattgttcttgttgtcagacaagtgcaggggatggaagatggtgtcacccaggccaccactaccaaagaaaggcagatgagagcccacccttctaatgttttttcactaagcggccattacacattctagagtggacctgggacctaagccctcagggaccccagtggtgggctggttttcctttactccactccccgtcacagtttggggatgttatcaggaagcattttaaaaaagggaataagatggacagagaaaggagattctggaggaagagaactgaggagggcttaccattaacattgagggtgtagtaggccttgtagctgcccatgttgctggtggctgtgcagccgtaggtgccactgtcactcttgttgaggaaagggaagatcagggcactctcctgggtcatcttcaggggtggcacactgccctccttctcccataggtactgctgggggctgtcgaggcagacaaatcagaagagctcaggagagcataggccagggagctaaaagaaaaaaaaaaataactgggagcagggatgtcaaggactgtttgatgaggctggagaaattatcggggccagagacactggagctgctatacgccaggtggcctcttggggttcgttctggggaagctgtagatctccagacttgtatcttactttaacttggcctttgtgggaaactcagggactgagttagggagtggccccttcccatttgtgctgctttgcagaagaactaattgcaggcggacattattggacagtcagggaaatgagaggctcaggtcagacaatacagaggagataggaaggagctgttatgtgaagaaggcaatctgagaatgtggagagtaaggaggagaccaggaaatggatcttcttacactggattgccgcgaccctcacagtgtagcaacagcttctggccctcacgaggatggggagggtctggcctaatcatcgcagttggtgtgtctgtggagaaggaaatggtatcaatgaatacctccccacacggcttaggagattccctcacttagttgcacactacagcttctacctctaaatgtttccgcagctcaagaagtgcaacaaagaccttccttctcctacttctcatgaacaaggaccattattgctattgaatatgtgagcaacttctcttgcaaccttgtgtgataggattctggaaggtctgtccttggtgggccctaagagatgtcttaacagaaagctgagaagggaaatgagtggtttacctgtgcctagcaaacctcctagcacataggaaagacctaatacatattttttacagaacaaataaagttgaacttgtcacatattgagctcacaa

SEQ ID NO: 38 - DNA, 737 bp, Homo sapiens
tgccacattggcacctatggggtggagccaggtagggcaggagctgagaacagccccagccttcaggggccgcccagcctccatccgactgcctggcctcaagctgggaggaggacccctggggatgcagcatattttaagatgttggttttaggcatggacatttgaatgagcagaatgtgtgggctgcaggctggggtgggagaaccgatgtccgcagggcaagagaatgctggtctctcttgccctgcggacatcgccaggaggctcttcctgcggccattgtgatttttagggtcagaaaattatttggaaatattttttattctgcaaatattttctatacattttttcttgagtgttttcccttagtatttagtaaaacttcttttgaaaatgctggcctgctgcacctgttctcagaggggcatgagaaaagaggattctcttcctagggctgtgggaagccccttgagatgttggaagcagggcagggcaggagaacccagggagggcacagagctgtggacgagggctgggaaagccatcccgcctccccagggggtctccgaggagtgctgctgtggccaaaccaggggggccactttgtgctttctgtttaggtgatgggatgcttctatctcctcagcaccccacaccaaatcccctgttattgccagatgatgtgcctaatgatcaaattgcttggaactcctaataataaaactttaaatcta

SEQ ID NO: 39 - DNA, 2463 bp, Homo sapiens
tcaattattaatttttgcggctggacgcggtgactcatacctgtaatctcaacactttgggaggccgaggtgggcagatcacctgaggtcaggagtttgagaccagcctggccagcatggtgaaactctgtctctactaaaaatacaataattagctgggtgtggtggcacgcacctgtaatcccagctactggggaggctgaggcaggagaatctcatgaacccaggaggcagaggtggcggtgagctgagattgcaccactacactccagactgggatttaagaaaatgtgtagttaaatattgcctaaaatgctcgaatgtaggttataaacaatgagaatagggcccatgaagagattttcgtttttcacagaggtgagacttaaaaaggccttgaaggataaatagaaatagaagcagagtagaagggttattccaggagaatattagtttggatgagggcacagaggcaggaagatggagcttagcttgagggaatggaggtcactggtgctgtgaatatttgcagacagccatatccagagctgagaggtgaaagaacagactggaatagttcttttctttttcactctcctaccttatttgcttttggtttagcaaggaggatcgaaagtaaaccaagagaaatggtggggggcagcagagggaggtgggagggaaactccaggatgagttatggtcagccaaaagaagctgttgaaataaaatgaccaagagttaatgcctttatagacgcagggatgcacagcctagatccccttcctctaaaggacttgctgcccatccactgaaagcttggtcagcagccagcccccagctatcggctctttcagggcctgccttgttgcaaagggccgcctccctgcaaagagctgccttgctcaaagagctgccttgcactaggtcatgctcttctggtggcagcttgcatcctgtcacagagaggcaggggtgtgaaagcacagccatctcatttgctctgcaggacaatatccactccagagttcctgctagactggccaagaccttgttgccattcaacttctttcccattctactcgctccctccttccttcacaggtgttgagccctaataaaattttgcacccgaaattctgcttcattatctgtttctggagaacccaacctgtaacattttcccagccagggctgaatacacacacacacacacacacacacacacacacacgtgctctctctgtatatatgtttctgtgtatgtatatatgtatgtatatttttaattacttttctccattcaatagtatactgcctatcaattattagcaaattgtattttcaacctgttggcttatttattctaaatatagccattttcctctaaagagaaatctttgttgccaaaagaattttataatggcaaaatcagtcattttccccactaatcgcaatgtaattttgcccattttgagatgggcaaaaatcatatgttcagaacagtaaggtgagacagaatcagctaatttactgataactgtgggcactacctgaactgacgtatcatgctgctacgcactttagtaccaggctctctggtggccagttctttgcaggataacgtggaataatgcttatgtaaaatatgacttccaagactaattctcaacttcagactccccactcccagcattattgctttggcattagtaatgttagtcagaaatatgagtaattcttggcaagaatgggaagcattcaacttgtaacttcaaaaagacattatctgaaaggttgaaagccagtttctaatagtacctggtatcttggcttcagggctcacagcaatcctgtggagaaagtatgagtttcccatttcaacaaagaaggtgaggcttagagggaaaggaagttgctcaagatttgctctggaacagagccaggattcccactcagatcttcgactctgaatcctgcaggccttcacctgtgcgagcactgagcgcctggctgccagctccagagctcctctggggccttggtcagtgtggtgttgtttatgtccagcacactttccgttggtctactggaggacagttcctgtacaggcagatgacttccttcaccaaggacctgtgactctctccctgagggctttctctgacatcatctgcacatggacagcttagactgaaagtttcaggggttcgatgccttccagaggcacctctctaacaataagagcccagattgagtggaaataccccagcttccttaccactccagcctccatgcccttagtggcatgattccgaggtgcatcctacactgactcttggtggctccctggccagagctcattcgcgtggccctcagcagctctcctccttccctggctgtcttcctcaccacctctccgtgattccaggaatcagctcccgaataaacgacttgcacccg

SEQ ID NO: 40 - DNA, 741 bp, Homo sapiens
atgccttcctggggtgaggacgctgccaggctcccagctctggagtcaccgccccgtgctaggggcaagagcccccaaggactgggatcaatattggaaacctgtgctttagttcttccacctctgctgctgctatgctgtgtgacctcaggactgggccgactgggagcaccatgtggagaacagagacaaactggagtgccttggggaggaaggaggagagcacagtctctgagtcagccatgaggcagagcaaatacaagtggtcatgcaggaagaagagtgctggttctgcggggtcctaagagggagatgtacggggggtgtgctttgttcaatatgacaacactaccaatggtttagttcttactgcatgagctttacatgtggtgtatctttctggccttgaaactatcctgcagggtaaaacaactgtcccccatcataagaaatgaaggtaacagtgcatgttctcccctcagcctgggacagcttcaccaggcaaattcctgctcattctccaggccatctccccagagaagtccttcctcaacctcaagaacacatcgagttctctgtcttctgttcccacaggaccctgcagtcacccctcctagctcttgctgtaacagtagacacatgatttcggtgtaaatatggacaggacaggaggcagggctggacactgctacatgccccagaacagtgcctgtcctatgatatccaaggaataattatcta

SEQ ID NO: 41 - DNA, 565 bp, Homo sapiens
aaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggagaaaaatcaagacgttcccttcagtcctccctcggtgttaacgtctgctccagctcgcagcccgctgctgggcattttattaatgcttttacgagttagaagagttgggataatttgccatctggagtttctctgccttgctgatctgagctcagacctgccaatttaccagagataattgat

SEQ ID NO: 42 - DNA, 733 bp, Homo sapiens
aaagaagcggagggaagcaacacagcgcagcgtgactacgtgcttgatctgtctcctcctaacgggcatgcaggcaacccaggtgccttaggtaagtgaccccattccctgccctgccttggagggccggatgagtcaaagagtaatcttatccctctgctagtgagtacaaatgaagtctgtgggccaacaaggagcgaggagcagtttcctggaagccctgggctggtgtttgacttgctttgagatagaataaatgggagaaagagactttatgggacatctgggcctagggctcctggatgctgtgctgaaaacaccacgtacagaagccagtctaaccttctggatgatgagagcccagatgcagtacagaggtgccccagccaacaatcagctgctatctgaatcccatctggatcccatctgaatcccatgtcaccatgaatgaggccaccttagcccagccagcacagctgaaagccagaagcagccgcatgcacaagcccaggggaagcccacagaggaaccaccagccaacacacagaattgcaagcagttaagcaactaagattaagacaacaattttaaaatgaaccaggtccggccgggtgcggtggctctcaggcctgtaatcccagcactttgggaggccgaagcgagcgggtcaccggaggttgggagttcgagaccagcctgaccaacatggagaaaccccgtctctactaaaaat

SEQ ID NO: 43 - DNA, 779 bp, Homo sapiens
ccgcttcctgggaagtaaggcataaccgagacctagcctcccggtagggaagttcatccgtttagtaaacagccccaactacgtgcggaccctcacggggatacgaagaattcaaccagggctggacaagtcagagtgggccaaggacaagtgagcattccagagaatttctacatgaccagctgttcattcttttaagaggatgacattcttcagctcatctggaaaggatacttcctttaagtctgttattcacagtctccaagggcaggtgtagttgggaaagacatttcatatggaaaaacaaacttgatagggtaaaaaaaaaaaaaatgagatgtaatctggaggcccaagtcattttcttaggagaaactcaaatgtgtttggtgttatctaaccttctgcagtttatcagtctgaaacaaatgcattctattctcatttgaaaatgtctgaacagccaccaattttcaaaatcacccatttaactagagactttaaagcccagaatttgcagttacgtatttcagaatgatttagtaattttgtgagcagctcagaggttaagtctacaatgtctgactacggtgcattattgaaaatatcagtagtgtaaggatcccgtagattggtgataactttgctcttgttatttcaacagttaccaccaacagttggtgacttaacaaattaagagcatagttgccatatgctcatatttggcaaatatgtcaaaatggccatatttgccaatttttaagacaataaattcacag

SEQ ID NO: 44 - DNA, 410 bp, Homo sapiens
gccctttttcacagcttgaaaatgattgttaaaaacaacaactgaaaatcaaacaactgaaaacatgagccaaatctattagcactgaactcctccaacagcactgatgtcacaggcccctggaagaatccacgttgttgacattactctggtcatttagttgccatgtagccaagcaaagagatggggtttgaccttgttgtccaggctggtttcaaactcctgagttcgagcaatctacccacccttcaaagtgttgggatcacaggtgactcttagaatcatctagtcaaaatggaattgtgactgtaagtgcactaagaaaagatccctttgggaagaatgaacttattttgacaaatatgttcaatatttttacatatttaaaatattgactctcacccaggaaa

SEQ ID NO: 45 - DNA, 571 bp, Homo sapiens
acggtgttctgggaggagttacgcaggcagggttgtggttgctggctgttaccaggacaaccggaggcgattgaccgttatctgcggtttggagccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcct

SEQ ID NO: 46 - DNA, 705 bp, Homo sapiens
gtctctcctgccaccatgtgaagaaggtgcttgtttcccctttgccttccgccatgagtgtaagtttcctgaggtctcccagtcatactgctggttaagcctgcagaacggctggtcttgaactcccagcctcaagccatcctcccgccttggcctttcaaagtgctggattacaagcgtgagccaccgtgcacagccaagacacaattttaaatcgagcggtcaggaagcctcctggagaaaatgacgtttgaacaaagacatgaagaaagtggagaatatttggagaaaagcatttcaggcagaggaaagtgccagggcagaggccccgaggcaggaggaagcaacagaaaacagggaagcaggtgtcccaggaggagcccaatgccatggaaagatgggaaaagaggtggtggatgagatcctggattcttataaactttatctactccacttgcacagatgatggaggatttgaggagtgtcagtgaatgctctgtgtggactgaacttggagcagactggggctggaactctccagggagggcaactttgaccgagacatcttagggtttgccaagtcctcagcagatgttttttgatgtgccttgagatcctcaaatgagaagggcagtgggattcttccctctccagccaggaccacatctgtgcttttctgtaattgtgtaaaaaaaaaaaaaaaaa

SEQ ID NO: 47 - DNA, 1266 bp, Homo sapiens
gttcaatcccaggtcgttttccctttcagctgcaatgccgggattttaaatagcagagatgaaaggcccctgcccccgcctccctcctcccctgagttcatgtattatgaatgaaacggcagcctcgctgcttcctgaggtgctccacttcaggctggggtgcaatggctcgatctcggctcagtgcaacctctgcttcccgggttcaagtgattctcctgcgtcagcctcccaagcagctgtgaatacaggttggagtgcagtggtgctgtgtctggagtttgttcctgccgttgggtttgtggtcttgctgacttcaagaatgaagccacggaccttcacgtccatcgccttggcttagtgcatgtcaccaaaaattctccaggaatttcatagtttggaccttggtggcatggctggccctggattatccatgcagggaggcctgatcctgtgacagctggctgcagcagggggctgcccatcttctgtgctttgtggtacatatctgtgtcaccaaagtagcggcctcggtacagcaagcctttcatctgctgcttctccgtccagcagttgttccagaggttggcgatataatcatctttcacattcggtttgactgtttggaggctggagcctgtgtactcctcggagaaaatgcctgccacatagtagatgacactcaggtggtcagtgactcgcctgtgatgtggcccacaaacagtcttgggctcagactgtagggtggactggagaccatgagctggctgagagctgacatgaggatgaggatgggtatcagctgcacgaacacccgcaagctgccgtcactccgcttctccctgcagccctgcctttgctgatacacacacaggcacattggaaacgcagtagaaaatggctgccaatttaaaaccagaagttaagaagagcaaactcgaatgtacagcaagagagcttcaggctggactggcttccagcagaagtgggactggaaacctcggattctattgtctcttctctgtgaagtgggaaaacatgtcagtatctgaacttgagcttggtaattactgctcatttctcaaccttttccaagccacgtaactcccctaaggcttagttttcttatctgtgaattgcgagatggtatgttcttcatcacgaggttgctataaagactgaatgagataatgtgtgtggaagcaccaagcatggtccttggcatgcagtagatgctcaataaatatgaactggagtacacatgca

SEQ ID NO: 48 - DNA, 448 bp, Homo sapiens
tgatcctcctactttggccttaacttcagatgttgccttcctggtgtctgggcttccgcagctgctgcttcttgaaatctgattagcaccataggactgacagtggcataggcattgaccacaaacttgtggacactgtcgatgacagggctgaatacccataacagcattttggaggatgagacaattaagtccaatgagtacataaccacgaagaaactcaccagcagcaagatggtcttggtggcccttttctctggggaggttcttaataaaaagctagtgctgtgaaggtgctgggagcacctctgatgcctggacaagagaatcaccatgaaggcacttgagagcggcatgattcctacaaggaagacatctctggataacgacagagtaacaaacagccttctgatggtgacattcattggggaaagtgagcagtatttac

SEQ ID NO: 49 - DNA, 2781 bp, Homo sapiens
agctggggttcttacccactccagtgactgcctctcagaaaagaacagggcaatgtccattctccttttattttctttaagcacctgatcattctaaaagcatgtgttcctccgtgtgtgtgagttgtgtacacgtgtgtgtgtgttcctttcttttctcggactccaggctcatgactgcttatttgcatggtgttttggtgtcaaaggagtgttgaatgtgttctccacacacccagctttattccactctaggagtttaacttcttcagcattgttatgaggtccccggtgacctcagtttctcctctccgcgtcatccaggacttcacctgaagcttgagctacacgtaagacttcatctaccttgcacagggcaatggagagaggatggcataccagaatcaccagatgacagacatcggggtgctgtcggacccgggaatcagaacctctgcagatagatattttggaaggcgctccctagattggcacctctggttagaaccctgcccagggactggacaagttgggcccatggctcatatctggccagtgttcattgctttgttgaatcacacttaatcctttggttttggtagattcctgcaagtagactgacagctgcatgtttgcaggaaagttaaatattttgacagcgcagaagactgctgcatctggagggttctgggtccagctataaccagacttgcctgtcctaaacaaatggattgactgcttccggcatcctcactttacttctgcatggtgaccaacatccggagcttaattacctgacagccaggaggtagggggcaaaggaaaccttttaatttatagtaagaagtgatcagttccttttttgggtcttagttagaatccaggtgcacttgaaacaataaaaccttgtatatagttttctcctataagaaacttctcagatatttaccaaaatcctggaaaaatatatattggtcaatataccacaattcccacaagaggtaaatatttacaaaatctactttgggcggtgatgctgcaagaatattaaaaggcgttgactttatcgtcaagtgaattatttcttaattttttaaaatttaaatcacagtatatttgacaagctacagcagtaggaaaacacctttgctttaaacaaaactaccttttctcagcaagaacagttactagagtgggaaataaggttaatttcagttttattaataatatctgaaatgaaataatgttacaactctcccctctaacctcgttgctagacaacttagaatatttatttatttctccttcagagaaaataagagtggatgttacctttaagcaacatacacatttaattaatgaacacaaggaaaatgattccggttgtagttaaatcgggtacaagcatataggatttaagagatctgaccttagaaatgaagaaaatattattgtaattactccatttgctaaaaacaaatgatgtggcatttgaatttaagacttctatcaaaagcagttgagtgtctgtaatcagttctcacctttacattttaatggagttgaggttgagccgttgcatttacaattatctaggctgacttcatgcctttgaaatgacttaaaaagattagcattcatggattatttattagctcctcgtgaacgtatttccaagaatggaaacaacgtattgcatcaaagtctagtttccaagtttaactcttttaatgaacagcatgactgtacgatgctgcaaaaggcatctctgaagtcacaggacattttgtcatgcttttcccttcaagtgcatctttagtagcagtctttgttccttgcaagctcagggagaatgttgattccagccctggcagctgcccgagatgccctgtaaacactacggctagcagaaagcaggctgctcaggggggcaaggcagctgatcccagcctgctgtagctatcactgatagggaatgcctgtctggggctcggcagagaactcagtgacatgatggccctggcagtttaacccaaacacacttttctgcctagataacaaaaatgtcatgcctgagtccctgatagcaaccccagaggagctccaggtttgaggcagcgctggcaggacgtggtctatctgccatctgaagcccttcattgcccgcctggctgtgaatctcacctcctctgtagtggaaaacaggctgaacagaactggcaggcaggtaagggacagcaaaccttgcagggagggcctagtgctgaagctaagccagccctttgagttcaagctcaaagacatgtgatgccagctttgcaggggagctaagattcttccgagaaaaagcagaatgagagagagatatgcagctgcagtggaggacttggaagagaacaacgccaggtcctggatcctgcaagaatctcctctggaaaagcaggggagagaaaagcaaggaaggaagcagggtcaccgcaagtgtgggatttgtcttattaaaatctgatactgtgtggcagtttgcttcactcttggtataaaatgtctgagctccatgttaaagtaaatgtaagtaatataaatctgcctttcctgaggtgaaaatagatccatattatttaaaatatgaactgagatagatgacagttacaaacattatacttgttcttattataattcttactaagctcaaggaataaaaactgggatgatgaaaaagaagttctgaatgtaaaaattggtgttttggataaaatacaaaccaacccagaaatgatg

SEQ ID NO: 50 - DNA, 559 bp, Homo sapiens
ctgctgtcgataagataaattctccagtagacaacctctcccactaattgtgtattagcaacgtattttatcttgagagcttgtacactgggctctcaacgtggtgtggaaggtagcctgttacagtgctggattcataaaagggcctttatggtttgtgaaagaatatctgtgtgcttagggaggaaactttttgatctgcagaaaagccagaagacatctaggacatccataaaaattcatcagagagcattttactactgagctgcaaagggaaaaacttaaaatggatatgaaaagtgaagaaagtgatcataggagaaaaccatttcaggtgtctgatgatttgtgagcctcaagtgactactctgtggaatcatctgtccttgcctttgaattagctttccctaggccatgagtcaacattagtagtttatacatccaaattgatgacaagagcacctcaaaggcagcagcctcaaggagcagccatggccccagacttgtcgcacggatgcagaaaacttaatggaggaggctgaggtcagaatgggaagag

SEQ ID NO: 51 - DNA, 3996 bp, Homo sapiens
tatgagaactgtaaatatctgcagacattttctctttcctattctaaaacttactaaaattttagatacaggaattctctgttgaaaaaaatatatatatgtatagatagatacacacgtatatatatacgaaatgtgagaaaaaatatatatatatattcctttgatggtctttaatatttagtttaaaaactttaaggaaatcataaaacttttaaatttcaactctctctaagattatatgggcagttaagtttaaatatagagcatatatttcttcagttaaaaggaagtgtgtatttactgctgttcaattagaaaaagcaattaacacctgcctaatcataagctacactgttttttatgtttagattttcaaaatagagcttgcccataaggacatctacctactggggaacatagaattattttgaaaagtttgttaagaattggctgattacttgacctaaggatttaattcagcatgaatacacaaaagaaagaaaatgtatatttgcttgtgttcaagtctgaaattaagctttggtctacggttaaattaatacagccctgagaacaccttgtcttaacttcctaaaaattaattttgagaaatagatttaatagtaccaaggtacattgttgttataatgaagaaggcgagaatagtttttattaccttaattgacgcgcttttataaaacgtcatttgcatctggattctaaagggaacgtgaattatttttgcacgattatgatttggagtaatattgaaatattaaaaaaattcatccttttattcttaattgaattccaatgcagtaacttcaaaacaatggaaatagcatgaggccagaaaggggaaagggagtagttgacactttgcataccaccagtaacatggaataggagggatgctacaattataggatgctactaaatatgaaaatttattcattaattcagcatttgtacactgagcatctactatgtgtcagctatcaagtatgtaatgatgagcgaagaaaaaaaaacaaaaaacaataatcaacccaaaaagtaatactgtcatgtagattatagcattaagattatccaaaacttaaacattctacaaatagatgtgaaattaattacaagtgttaaagtgttattactgctacaaaagaaaggtaatgttttgcaagatcatagaatagtcaacttaaccttgtagaaagatcaaggaagtcttcccaaggaattaaatgatactttcattatctttgctttacctgtgaagagctgaagtacagttaaataacttgctaaagttttcacaactgctaagtgataaagacaggactgggatccatgcactggtgccagagcctacaatattaacccctctaatatactgtccgccactgaattccttactataatgtcaagagtttattaggcaagcttcatcaggttgactaagcaatggtcatcaagggaacagtaaagagaggttaggagagaggaataattagaattataataactcaaatatgcagcaacctcacgaattaggaaaggaaaagaaaaagaaaaataaataaatgtataactagccttgaatctagtttatggaaataagtagttttcatctaacagtctgcataggaaactacataagctcaattcacagaatgaagataaatgattattaaaaataatcctcatctatgacagaatactttgtgcccactcccaatcatatcatttaaagctaaattaccaaaagcatgtcatttgtctttgaatttcaggtttattaactgtataatggcaattgaattacctttcctggaattaaaggtaaacagtcttttccccacattattctgaaattgattttgctttgaagataacatgtacacttacattgtgtttctgtttcatgaaaatctattgttaatgctaaatattttaaaataatgttttcattcattaattcaatgaatacttagaaaattctattgaagatactggacaaaattaagagaggcataattttggagcttacattctataggaggagaaagaaaattaacaagtagaccaagccatgtataaatacaatttatgtttataattgaatatggaacatgcagaagccattctcaaatggataactctagtctgggtggaaatcaaacatttcttgcccaatgtaccaatgagactgtaccataataatgtgtaaatattcctaatataaataatagtataagtaatatttgcttcagtgcttcaatttcttaatcaaatacactaaagaataattgtggatctttaatttctacattttacatttactttgctgaataattattatatttataatattaccaatatttaataacctactctactgtagtagggcttctacggtaggaaagctaagattgtaaatcctattataaagttttgtttttcccttaagcaaaacaactcctattttttttgtgtaaactcatttttctacaataattggatgttttaaagagacatagttattcttctggtattttctattttattttttcactgcaaattcatcacctcattctgttgactggatcaaatttattattaatgtatcacctgggctgtcagtaatttttaacatgtcaatattttccagtatttctagtaagtatgctttaccagaaacatacatattttatagtttttctttgcttcttaaattttcctttatttattttcagaagtctttgtctttcttttcactgagaaagtcaaccatggtttatgggtcagcttaattttttacttaaaggaggtctttcctaattacctaatttaaattgatatccactcagattgttctgttttattgtatcctaatgttttccttcatctgtcacatttcaaaagtattgcttatgtaagtcctcaaaagtattgcttatgtaagtgttttagcatacacttttcctaccacttggagtctcatggtcccagtgactacgtgggttttgttcactgatacatgcccagtttttagcacagtgccttgtacagagtatgaaatatttttcctgtaaagaaatgagtgttggatgttacagtctgtgataataaggaaaatcctgcccttcatttgttactttctcttgcataagaaatacttcactattatttaccttaattcttatctcaattctaatatgcatgctggtttgtgccattgctaagctcttttaattgcaaaagacaagaatatttgtttttaacagagtaatttgttatgattccacatcctccaacagtgtcatggtacaaacataaaatataatagagaacaatgaccaacttttatctccttattctagtttttatctccttgtgaattaattttagaactcaaaacttagataaaagtatctatggagatttcttccttttcattttactttacctaattttattggcttgaaagacctcattgtgcttaattaatatcagtgatcaaatctattatgttcactttcactatgtaggtctttaaggggtaccaaccactcaaatagtcaaaaagtccatgtataacttttgactaacccaaagagttaactactaatagcctattattgactggaagccttaccaataacataaacagtcaattaacacatattttctatgtgatatgtattagatacagtattcttacaataaaataaactagagaaaggaacatattattaagaaaatcatatgaaagagaaaatatgtttactattaagtggaagtggatcattacaaaagtcttcatctttgtcatcattttgagttggctgaggaggagaggaagaggaaggattggttttgctgtcccaggggtggcagagggggaaggaaatctgcatatgaatgcattcatgccattcaaacctatgttgttcaagagaccactgtaaattaaaaaggcatcagattttt

SEQ ID NO: 52 - DNA, 2008 bp, Homo sapiens
gcttgggtgcaatggccgctcaaagggcgaggcttattcgaagcctcaaattcagaaaacccagccagaccttggaagttaagaaggtggaaggcagatcgcggaaccagtgttctgatagttgtggttctctgagggaagccaattctggggaccggtagtggaaagctcttgcgctgtttccggccacctcagcgggaagcggagacgcaagcagctggatctccggtaactgagacatagggtataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacagtctggccgggaccttcaacagtatcagagtcaggctaagtaactctttcgaaagttgaatgaacagtcccctaccagatgtaccttggaagcaggagccatgacttttcactacattattgagcagggggtgtgtgatttggttttatgtgaagctgccttccctaagacgttggcttttgcctacctagaagatttgcactcagaatttgatgaacagcatggaaagaaggtgcccactgtgtcccgaccctattcctttattgaatttgatactttcattcagaaaaccaagaagctctacattgacagttgtgctcgaagaaacctaggctccatcaacactgaattgcaagatgtgcagaggatcatggtggccaatatcgaagaagtgttacaacgaggagaagcactctcagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgtcctgaaaatgaaaggttgcacctcatttaatgaagcttaaccctatgtagaaagtctctttcgggggcagaggctttctctgggtgccaagccatatatattagggaatagtagattgttatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttgtttttttgtttttttgttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagtgtaagagcaagtataggatatggagaggcccctggcttcatgagaacaaaggcaggcccaggttataattacagctttctcctgccccttctttactttctctaccacagttttctccgctgtttgttttcctcttgccacaatttgctaacacttaaaaaattttcctgcacccagtagtttcatatcctgtagacatcctcttaggacattctcaaatttcaaaataaaaaatattcatct

SEQ ID NO: 53 - DNA, 2315 bp, Homo sapiens
taaaaaaatacttctacctttattggcattgtgtgtggaaaaagtggtctatttaagggaaatacaggctagtaaaatatttgttatttgcactaggagataatttaaggaacaccttctcaaatgtcatcagacttactttaaaggcaaaccaagtccaaaagttctaaattgagaaagctggaagggaaacttaaatatgatccaaccccctgttttatgaccagaggggaatggattggccaagatgtcggggatggttaataggacctcaggctcctggtcagtgtggggcactcagacccatgagtctagaaagcaaagaacaactggattcatgtttcctatgtcagagtccacccagttgcagttccacctgagtccttcacagacattaaaggtaggattcacatcatggaataagcatttttctactagcgatttgtttaataaagctttattggaatataatttgcatgccataacatttccccttttagatggaaataatagacactgggaactccaaaagagcagggaggagagggagggttgaaaaattacctgttgggtataacattcgattgtaatcagtttccagtgttttgcattcctaccagccgtgtaatgcactatgaacattcatttgggggatgaataccctaggagcccaatccccaccattacatgtgtaatacccatgtaataaacaagcacatgtaccccaaataaaaaaaaatccccttttaaagtgtgtcattcactggttttcagtgtattcacagagttatgcaaccatcaccacaaaccaaatgtttaacatttccatcacccacttagccccctcaaagaaatcctagacctactagcagccactccccattacccacttccaggctctggcaaccacccttcagcttccagtctttatagatttgcatgtgctgggtgttttcatagaaaaggagtgtgtgcccttttgaatctgatttctttcactcagcagattcatccatgcttcagttcatccacgttgtaacatggattagtacttcattccttttcatagccaagtaatattccactttatggctatactacattttattgatgtacatttgagttgtttaccctttttggctgttaggaataatgctctgtgaacatttgtttacagagtttttgtgtatacgtatgttttcagtttccttaggtgtacacccagtagtagaattgctaggtcatatgggaattctgtgtttaaccttttgaggagctgccagacggttttccaaagtggctgcaccgtttgacattccctccagccgtgtatgagggttcgctttctccacgccctcgctaacacctgcgattttcttgttatgtgagccttctcgtgaatgttattccactgacattaatctcatggcaccgtcagtgattgaaatgatcttcttgttctctgtcttcgcctctggatcatgaccttcccgaggactgaatgtgtcataaaatccccagtctctagcagtacatgtgtattgagttggatcacatgctgctggacccatggcttgtcatcatgtgtacatgtagccgactttgactctcaactgtgtcagttctgggctagagactgttactttatacaaagagagataaactgtgtcccttgtcctcaaataaataggttggactactagggtatttacaaaacagagtgtaggtgaagaaaaggaaatttcagtgacaaattaggaggcacttaagaaatactggacgttttcaattaatttggcaaaatgaaaagtaatagatacatttccttggttgtggctgtgatgggtagagacagtggtgctgaacctcgctcacacatgtgaaagcttgtctgctccagaagtagaagagagccttccagttgctaaggctctgtccagggccgggctcctgccaggtggcaggcagaggcttcctcaagccctgcgtccctcttctgggttcagagaccactcccaggcttggttctatcagcacactccatgcatacaggtgcagaatgctctccccggccacccgagaccacacctcagccaggaccttgtgcagagcttgcttgggccaaggtacacgatccaggaaagctgagctcaagaaaaatgaatccaatgctggatgtggtgactcgtgcctataatcccagctaattaggaggctgaggtgggaggattgcctgagcccaagagttcgaggctgtgttgagccatgattgcaccaccgcactccagcttgggtgacaaagggccatgtttctt

SEQ ID NO: 54 - DNA, 735 bp, Homo sapiens
aagtatttgttttcaggcaaaagcaagcctccaaaagccccttggttcttctctgtgtgtctcgccccttctgccttgtacaccagactgccggcaagcaagcggggaggtggcgaacagctgggatcctccagtgaaaagtttgctcagcgcgagagatgtcaagaggctgggattgtcgcctatcgggagaagaattccacagatgaattggttctgccctgtatctttgaatggtttttattttctgatgtccagtgtggcagcctggcagagacatttagttgaaagaacacggggctctggaaacaaccagtcctccttggttcatattctcgtgttgtcacttattaaccgagtgacattggaggtgatatgctgcagtttatcactgaggtcctgagatggtccatactctaagctttgtgtctactgtggggggcaaagggaaaacttcccccttgctctctgaagagtcattgaaaatcaactgacaaaagaatctaaaatattcctggaaatggagagtcctgacatgatggccccatgatgaaaagaacccaggttcctgagtcacgacgtggacatgaggcaccaaggagaaaacacgtgaaccttaataagtttgggggtacacctccttgccatgtgttaccttctgtcatgttatgatgcagcaagaaggccctaatcagtggtagtccctcagtcctggacttctcagcctccagaact

SEQ ID NO: 55 - DNA, 995 bp, Homo sapiens
gacggggttaggcttccggcgtgggttgtgtggcctctcccagctccacgcgtttctgggcgccgggcactaggcgagccggccgggctggcgcgaggccgcaggcgggaagagtccccggggtcggccccgaagcggctctggaggcagtagccggggacgccgaggtcagggaggaggcggatccgagcgcggtcccgcagggccctgtccgttcttccgcctcggccggtcccgtcaggccgcctttaaatgcccggcgcctcgcacctgctaacaaaacgagctcctgctgttccccagctccgtaaatggtgcccctggccctccccagttctcaggcagagccttggcggcctccctgacccctaacaccccgcatccagcccggcagtacatcctgttggctgtgccttcgaaatttccccagacctgacctcttctcccacctctgccaccaccctgctccgagccgtcttttcccgccgagatgactgtagtagcgtctcagctgggtctccccgcttccaccttcccctcctgagtctcctcaacacaggagccagagcgatctcggaaagtacaggaggtcatgccccagtgtggttcccctttcctgggtttaagtcaaggtcctcaccgtgcctgccggcctcccgggtctctgcgcggtggactctggacctccctgccccgtcctgcctcagggcctttgcacctgctgttaccgcggcctggaacgctcctcccctgaaaccctgtgactcccacttagtgaggcgaccacctgttgaaaaccgtgcccccttcctatacagatgctcctgtcatatggggttagattccccatcaacccatcataggttaaagcattgtaaggcaatttacggtaggtttatccggatgtaaccccatctgtaagcggaggagtatactgaatgtgtatggcgtttgtaccatggcaaagccaaaatgtaagtcaaactcgaagtcca

SEQ ID NO: 56 - DNA, 583 bp, Homo sapiens
aacttggaaaccgaaaactcggcggccgaggctccgtgccccgcgcgcagcgctgctcctgccccggccaaggacgcacgggccagccggcggaaccagaggttttcagtgatgttgagagtcaacaggaaattaatcagcaagtagaaaattgaaagaagatctgcatcttactgcaggagtcattaaaataaaagcagatttggcaaaatggcaagaaccagaggatgaggatgtaaaacaaaaacttttggagtcattttgccaccaggatgaaaataggatgaagctgacatgacaaaggtgcaggtgacagcttctaccttatgatctgcgttccagtcagcgggaaggagatggggtgggaatgtgataaaccacttcccttgaaggacattttccagaaggtgaatgccacttctgtttatatcccattggccagcacttagatttatttccaagaagaaaaaaggagaacagatatcatgttgaccagcagtctctgccacagacagctaatctccaccttccactaaggctgagaaattaccagcatgggaggaaaaggtggtgcagttcagca

SEQ ID NO: 57 - DNA, 875 bp, Homo sapiens
catagtgagtctggggacccaagatcttattttcctttctgtcacccccgcttggttttggattccgtgacagctggacccggcttctgcgtggacataattggagacactggttattttaccaaagctttgaccggaaggatgtacttttggatacaaacagactgctttaaggagtcaaagctgacttatgaagttggcctcatcccttgtctacacagtcactgtacagagttccttgcctgtagtatgtaaagaatgtcactttctgacaggctcaggagccccaaattatcctgggaccttgaggagaggacattgcccaatttatataggtattttcaggcaccaataaatcatggctgggctcaaggctttaaaaaaagtcaaatctgggattcgttatagaataaagttccagcaaagccaattttaagacaggcctatatggcaaataattattcgtgctgacattatgcaaacactcaggccaagtataagatgaaaaattattttaaataaatttgtcctactatgatttgtcttcagtaaaaacaggtactgggctgggcatggtggctcacagctgtaatcccagcacactgggaggccaaggcaggcagatcgcttgaggtcaggagtttgagaccagcctggccaacatggtggtgaaacaccatctctaccaaaaaatataaaaattagccaggtgtggtggcatgtgtctgtaatcctagctacccaggaggctgaggcatgagaattgcttgaacccaggaggtggagcttgcctgagtcctggtaaggcacagacagaaagggttgtcagccatttttttctgaggttataagatctgcaacttccccagttattc

SEQ ID NO: 58 - DNA, 491 bp, Homo sapiens
ctggcctggtgaaggaggcacgaggaagattgcagtcagggacgctcagcctgggagctgaccctcagatccagggatcccagcagccttagaaagctgatgatgccaggagcggggacttgcctggggctcaagggaaccattatgcctgtgctgagatgaaacgtgtcccactattcctggatgtgtacagaacccgacaccatggctatgagtacctaccacgaagaaacagtaacaataactggactgtcaatactggatgtcttgggagcttaagagacactgttctgagtattttacatgtatttgtcagtggctgttcccatgcaggaggccctgggacatgcctgctactgtttctttctgctggtctgaatattttacatgtattatctaatttaatcctcacaacaactatcatacttatggtaattatattatacccattatgcagacgagaaagaaggtagttgggattcatacttgtg

SEQ ID NO: 59 - DNA, 756 bp, Homo sapiens
ataaggaaataggtgacttgcggccaggcacggaggctcacgcatgtaatccctgcactttgggaggccgaagcgggcggatcacgatgtcaacagatcaagaccatcctggccaacatgaacatgcttctagaactttcatctattatgaaaaaataatgcatcaggagcagctggtacctgcaggaggagagttgtgcctttgtcagctcaaactgcaggaagcgctttgggacccacaccctctacagacacccaccaggcgaagggccctgttcagggtgctcccagcctgggctcacttccacaggagacccttcccttatgggggctggggacaggttctcaccctgcctgggcacactgcttgagggaggtctgatgctcgggcagggaggagctgtacaccgtcagaggagatctagggacaagagcggctctgcctcgaggaggaggattggtatatgtcacctcttccccagtcccagcacagcctagtgggatattttgcaagacagtaccccagctctgcagtggcagcaacagtagcagttggccccttaaacatgggtccagagcaggactggagctttgtgctcagcctgaggtcagatgtgcttcctgtctataaaggagaggttgacaagaaacttttcaggcttttcctctcaccagttcatttcttgaggatgaaccagttggatttttaattcatcaatggcatggaaataaaatattgattaaaacactggcaaa

SEQ ID NO: 60 - DNA, 3510 bp, Homo sapiens
cctggagagagaagaatgcaggcagcattttcaagctaatcgtttattggcaatctgtgatcacaaggttgagcaccaaatcggagtcattttgggagaggagagaagctggactccaggcatgacccagacggagctgatcctcacacctccgttgaaggcagaatatctttgtgcacatcagcttcattctgcagaccagctttggctacctggaacactgttcaggattccaagacctcgggctgcagtggaacaagacattgatctgagattaattatgaccagcaaggatcaacacctgtggatggagaggggaggggagggtgcaggcatctcctgtcatgctcattggtcagcttagagacttgcagacctggcactcgccctagaggaagcagtgtagtgagaagaaagccagacttaagggatgttggcttctgtttccagctctgacacaccgaccttttggttagaagaagctcaactagaagacttagatcctaagagcttcttggggatgtagaacaaagtctgcttccattagggcactgcccttttgaaatgatcatgtagataacatgcatttgaacaattggatcagtttttgagaagtgaatgtgtgtgtgtgtgtgtgtatgcctgtgcagactgacaggatatggtggaatcgaatccctgctgcagagttttcacatttacagctgatcactgcattaacaaaaatgtattgatcaccaaactgacattgtttagcataacaatttttcttcaaatgattactgtgttagcaaaaggatctcttgggttcaaccttaggccagtgtttgaccctgagcctgttagaacctcatgtgtcgtatctggacctctgagagctgggggcccctttgtgctgtaaaccagtacaatgtggtgctcttgacactaggaaattattgaagacccccaaagagcttttggttatgtatctttccaaaaatggaaagacaaaaaattttaaacatttattaatgtctctaccaattacaaacccattacatgttatcatagcaaactttaaagaaaaatctttttcaaaacactagtagaagagtaacattgttttacattttggaaaatcacgtctgccttctccattcaatgtgtgaaatacattttttttttttttggaaatacataaagaaaatggtctcccacagattcacagttggaaaaggaataagaacttgaatagcgttttcagagaactggatttttatccttggcactataccaaaatccaacaagtgaaaatttcttaaaggttcatgcagtgtgaaatctgaaaccctatcaatgaatctttagcccccctgtcaaaatccacttggaacacaacttttatctgtgcacaattttgtgccattatttgattatttgaaaaaaagtgattcattgagttatgctaatctttcaaatgtggacaaattttggaaagtatttttaaaaatcacatttctacaggttaccaccaatctcgacagagacatcatttaactgttaagaacccactaggctcacggaacttgcagttccaaatgaatattccaggtcctggggtgtgtctgtcctcatgctttcccatcatctgtcttgtttgccaggctgaggctgagttgcatctacattttggtttgagaagaggcagaaagtgtggcagaggcacacgtgcagtcttcagggccacacccccgccatgtccactcccattttaggaggaactgttagtcagatgcagaagacgtaggaagacaagccacagttgtatggttgctgcctgtgaagcagtgagccacctgtccctgtgtgcagcaaatggatggcagctcaaagggttaaactgaagataattgaatgaagggaccctttggagaggcgcaggtaggattaaggaagccaggaaggggtggaagcactcagaaagtagctcagaaggaagtcgttcccagtgctaggcctgcagacacaaggcggggggaacctgtacccaccaagaatgggagccaagagtgcgaggctgaggtgtatcttggagcctcccattggcccaaacccaacaggagccataggaggccctggttcacagagcccctccccagctttgtagctgccaccgcttggcaactgcccttaggtgcacagcaagactgaataaccacagtgtccctgcagatgggggcagtcctgtgcacggcctccatgaaaccctcactgtccagctcccgtcctgtggctccaccagcttcagattgcatcttttgtcgtcatgctgctgcctccacatcccatttgggcagctcgccctccaggatagcatctgcattctgggaaggaaagctgagaagggaaggtggaggaggaagcggttagtgcttagagtagcaaagctttttttgtttgtttgtttagacggaatctctctgtcagccaggctggagtgtggtggcacaatctcggctcactgcaacctccgcctcccaggttcaagcaattctcctgcctcagcttcctgagtagctggaactacaggtggtgccaccatacctagctaatttttcctctttttagtagagatacagggctgcgtggggattacatgaaatactccaagtaaagccctaaatgaatacttgacccacagcaaatataattaatattaggaattatcattgttttagtagatgtgaaagaaaggctgttatcaaactataagtaatgtatacatgctagttaccactgtgaacacaggacatgaaataagtatccaattagtgataatatacaatgaattgtgactgtgctcccagagaagccaggtgaaggccaggggaaattcagaggaccatctctggctgggacatcagggcaggcttcctggagcaggaggtccctcaagactggagaggacactttcaggaagtcaaccaagactgaggatgtgactgacattcctggaaaatatcaaggtggaatttagtatcttccagtgttcttacatggaatcatttgttcatttctcctgtggagattaaaaaactacaaacctcacattctttaccataaaaatctcccatttttaaaattcttatatttagtcctagatttctgtgagtcttcctcatttgcccctggctatcatcatcctacataaaatcagggatggttggcatcctaactggcagctactaggaaaaggaaactgagagaagataggattctaaagctgccactgcctggaaaatcttgttagataatgatacaagttaggagcattgataacaacacgtttttcacttactgaggtctaagttttgggtcatccaattgtcatcctactctttaccttgtcaccacaaaaatgttcttgctgggtgagtcggaatgtattaattacctatcaaacaattgaatattatatcaataaattatgtaaatattaatattttaataaatagcaatacaaattaa

SEQ ID NO: 61 - DNA, 402 bp, Homo sapiens
caaatactattgtctcaattttgtagaaaaatgaagctcttagagatgttaagggattggccaaatcactgtcaggtaaatgagggtgttgggttttgatctctggcctgtcactagacatcatgacagtatcagcagactgtctctcgaaggcataggactgtctcctctctgttgattttgcactgcacgggacggcctcctacttacgctgtaaacagctgcattttagtctttagccttgttagatctcattgtcagaaaaataaataaaggcaagaggagcctgggctggcggtcgggatcttttccctccctccgcgcccgccctccctctgtccttaaggaaatgctaccagacaccccccaccagacacgctcagccttggcgaggagcggccg

SEQ ID NO: 62 - DNA, 993 bp, Homo sapiens
atcatgcttcagttccctaaaaaagaaaacacttctcctgtgcaggggaaattgcttcaatggatagattgcatttaaataatttaagtataaaattactcgaacaggccgactgatatttcgaaaacgaaacagtcacaatcacttaagaatgctggcaaagttcgtgatttggtgtgtagatgagagaaggatggatagagaaaagcatcattacaaaagtgaaatgtgtgaattttattctggctttgaacattgagtagacgaagaagacaattccagacggaggaaactccacaagaaatatcatggaaatttgaaagaacacagtgggcttgggaagagagatctcagtggtggaagcaccatcatcccaaggagacttaggacattatttgaagagagttttcccctgaggaaagtgcttcagaggagaaaatacaccagaaaaagacaaggccctgctctgaggagtgaagacacaatccagcaggcaggagggatggctaagttcaaagtcttgagaagtgcccctcatggacaccccagggtgcccatctccaggttaccaccaggtgcttccaagaccaagataaccaggcaatcatagtagatgcatcaatgcacccttgcccaagggcctagacaagaggaggaaggaaaggaggagcacgtgcacaaagctaaggaggtgattaacaacatgatacagtattgtttagcttcgcatgaattttatcaccttgcctagaaccagccaccatctgccagggctcctgactttttctgaaatgaatagacactaaagcctgctggggaatttcatggaaatcaagatgactcaacccagagtccatttcaaggctaggatgctagaggacgccaacaaaggagtagggaagtgaaacggatcagctcacatccaagcccttgcatgatcaatcctgcagtaggagtgctgctcagttgggactcatgagagcccggaagagg

SEQ ID NO: 63 - DNA, 479 bp, Homo sapiens
agccccaaaagttacctttgtcacgtctactgtactctattggttatgcatgttctgttggaggaaggagactatggaacggcatgaatatcaaaaggccatgatcactggagccatcttggaggctggctatcacaacactcacctcactgctatcagagtgatcccttaaacatgaacctgtctaattaaagtggaaatggtgaagatacactgtggatagaggaattgagaagaatggtggtgaaggcctgaaagagaatggaagataaagcagcaatttactatgggcatcaaacagatacgtcgaatgacattgagggtttcactgaagaccagtggactcaaacttacccaatatggccactgttctctcaaaaaacgtgagcaaatgacatctggagctgatctccaatattttagagaaagaattgaaaagaatttttgtgggggaataaaattttacccagaaagtaaaa

SEQ ID NO: 64 - DNA, 318 bp, Homo sapiens
ggatgtgagggcgatctggctgcgacatctgtcaccccattgatcgccagggttgattcggctgatctggctggctaggtgggtgtccccttcctacctcaccgctccatgtgcgtccctcccgaagctgcgcgctccgtcgaagaggacgaccaaccccgatagaggaggaccggtcttcggtcaagggtatacgagtagctgcgctcccctgctggaacctccaaacaagctctcaagattgctgatctagggccactaagtgatgaattgtatttggaagcaaaaaggatggctaaaaaggacctcaaccctttt

SEQ ID NO: 65 - DNA, 703 bp, Homo sapiens
ggaaacagggcggaggcgtggagggagccgtgcagcgctggtgtgaggagcagcgagcaggccaggcctgtaaagcagagtgagggaaccaggatagagaaggctgtacaggaagcatggtgatggcatctgcatggcgcctgtggaggccccagggagcttttactcatgatggaaggcacagagggagtaggcacatcacatggtccgaggaggagcaagagaaaatgggagtggggggtgtcaatgtgctgatattccaatcttgcagaaatcgactggatttagtggaattaaagtcaactggaagacgatctgtggggataattccatgattcaaagccttcagggaaaacgtgtttgctcagctgcagtgattgaaaaattgaaggcaatgagagtcatatgttatgcttggttatgtcctgctctgatgccagtttggagtaaaggctgaactttgctgttgaaagccactgtggaaagtggaaacattgactgtgcgttgctgaggggaggaatgtatttacttacccagaaatagacgcatccttgtctcagtgggctgggagatagtatcaatcctttctgttgcaacagatcccactgccttcttttttcaaaagagtaaatatttaaataggtaatacagaaaagttattgccatttttccttcatcagccatggctgggagtcaaaagag

SEQ ID NO: 66 - DNA, 4452 bp, Homo sapiens
aaaatacacaaattagctgggtgtggtgacacacacatatagtcccagctaattagggggctgaggtgggaagatcacttgagctccaggaggtggaggctgcagtgagccaagttggtgtcactgtactctagcctgggtggcaaagtgagaccctgtctcaatcaatcaatcaatcaatcaatcaatatctcatgctgtaattgtcttctgatgttttcatccacccagccccacctctgcagccttaattactggagtaggtccatgatttcagtgtagggttaatgtattctgcagatcatctttgatttgacctgcttttttgcttcctttttatctctgaacaaaggagatcatcattctctttaatctgccttctgtgtaaatctctaccagactggaagctccctgaaagcagaaactgtctgcttccccagaacttagcactgtgctttcatgtatgtgggataaatttttactttgttagtgcaactttgtttgtacacgttatccttgatattacatacatttgttgatgggggcaatttatatttgttgtgagtaaaatacttttttgttggattaagaagaactatactcttcccagcactttgggaggccaaggaggacggattacctgaggttagtagcttgagaccagcctgaccaacatggagaaaccccatctctattaaaactacaaaaaaattagctgtgcgttgtggcacatgcctgtaatcccagctagtcaggaggctgaggcaggagaaccgcttgaacccctgaggcagaggttgcggttgagccgagatcgcgccattgcactccagcctgggcaacaagagttaaactccatttcaaaaaaacaaaaacaaaaacaaaaacaaaaaaacaaaagaagaactactctgtagtgagagctagaatcctcatgttgtttatttaaaatttttggccaagtacagtggctcatgcctgtaatcccagcactttgggaggctgaggccagaggatcacttgaagccaggagttcagttacagcttgggcagcaaagtgagaccttgtctctacaaaaaaattttttttaaattagccaggtgtggtggtatgcccctgtagtcccagctactcaggaaaccgaagcaggagaatcgcttgaacacaggagtttgagggtgctatgagctatgattgtgccactgcactccagcctgggcaacagggcaaggccctgtcttaataaaataaaataaaattcttaatatgtttatatatttgaaaaactatttgtgtagagacacatgtctgtaaatacacatagatatattaactttttaagctttaattgaagcctttctcttcacaggttttatatatttgactgcagatgactaacagattgaattttaagagtgcgaaacactctggtgctatagggaaggaacttcataaatagcccctcctgtaagggaccagtctttaatttaaaacagtccagcccaggaatcttgcaagaattttgtaattatttgaggagagatgtagatataccctggagttctttgactttaagttattctagagtcatcccagagatggcctagaagacttgaatgtaccccaaaggattctgaatccctttgggaaatttagactatgattttcagtaagaattaaaagccccaggataagcgtggtggttcacacctgtaatcccagcaatttgtgaggccaaggcgggaggatcgcttgagctcaggagttcgagaccagcctaggcaacatagtgagaccccacccatctcaatttaaaaaaagagagaaaaaggccaggtgtagtggctcacgcctgtaatcccagcactttgggaggccaaggcgggtggatcacctgaggtcaggagttcaagaccagcctgatcaatatggtgaaaccccatctctactaaaaatacaaaaattagccagtcctgatggcatgtgcctgtggtcccagcgacttgggaggctgagacaggagaattgcttgaacccgggacgtggaggttgcagtgagccgagattgggccactgcattccagcctgggtgagagagcgagactctgtctcaaaaaaaaaaaagagagagagagagagagagagagaaagccccaaacataccttgggcctttacaacctacttggtcccagaatcgtcttattgtaaacccaaagccaggtcttctggttcgaaccagtcaaaatgggtaatctaaaaaagttaaatagatgattcaaaatcgtgttggtggttttttctttttaaatcccctttccaagtaaaaggaatcttttttttttttttaagttttgaagcctcatagccataaatattttggcaccagcatctattggcacctaagtcattggctgtatcatattcccatgggacccttgttcctagaggaatgcaggaatgatcttggagtgggaaggacagaaacaggtgcttgcaaaatcagatatttctgaaattctctgttattctatttctactgtctttccccactttactataaatttgatctgttataaaatggctgtgtttagatagatacccgtgatgtttaggaaacaaatgatatagagactcccatttaaatgaatcttatctttataagaaacagccaaactgttttccagactggctataccatcttacattcccaccaggaatgtatgagtgatccagtttctctgcatgctcgccagcatttggtgttgtcactatttcttatttcaaccattctgtttatccttttcagtgaaatatctgttcatatcttttgcccatttgccaattgaggcaggaggatcacttgagcccaggagttcgaggctgcagtgagatatgatcactaaatgtttgcttaatgagccatatctttaaatatcttttttaaagtttttaaaagtcagtccagtggtttatgtgattatgtgggattttttaaatctttccaggcaaaatgtgtatagcattttgaacatatttacactgtactgagcccaagagttctcatattctttctttgctcattatagagtatggtactaatactgtataatagtaaattttcaaagatacctttatttagaatgttagagtatacagatatatactttgtacatagttatcataatgtttctaacctttttatttaaagcaggctgatttgtgtaaaggtttcagaatgattttgttaataagttattagaaactttcctatttgtacaagatggtaaatgtagattccaatttgtatgcctcagtaaattcataatcttatttctctgatgtgagccactgtgcctggccttctgtgatgctcttaatgaattttgcagttttattaaattgtcattgagaacctcataaatcattgttaagatctatacaaaaaatcaaggatccacagtaatagaatatttttcatctgcatatgaatttttcccttccctttttgtctacttttagatttaaaaaaaattaccaggacattcttattaaatactattacctgttttggtttctgcacattaagaaagtcacagagaagccagacacagtggcatgctcttctattcccagctactcaggaggctgaggctggagaatcacttgagcccaggagtttgaggatatcctgggcaacatggtgaaacttggcaaaaacaaaaacaaggccgggcatggtggctcacacgtgtagtcccagcactttgggaggccacggctggcggatcacgaggtcaggagatcgagaccatcctggctaacatggtgaaaccctgtctctactaaaaatacaaaaaattagccaggcgtggtggcgggtgcctgtactcccagctactcgggaggctgaggcaagagaatggcatgaacccaggaggcggagcttgcagtgagctgagatcgcgccactgcactcctgcctgggtgacagagtgagactccatctcaaaaaaaaaaaacaaaaacaacaacaacaacaacaaaaaacaaccagagaaatagcacttgttaactacaattgtgactctaggtaaacttgggccttaatatggttagacaagaagggttttaggtaacttgcctttttagatcctatttaggcttattagtctatattctacattcttgcacgatggaaattactagagaagtgggataattctttgttgtggggaaaataaaatttgttgtgaaaatatactgtattttaaaatatttagaaagattataaataactggagaaaagataatttcatatactaatatgatggaattagcctagcagatgttaaaaatcctttctgaaaattataatctaaaattatttgggaaattacaatggaactgaataatctgtacgttggtatattaaagccatttttatattgtg

SEQ ID NO: 67 - DNA, 1717 bp, Homo sapiens
gttggtccctacagtagataaaacgggcacagtagctaaaattaacgcctaagtaaaaccgctgccggtgagttttgggagtattttcgcttttttgaaagttagtattttggctctcacaaagcctcctgattttagtaggctttccctggaatgacccagattccttttcgttaccttagttaaggcaccccctccccgtgcagggtcagggttggaaaactaccgcgctgagcccaaattaccgcgaagatcgtcggaaatgtgcgcaactcagctaaagcggagatttaatggatggtattcagtagaaaatgggacaagacatgaatggacagtttacaggaaaaaaaaatgcaaggggcccctaaacatttaagtgggtgctcagcctttttcataatcagaagaatgcaaacgaaaacctcactgagctaaggcttctgatccatcagattgtcaaaaatccaaaagtttaacaagcgaggtacgctgttaaggacaatacaggaacctgatctgtcctgcattgttgggagggagtgcaaatttacctttgacccgcaatccacctctagaatctactctgaaagtaaacttgcacaaatatgaaaacagcatacgcgcaaggttttatttgtagtggcactgtatgaatttgcaagactggaaaccatgcagatgtccatgagagggggagtggctgagtaaactggtacatccgggctggtactacagcccagctgactctgtggcgttaagaaaaatgaggaaaactacaatattttctatggcgtgatttgtctccagagatgatgtatattggctgctaccgttagcaaaaagaagcactgaaacgataaaaccaaaactgataaaattgatagcgtaaatggtggagaatccggtggaagccctagaggggttccaccaaaagaaaaataaggtgacaataataatagtaaaaagaatctgtggcagtaggaatctgccaggcttcctgttctggaacccagcactagacccggaaaggcatgtttggctgggtgggcctcaagttacttataattggtggccatgctatagcctgagtgaaggatttctggtaccctgccgctctccaaaaagacgtctctttgggaactctagaactggaatggtccatcagcacctgccttttggcagagagggcaggcctttgtaccccactagtgacttggtttggaggtgggctgcccccagaacaggatgtaatcttgggcaaggcagctgctgtcaggctgggcacaacctccccctcaaggctgtgaggagggaagaaaggaaacaacttctactttctttaaagtaggaaacctcctcatctgccacctctcctgcagtgagaagtagagactagacgtggatactcccacataggatactggggcctaatggatgactgtgggcctccaccaggcgcaggtgaccctgcagatatgattcagaggcagcctctcgctgctgttcatcagcagcctgattccatgtggactatactgttgctttcagaaatcatggtctgcctggacctagccaggctcactgttgaagtcttgttgtgtgctcttccttccaggcccagagagctgcccagtagatcaacttgggctttctatcaggctctaagtacaggcaggtccttaggacaaattagaataaaacaatctcagagtga

SEQ ID NO: 68 - DNA, 2170 bp, Homo sapiens
acgaaatgtgtttaagagttcaactcacaaatttagtttatttctctgcctataaatagagatttgtagattcttataggtagagaaataaaccaaattccaactgctccttatgatcattcctctaggtgttaagagtgagagagggaaggcttgacaaatttactgaaagaggtatgggagtgtgaaagctttagacaaggtacaaagatccactctcagaaagagaaaatctgaaaaaagctccaaaacattgatcataggtttggagtttgatagttcacagctctatgtatggagaagagcttaaaggtaagcagtaccagaattggtagctttaaattataagcattgcctcataagggaaacatgaagacttggagacatgtcagtgaagacttggaaacatggcagtgaagaagaagaaagaagaaaaaattcttcaggaaaagaaaaaaactgaacttagagaagagggtgttcttgaagtaggagctctgcctatgaaatgaacagaaatagaaaagagcaggccacatccatacagaactgtaagaaaaaacaaacaggaaatgtgaatcagcatttcaactgatgaaaatctacccccatcaaaaaaagcaggaaaaaattgacacaatgctccaagtgaaattaaacatcctcaaaccaatgtttggagatttgaaaaataaaattaagaaatattctgaaacaaatacaaagaacaaaaagcattaagaaatgaacacaaagtagattaaacagaaaaatagaagataaaatcataaccaataatgaagttttaacattcccacatttcaaattcaaatttaataaaaagtcttgaagaaaagcaggaaaacaggataattgagatgagatttttgttttgaaaattgaccaagttgaaatgggagatggatccaaagtctactgtatataattggtgtccttcaagaagagaaaatatttaaaactataatccaagaaaactttctggaagtgaaaagagatctgaatctataccacagaagttcataccagaaggcacactcaaagatatttcctagtaaagctgtatgactgtaaagatgcaaagaattctcagggtctccaggcaaagacgtgacatagaggcaagagaattagaccagtgtcagatttctcaaaagcaacataacaaagcaagacagtggagcagcatgaggaaagtgactgctagccaaggattttatatccagctaactgttgtccaggtattagggctgcagaacaacagtttgaacatgcaggaactcagggaatactgtactcgtttacccctcctgaggacactcgaaaaggatgactttcatctaaaagatatttgggacatttcctacaaaaagactgtgacaataagtatttcagatatctttttgaactaagattaaaaccaatagtagggacctagagaatagtacataaacattatacattctgacaaagcagaaagaatgcaactaaaatataatgggatggaaaataaaaggaaaaactaaggccatgtgtggtggctcacacctgtaatcccagcactttgggaggcttaggtgggtggattacttgagcccaggacttctagaccagcctgggcaacatagtgagacccagtctctacaaaaaaaaaaaaaaaagtgtttaattagccaggcatggtggctcatgcctgtagtcccaactactcaggaggctgaagtaggaggatcatttgagcccaggaggtcaaggctgcagagagctgtgtttgcctaactgcactccagcctgggcaacagaatgagaccctgtctagaactgttctttttcagaactagaataagaataattactgtaattgaagtaatatgagggagtcagaggctaccatctaaaactgaaagaccaaatagaaaagattaggtaagaaaaaaaatacagtgtactgtaaaagctattaatataaaggtaagcgtgacgaagactttccaaaatactgagagaaatttttaaagggacaaagaaaaccatgatggaacagaaaaaaaagtatacagtacataatgcataccctaatgataaaatatgtggagaattgagagcaaacataaaggccaggacaaatatgtaccaggcaaatagaaacccc

SEQ ID NO: 69 - DNA, 3961 bp, Homo sapiens
gctagagtagggtctggagagagctcccactgtggcgagtcctgtcgttggattcccgcggcgccccgtaaggctccgccccggcggtgctaccaaaccctgttcgattttagaatcgtacattcccagagggaatcctagacccctcattttacagttgaggaaacaggcccaagtagcatgacttgttcgcgccgctagtcgaaggagcagcagccccgatcccttgactctggggcactgctttccctttagctcatttttggaggaaatgggtgcgcccttgctcgacctttggtgattgccgccacaggccttcccgccggctaactcagcgtgcccaagtcccgtgacttagtgccaggacggtgctgtgacccgttatcccctgtcgggttttacctccccccgggagagctcagccctggatcccggcgggcggcggagcctctctggagcccggacgggacagcccaccagggtctgcttctgtgaggggccgaggcgtcattccgcgaagccttctccttgctgttgccatgtgaagaaggatgtgtttgcttccccttctgccatgattgaaaagaagcataagctgcaataaaaatttggtttcaagataacaaagtcagtccccaaaaatcagtattgagagtcactgacattaaatgatgaagatacgaggatggtgtggggacctttactcttcgaagatgagctatacatgcccctgaaaaggctgtctgaagacaggggaaggctggagatggcaactttggcctctgccaagtactcgtgctattttctgtatgtgatactatctgttttgtaactcagaggcaacaccacatacctagcataaggcttgaactccctttggggttatcaattacttacatagccttcctctaagggaaggcttgcaagtggttcatattcgacccttccatgtgataagcattcatgtgggcttcacaatgtaacagaggtacacagagattcttgtaaacagaaaattttataaaactgttaactgatctcactttgaagaagtcttactgactagatgtcatttatcagagtagacaggcttaaaatgcattgcttgtactagactgttgtaatgcatttttttgtttttgcattggtttttaattcatttaattggtttacactcatttttttttttacattccatttttgcatttgtatgccagttaaaaattatgaaatggcacattgtgggattttgtttagctaaattctagaaaaattgaaagataccttttattcgacttaagcctgaggttattcagcacggtgatctctgcatttttgaaaggttgtctcgtcgtttaataaacgtaaataacttaagcacattggaagagctattaaatgagagcaggagattaaaaagacatgatttcttactttatccacctgacaggatagcttgcattggtgattaaccttgcattgttaaattcatttcctaaatatttaggtaagtagttggtttgatcattatttgtaaagtattagtagttgcatgttgaattatcatgttaagatttttagtttgttgttcatgtgatatgaaagataacaattcctaaaactgaatgcatgcatggcttattcagctcaggtcacatacaaagagaaatgtgacgctgcaataaacatagcagagctatctgggtttgaagcaaaaaggctatgacgttaggtatatgcactttacattgtatgtatctttttagttctagtgaactcatctggaatcatgttacagaaaatgattctccaggtccaaacacatttaagtttaatgactgggactactctaacaattgcggctatctcattttgtctcattggttcattagcatagcacccatttaagaacaactacttctaaacacagtaatatttcagaggctataaaataatagagaaagaaaacttaaaaaatcctttgtttgcagccaagaaaatgtgaggatcagatttgtacttgttttgaacaattggaaactgtcacaattgtttttaagatgtaataaatgtatataaaatatgggattctatagtattagccattttgatatcttttgttgaaagaaaaaaccaaaaaaccccatatgttctaagtctcagaaatcaaagaattccacaattttcatttccactaaaatatttatttaatggatatcttacagaaataaataaaaacagtttttgtctaatacagataggtttttttatatatatgtaatttgattttacaaaattgaagcatatcaaattgttttctctaaaacatagctcagaaaggaatagtagaaaacaaacacaaagaaatactgaaatagtctcatttttaaattataagcatgggccttctgaatctcagcatgacatgttattagtaaaagaatgtaagatatggagtcaggggacctgggctccactgtttacttgctacatgtcctaagaaagtttcaatatatctgaacttcagttctctacctttaaaacagtaaagatattaattatatcaacttcacaagattgttgggtaaattaaacacgtaaatgtacatgaaagctctttttaatatgtgaagagctataaaaataacagtttgatttaatttcatataaaagaatcaatggatacctccttttaactgaagaataagcaccaaaagcatgtgtgtgttttcttcagttgaattacatcactctataaacctagagtaagaaaatgcaccttaactaagcaccaaagcctctcggacaaatgggatctagggaatggttctatgagttttccaggcagctaactgggagctaataagtcctgagggtcaaagagggtcctttaaaactctgaaggctcaaagaaaaggaagccaaataagaacatttgtattacatcaaatggctaggatgtaacaagctactccttattcagcaatttcaaagtccattaattcctcacagaagaagaaacacttcgttattatcacttgcaacgatttgcttatgtgaacatggcattctcttgttcaaaaggtcaaagactcgtgcttaagggaggaacaactggagtgaaataacaactctaccatgaattcagatatcactggctaaaaagtctagttacacaagaacatgggaaagaaaaagaatccaagacatcagtataataatgattaaaaaaaaaaccctgccatatttccatgttataataaaacaaaatcataaaaactgcaatatttacagatacatcaatcttacaacatataaaaactttaacaataagaaaaattaagagtagggaaagcagataattttaaggtaatcattaatacattaaaaaatctatttggagttaactgtttacactaacaccactttacacataatagaaatatgaatattttcattgtttttgttttcagtagcaagatgcagaagaaacaaataactgtctaacattaacttattgtaaggagttgtattactgcaaaattactaggtgtaaagttatggtataagcctactcaaaaaatgggttaatataattcaccatctacttaaaatattactaacaagatattggtgaatcatgtgctaaagatactgaaggcccttccaaaactgagatctatgtttgttcaatataccaggtcatataaaactagactagtttactttcttattccaactgttttatgagtgatcttatcataagaaaagtacacattacctctcttaattcccttgcatcatcagatatagatactatttgggacaaaaaataaatgttttattaggagtgtaaaattaagaatctttatagatcttttggaaacagtatattgaaaaggactcaataagtactaagccactgtataaccagaacaataaacaaattcattcaactagg

SEQ ID NO: 70 - DNA, 601 bp, Homo sapiens
gggagcaggcgctcacctgagctgactcagaaattggaatgagttgtctgtggatcctgtaaggagcctggacatggtgaagagaatgccttgaccatcaggagacagcttagcttgttgaatcttgatcacttcttctgaccgctttggatcttaaaagaacaagggatgatggtgacttatggtgacaaccaagaacaggcttcagaaagaaagcagctgtgtagctatggccaaattgaacttcttgagtcggtgtcctcgcttgtaaaatggacaattctactgaaggaaattgaaggtcttaccgactccatccaaggaattgacaagagatccccaagaaggttgcatagagcgagttctgggggctggaaattcaacatcaaggcacaagcagatcagcagattcagtgtctgttttctcccccagaataacatcaatagaactcccagtgaaagaacgtcttcctaaggcaattctgaagacaaaaaagcaacataagaacacacttcccaataatgtgaagatctatgactgtactaaataaaaatgttcccttaatgtactgtaaaaaataaagatgtttggctagattta

SEQ ID NO: 71 - DNA, 952 bp, Homo sapiens
acccacagatgtgaatgtcgtgtgatgttggctttccagtgtcttgcatggcgtggtagcagcagaaatgagcttggctgggcaccctctctgggccttggaggcaagcctgggctcctctgaaaatacaggcagcttcctttccctgacttgcctggaggagccaggccctgtggtgcggtctggctctgaggcctgtggtcctgcttgggactggcagtcttaggctgagggaacattttccagagtatagccgagggacagaatgtctcagtaagacgggctcggaggggaagtgttttggaaaggcctctgcttgctctgggaggcgttcaggatgctgaggttttggaaatctatggcggctcttcacaactgctcccagctttgggaggaggaatagacgggtgctcgtttcctcgggttcagtggcaaaggtgaagaccagcactgccgacctgggacctgggcctctcccgggcctggggaggacactggactttgaaggggaatgcagcctagaaggcctggaccctggagtcaggagatgctgctcccatccagtaagccctggctggagctcttctgggcaccaaccctggcataaaaccagtggggcctctgggcctgcactcaacagtgcctctgatggagcaggttcagcttggttgtgacctctgctagaagccctccctggcctccctgtgcactgagctggtggttcctcctttgcgccccaggtacatgctcagatctgtgtaccctacactttgtcctccagcttcgtgtttggatgttcacaactcccatgagaagggcccccgagagctggcacagtgcatgtgtttcctctccagacttctacaaacctggcacataattgtttgctgaaagatggcatgttcctaaaacagaggaagtagaaccgaataaagcgaaatccaacttccca

SEQ ID NO: 72 - DNA, 285 bp, Homo sapiens
caagttaattcactcagtgctccaggcatcaacttcatagaaggaatggaaattctacctgtttcctaaagaactacagaggtgtacaccaaacggagggcaaatgctgttaccactcatcgtgcaagacttttgaggcaatttggacatagacaagtgatgggaaaattgaatcattatatggctcatgacagtgttgaaaactcaaacatccaaggacctgtacctttgctaagtgccatgcatatgttgctgataaagatgcaataaatactcttttgttaa

SEQ ID NO: 73 - DNA, 678 bp, Homo sapiens
ctaaccaggttaggcataggcagatggggcaaatgtgctgggaaggtttctgggaaagggtctctaaattcttaaaaagtgcaagggaaatcttctatctctgtatagaaatgtccaaagaggtgatctaggaatttggcagccaccctggacccagggggaacaaacagaagagctccagctagtgccctaggctgcatgtgcaattccatcactgagctgctaaaacaacagccctagagctgcctcacttgggcttcctgtttggtgagctaacaagcccctttttgttctgaacgtttttattgagctttattttcaaaaaagcagcctgattcatgcacatatctttagaagaaatttaaaacgccctagaaaagaatatcttcagtttaaaatctaagcaatttggaatttacaggaatatattcctcttagttccagttactcaccattaaaaaataatggtcctcaggttcagctcgaagatatttaaaaaccacttgctccatgaacctttccataagatcccagtcttcaatgattccatgtcgtatcggccactggaggaagagacaccagagttgtcaagcctcagttcgcaacaataagagcaacagtttaacagtggcacagaagaaactgtattattaagaataaaggtctccttctcattgc

SEQ ID NO: 74 - DNA, 430 bp, Homo sapiens
caaagctccaagacagacctgtagcagcatggcccaaaaagttcctctgctgccccagtcccatacctgcctgaggtacgggggttcaggctgagtcggctgacctggagtcatctggaagccttgtcagaaatgcagattctgcagtgctgttcccagaggatgagattcagcagaactgggtgttggatattatatgaagagatttgcaagtgttattttacgtaattcgcactttacaaaggaggaaactgcagcgcaggtaccaaggttgccccatctcggtccaggcctgctcccggcgagccactcgcccttgaccacgcctcctctctcctgattggctgtcaggcatgagtcgacagagaaagatgaccactgccctcaccccactaaagaagccccagcacttagcaagcacttatggccc

SEQ ID NO: 75 - DNA, 2646 bp, Homo sapiens
gcaggggagacaatagcgaacatgctgtgtgggctcagccgggagacccctggagaggcggacgatgggccctactccaaaggaggcaaggacgcaggaggggccgacgtttccctggcgtgccgcagacagagcattccagaggagttccgagggatcactgtggtggagctgatcaagaaagaaggcagcacgctgggcctgactatctcaggtggcaccgacaaggatggaaagcccagggtctccaacctgagacctgggggacttgcagccaggagtgatctgctgaacattggtgactatattcggtctgtgaacgggatccacctgaccaggctccgccacgatgagatcatcaccctgctcaagaatgtgggcgagcgcgtggtgctggaggtggagtatgagctgcccccgcccgctcctgagaataaccccaggatcatttcaaagacagtggacgtctccctctacaaggagggcaatagctttggctttgtccttagaggaggtgcccatgaagatgggcacaagtcccgcccgcttgtcctgacctacgtgcggcccggtggccctgccgacagggagggctccctgaaggtgggcgacaggctgctcagtgtcgatggaatcccgctgcacggggccagccatgccaccgccctggccaccctgcggcagtgcagccacgaggcactctttcaggtggagtatgatgtggccacccctgacacggtggctaatgcttcgggacccttgatggtggaaatagtcaagacgccagggtctgccctggggatctcgctcaccaccacctccctccggaacaagtcagtcattaccatcgaccgcatcaagccagccagcgtggtggacaggagcggagccctgcaccctggagaccacatcctgtccatcgatggcaccagcatggaacactgctcgctgcttgaggccaccaagctcctggccagcatttcagagaaggtgcggctggagatcctgcctgtgccccagagtcagcggccactgaggcctcagaggcaggtggtgaaagtgcagaggagtgagcagctgcaccgctgggacccctgcgtgccctcctgccacagcccccggcccggccactgcaggatgcccacctgggccacacctgctggccaggaccaaagccgatccttgtcttcaactcccttttcctcgccgaccttgaaccacgccttttcctgcaacaaccccagcacccttccccgtggatcccagcccatgagtcctcgaactacaatggggcggaggaggcagcgaagaagggaacacaagagctcgttgtcgctagcctccagcacggtggggccgggcgggcagattgtgcacacggagaccacggaggtcgtgctctgtggagaccccctcagcggctttggcctccagctccagggcggcatcttcgccaccgagaccctgtcctccccacccctcgtgtgcttcatcgagcctgacagtccggctgagaggtgtgggctgctgcaggtgggggaccgtgtcctgtccatcaatggcattgccaccgaggacgggactatggaggaagccaaccagctcctgcgggacgccgcactggcccacaaggtcgtgctggaggtggagttcgatgtggcggagtccgtcatcccaagcagtggcaccttccacgtgaagctgcccaagaagcgcagcgtggagctgggcatcaccatcagctcggccagcaggaaacgaggggagcccttgatcatctccgacatcaagaaaggcagcgtggcacacaggacgggcaccctggagccaggcgacaagctactggccattgacaatatccgcctggacaactgccccatggaggacgccgtgcaaatcctgcggcagtgcgaggacctggtgaagctgaagatccggaaggacgaggacaactctgatgagctggagaccacaggtgccgtcagttacacagtggagctgaagcgctacgggggtcccctgggcatcaccatttcgggcacggaggaaccttttgaccccattgtcatctcaggcctcaccaagcgtggcctggctgagaggactggtgccatccacgtgggggaccgcattctggccatcaacaacgttagcctcaagggccggccgctgagcgaggccatccacctcctgcaggtggctggagagaccgtcacactgaagatcaagaagcaactagaccgtcccctcctaccccgcaagtcgggcagcctcagtgagaccagtgatgctgatgaggacccagcagatgccctgaaaggaggcctgccagcagcccgcttctcgccggctgtgcccagtgtggacagtgctgtggagtcttgggacagctcggccaccgagggtggctttgggggcccagggtcctatacaccacaggcagcagcccggggcacgaccccccaggagcggaggcctggctggctgaggggcagccccccacccaccgagccccggaggacgagctataccccaaccccagctgacgagagctttccagaggaggaggaggaggatgattgggagccgccaacgaggcatcctgtgtcaccgctctccaccccgtctcatctgcccctgttctaa

SEQ ID NO: 76 - DNA, 2424 bp, Homo sapiens
acttccgcctccagcctccgggccgaagctttggcctatggtgcggggaggtagtagtttcttccgcgagggtgcgggagggccccggggcgcccttgggaaccgggctggaggcagagacaggcccggaggaccaggcggacgtaaggatcaggcctctggacgcaactgcggagccggaacagaccaggagggcgcggttgggcgggtacagccaggaagtgctcgtcgcgagcgcggcccgcggttcggtcacagcgagaagcccgcgggtgctgggagtgctcggtcttctctcgatctctgcagggagtcactggccccgttcctttttatctgtctgaacatcacgccgaacttttaacagttgattccactgcattttcaatgtggtattttttttttctgtaaatgttcatctatttttcgcttcaaatatgcgtttctgttacttttctaatgtaccgtaggagccaagaccacctatactacgttgcaaaatagcactgataccaggggttctcccaaggttcattcagaaatgtcacatgattccagtaacaatacgaaaaggttttttttttggaaccaggcatattgatcctggagttcacatggaggaacaaatgtctcataacgcagacgacgcggacaaacaaaagcgcaatgcccgacagatgcgaaaacagcctctgtcattaaaactgtgtgctagtgacacatgaacaggaaacaaatggaatatccagacatcaacccagtaacatggaaatttggttcataaacataatttcagagcggtggaacaaacatgcagtttataatgaaaggtgctaagacaaatggttagccgtctgagaaatgatgaaattaattctggatctcacagggataaactccaaacggatcaggagtctaaatgtgaaaaacaaaacaaaaccacatgtgaagtgttcacgtgatttcgtggctgattaagaaacaagatgtgcccaggaggtggcggtggcgcacaagctttgacaggttggagggtgagggagtctcacgcaccatgagattacccacaggcttcgaattgggggtcactactcagaaaagagaaaaaaatgagcgtgggcggggggcgcgcagagaactcccagagaagaaggagatcagacagggggagggctgacgtgactagatcacgtttctcagcagcctgacaggtgtctgagtcacaaagctctgaagggcagcaacggcttgcagtctttagagccccaggatttatcttatctatggctagcagagattggacacaatttcacgaagtatacaaagcaaccacatgctaaatggttcaacactatgagtgtttgggatgtgttttatttattatttattaattttgatacggagtctccctctgtcgtccaggctggagtgcagtggcacgatcttggctcactgcaacctccgcctcccaggttccagctattctcctgcctcagcctcccaagtagctgggattacaggtgcccaccttgtaatttttagtagagacggagtttcaccatgttggccaggctggtctcaaacttctcacttcaggtgatccacccgcctcggcctcccaaagtggtgggattacagacgtgagccactgcagccaccgtgcctgcccttgggatatgtttttttttcttttaattttgttttgttttgtttttttgagacgaagtcttgctctgtcgaccaggctggagtgcaggggcacaatcttggctcaccgcaacctccgcctcccaggttcaagcgattctcctgcctcagcctccagagtagctgggattacaggcacgtgccaccaagcccagctaatttttgtatttttagtagagatggggtttcaccatgttagccaggatggtatctatctcttgacctcgtgatcctcctgcctcagcctcccagactgctgagattacaggcgtgagccaccgcacggatatgttttaagtaactgaatgtattaaaatttgactttggcaccagcaggctattgtgaataatgttgctttgagcatcgtgtgcaaaaatatcctggacccttgttctcagcacttttggatatatatgcaaaagtggaatggctgggtcacatgataattctgtctgatgttttgagaaaccactgtcctgttttccagagctgctgcaccattttgtattcccatgagcaggtgcacaaggttccaactttaccacatccagccaacagttacctcctatttaatggctaagagccatcaccaccggggtaatgtgatctcactgtggcttttgttttcatttccctaatgtttagttatgttgatcatcttttcatgttcttattggccatctgttatcttctttattataagtccttttctgaat

SEQ ID NO: 77 - DNA, 716 bp, Homo sapiens
tcagtggtgacattagcgaagaatgacagcatgtctctaacaaagatgtgaaaactgaggcttttcaaagtcacacagttagcaaaatgtggagccggaattcaaatacaggtttccgtggcttgagatcccagcttttcaccattaaacagtgtcaccttcagaaatggcctttatgcctcctggtctcaacatagagcagaaaggaccatctggacaccacatatgaggaaatcagacatctctaggttgaatcatgcccaaaaggacaatttcttgtcagataagctgctgtgtactaagtctgataactaacaaaattgctatatggtaattttaactggaaattgtccacttttatcctccggttttctctcttattccattggtaaccaccctgggagttctaataccatgtccatgtacaagtgcttaaatcaaccctcaggttgtgacagtcaagctacagtggctgtgaaataatctgcacagcagagtatgctatgtcattggctcaatcagcataatgcagcataatagaatagaagcacacaattatataatgccataatttgatttctctctaatttctggacacatcacaaaataatcaaggcagtgaaatgaagtgtaaagaataatggctgagtttggagtcacatcactgccacttgctagcctgtgtgaccttaaacaaataaaaaactctttcttga

SEQ ID NO: 78 - DNA, 315 bp, Homo sapiens
tgttacaggagaggggtcctgatccagaccccaagagagggttcttggatttggatcctgtgcaagaaagaattcaggtgacttagaatgcctgaccatgtgggaatgcagcccagtaggactcagtctcattttacccagcccctgttcaagatggagtcgctctggttcacacgcctcagacacagcctctgcctcccgcctcagcctcctaagcagctgggactacagtgcatacctgattttctcgacctcttttatgaaatatccccgccagactccctcgaccgtgccacccccaggttcccgtgcata

SEQ ID NO: 79 - DNA, 1966 bp, Homo sapiens
agcagctgcccctgcaaatgtcagcgccagcccagtcaaaagagcttgaaacctaccaagccggaggactgtgctgtgcctctctcgcccacattttccccaagcactctcaggaacctggcaacagtgtccccttgtggccaagcctggaacatcacatctgtacgttgcaatctgtggatcagctacgagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttttcttcttcattcttttcactcctcgttactcttttttttttcactctcagcccacacaaaactaggaactttgttattctacttatttttctgtactctgtctgtttgcacacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagcatccctgactctgagactgtggggtagctggttgttttaagatgggaccagggtattgtgcacttattgccaattcttgcttcagtaagtggggtggctgtgcagagtgagtggcctgtgtatgaaccagggtccgtcccatctaatgagagtccggtcaggctgagtcctcaccaagacttcagcgtggattcatcagtaaccttggttcactggcaggcttgctggactttggagaaaaggctgaccctcccccaaagcagcccattgctgccactgccctaggaacagagggcctggagccagggcttgacctggtacaggagcttttgcacaaggccggctcaaacctccaaacctggggaaacaggatgcatggtgaagtgaagaagaaagaaaatgcatccaccgttccttcctgttggtgtcagcacgatgaggaataattacctggatctggaaagcaggcgtgtgggaggctgcaggcccccctgatctgtgtagttaggcacttaatttttcatcctcctccttctctctgccctcccgaaaccgccgttttcaaaggaaaaacagaaaaacgtatctgggtaacccgtgtaatactgtttacatcagcccacttggcccagaaaggataccagctccttactgatgctcagataacagggttagtgcttaaaaaaattatgccttgggccgggtgcggtggctcacgcctataatcccagcactttgggaggctgaggtgggtggatcacaaggtcaagagatcaagaccatcctggccaaccaacatagtgaacctgtctctactaaaaatacaaaaagtagctgggcgtagtggcgcatgcctgtagtcccagctgctcgggaggctgaggcaggagagtcgtttaggcctggcaggcggaggttgcagtgagctgagattgcgccacactgcactccagcccaggcggtggagtgagtctccatctc

SEQ ID NO: 80 - DNA, 2822 bp, Homo sapiens
gtttttgtgcaggaacagcccctcccgtctttgtcctggcggtgagcacccagggctaagcttttgaacactttctttgtgtttggattcagcccaggcaatgcatatttgctttcatttcttcttgagcttgaggagctcctgggtgcaaatcttggaaaatgaggatctctgagcctttccaggccagctctttgttttgtagcagacaattgaggctttgaaaaggaaagtgggtgggggcaccccacaggtggccctcatcacccaattgccagtgcctgcaggctgcttcagcagaggcccagagtcaaagaggacttaaaaccagctgtcgtttctcccttagcttctgtgtatgagagaaacgacttctgtttttcaaagtaagaacaaggaggaatttgtttctaaaagaacattaaaacacaggctcgtggtctaaaagcaaatggttcagcaggatgttcagggccttaaagcacagtcagcaggactcagcatctcccagcacctgctctccggttgtcatggtaacatcatccccaacccaaccaccttgtccagccgagagacagcaatcataaggagggacctcggtttcccccgaggatcctgggcttcctttctgaaacgcttgcttctgagctcagcaaccaggaacaccaggccagcccatccccagcacctctgtggagatgagggacaaagtcctacagtccctcttcctgttctgatgagaaagggagggaagaaaacataccccgagcgcctgcaatatggtcatgacactttcaaaaagcctgtgctatggagtcatgatcagaaaccagagtgtggagagggtcagcagcctgcctcagagcagccagctaggcggggagtggtaaatttgggacttgtacccaggcatgactggctccgagcccagtgctccactctatggaatgttccctgggcctcagttgctttcctttcctttgcaggccgcgggctgctgccactctggcagctggtgagttagctggagggcaacattccaaagcaggggcagcatgctgctttcctcctgtgcccactcctgcggggaagtccgttgactcccaccgctgaagggagctggcaacaccaggatgaggtcccaggggacgggagcaggtacccactgtctgtctaccttcccactggaaaagcacggacaggccagcccttgcgggggcaggcagaggacagagttggctttgcgcggtctctgcctgctgagcagttccaattcctctcatgggagaaacaaggaggcagtcgcttgtgcatgttccagaagttttactggggaggaggaagcggacagaggaagctgtgtgtgcatgtgaaggggtgggcagggtgggagggatgcacgcgtatgtgagcatagcatgtgtgagtactacacacatctccatgcagaagcacaactgggcagccctggcttccagctctgggcttcagcacaacagacaccagcctgtggtctctcagaagccagggagaccacatcgggctcaggacgttttacccaaagtccagagtttttatgcctctccctggcattctccataaagaagggaaggtcagatgaccccttagatctgtgtcatctgggaatttccttgggctggtttagacacgatgccctctttttctcaggatagcagataacctgctttgaaagagggcttaattctgtgggtcctaaattttctcctttctctctctctttctgtgtgtgtgtgttgggaaaatggcaagtttccaataccagctttggaggaacgattacgttttccctccaatttcaagtccgaaagaccagagccctcattccaaagccccccacccagatggattttttcgtttcatttgtcatccgtcccatgggagggccccatgtctcctcagaacccatcctggaggcagcaggtcgggtagagtgagtttggcctgctcatgacctccacccctgagattgtgaacaaggatgtctggggcgatgctgagaatgtttttgaagctgctcccagatgacgctgatgatcacaccagattgagtgctgcgatcgccttgagtccaacctctgcataaacgaggttctcataaacaagttcactctaccctaagctaagtctatgtgagcaaacccacttcatcctttgtacctggagacctggttacactaacctgatactgacctgttcatgtagctggaatggtgtgtttcatgcagtgtggaccaagcaatggcatggggtgtgtgtgtgtgtgtgtgtgtgtctgtgtgtgtgtgtttgtgtatgcgttcacacttgtgtgtgtatatgtgcatgtagatgctgcataaatgatttttgatgtcaaagacaaacacattccattgttttaaatattctattatgtaaacaatacgcagagggaccatatctactcttgtcatattatttgtgatggtaaaacatgcatttgcaataaattaagctttctgggaaggcaagcagtattggagccaaacgactgtctcggaacatgtgtgtgttatctcggttcatatcaagtccaaagctaatggagccttccccgccatccagggaggaacaccaggaccccggagtttcttcttagtgctatattttaaagttgcattgacgttttcctccccttccttttgtgcaagttggaagtagcagtgttctaaaagatggtttgacgtttttgctgttgttttatgtttttaaaaatgtatctgctttgtgtttggaaataaaaatctctattttggtctatg

SEQ ID NO: 81 - DNA, 237 bp, Homo sapiens
gagggggagcaggcctgcagccccagaagcacccagagggcctgtgggtagatttgaataaaggtggtccatgggagtggcttcccagggagaaggcaagccccagaactggacagggaagaaagcaaaccatgttggactcgcaatcagtgatgatctagagcagaggtcatcaaaatacaggccacaggcctggcctgtcaccagttttttgtaaataaagttttattgaaacat

SEQ ID NO: 82 - DNA, 725 bp, Homo sapiens
tgggctgccaggcagttaggcctatggagagctgctgtcagtctctctaggaggccatggtttcctgcatgtgggggagagccccatcccccagactctggagtgagtttaatttcccaaggcaagtctgcctgattgtcctctcctttccttaccttcagcaccaagaagtttccggtcccggtacagatcagtgaggaagaggctattgacaagtgtggatttgcccaggccagactctcctgagaggagagaggacagaggcaccaaatcagaagggacccttctctgggctgtctgatagtctgcagagacacagctgcttccgtgctctaggagagagggactccttggagatctgatctcactagtagtcgtaattctttggatgggctcagtttgtactgcttcatcctttggagaaggctccagaccctcctttactctcccgagattctagaaattctcaggactcatccagagaaggaatcagccagaagatcctatgaagacaagatcaaaccaaacacgctgtgttcgccccagttttaataagaaatctgactgaaaacaaatggttgaatgtgctgctaacagagagggccaaacgatgatgtctattgtggcagctgaacaaagtgagacttacagaactggaactgctgccctgacagcaactgaagcagaaagagaagaaaggagcttacaaccaggacactcaaact

SEQ ID NO: 83 - DNA, 2469 bp, Homo sapiens
gtagaccttaggcgagggaaggcatgtactttccctaagaagcgggaggagagaaataaatagagggcagtgggatgagaagaacctcgcgggatgggaagccgcggagggaagggccgtctttggttacctggagagcgggagcagctgcggatcccttatgaagtgcccggatgaagctccagcgctcacgcgctttccgcattgagtgcagcgccatcttgagaagggcggagccgtcttgtttggaatgacgtctgttcagagagccaatcccagtctcgcgactcctgcttgctgggcgcggcttgggcctccaggctgcgcagcgcagccgctatcgggcggactgcagttcttgccgagcaggggagcaggagagtcagtctaagaaggaaatgtgatgatggaaacagaggttggaagatggaagaggacccagagtcaaggaatgcaggtagaaaagaaaagcctggattctcccctaaagcctccagatggaacacagccctgcctccaccttgatttcaggacttcttaccccaagaatctcacccgggaggaaccatctatcatcctgccttgaaggtagtttctgctggatctggtcagacctttgtatgatggattttggaaacccagtggaaggatgttcgctcattgcccccatttgccactataggactatgcgcctcccttttatttactcaatttgcttttatcctgatctattatgttgttgtagacccagttccagttgttacaatactgggttatcagttctaaggccctggcaagggtggtgtggaacaggtcccacataactgcccatgtcgagagctctaagcctaaattgggagggacaccagggacaagactcctgggttcatagcctaggggcctaaggtcgcagcatagagcttccttagatccctttggagatactaatacttgggagaggaagtgaaagtctgaagcattagtatctaggaggcagggatcagaggaagtagattcagaggtaaggagaattttggggctacactttcaagaaagttgtggtcaggacccaggaggtatgggtcagaaggaaaggtagaggcacacgcacgggtgactgttgagtagggacttctggctgcgccatgatctcaaccggctaatgccgagagtttgggatgacagctttctgcctctagtcggcccccggcttccccagggaaattgaaagtggaagctggttccaggtagaccagcgcttccaacccagaagcgttgggggttgttagaaagccattccccagacagcctcacacttgagtcttaagtctggtggccgccctatcgtttttaaccgtccgacaggtgcctggtattttcctccaattctaaggaagggtagaacagaatagcaagcgaaagcgctttggaggtcccttcatgattgccaaaatgttaccagggagtccttgttcttagagctccaaagatgatggtgggccgcttccatgatggcggcaagcctcttgttctctgacctggggttcctggcctcacggatactaaggaatggaatcttgggccatgcattgagtgttatagctctattcagcccaattaggatgaaccccaggcacttagcccgcgcaggaacaatggcaagcctctagcccgattgggagcagcaatggacactgcctcgctggatcacaagtgcagcagatccacccctgccagatccagagggttggaagtcagctgcgggtctgcaatgacggcaaacagtggtggacggcgagtgaaagctcagctcgagccataaaaaacacagaccagaagagtgtgcagttgcaagatttaatagagtgaaaacagagctcccataaaatgggaggggacacaaagggggttgcccttcattctgtttttcataaggactgtactaatttacactcccaccaacagtgaataagggttccattttttgcacgtccttgccaacacatcttatcttctgtgtttttgatagtagtcattctaataggcatgaagtgatatctcattgtggttttaatttgcatttccctgatgatttgtgatgttgaatatttttttcatatacctactagccatttgtatgtcttcatttgagaaattctattcaagtcgtctgaccagtttttaattaggttatttgctttcttactattgagttgtttcaattccttatatattttggatattaaccccttgtcagatgtttggtttgcaaatatattttctcattctgcaggttgtctccttactctgttcattatttttgtagttatgcagaagctttgtagtttgatgtaatcccagttgtccaattttgcttttgttgcttgtcatttggggacatacccataattgatcttagccaaaaggctgagaagtgatttgggtcatattaaaaaatatcattgccaa

SEQ ID NO: 84 - DNA, 573 bp, Homo sapiens
ggctatgaaagaagtcacaggaggatttttgcagagcttccatccagttcagaaacaaagcaattcaatacatgtcttcaagatttctaaaggcaatgacttagtgttgaaaagctaattcacagctccccagctgcctacttgtggggacagctttcttcggctgcaggcagtaattgctttactgctatcctaaattgccctggagaagaaagcaaagctttgcttgctttatcctgtggatttaaagcagtgcctatacttgctctgcatagaagagaacttctcctacagatatttttattctaatccacgcaacacattccagttgaaacaagattttgaagacacgccctagtgtacattttatctgcactggcctcatgaggaaaatcaaataagattatcttacattacaaaattttcttgcatactttatgcaacagtggaaacaacacaggattggaattagaagacctggttttaaataccaaattgttccccagaatgatctgatcctactgcttagcctatctggatgtcagtttctacatctctaaaaggaaggtgtgc

SEQ ID NO: 85 - DNA, 516 bp, Homo sapiens
gtgcatatgcacagaaagttctagaagaacccaggaggcagtgtgagcctgagaagcaaaaccacaaagagaacagagggaaactcacggacaatggtgggagaagcagagccagtgtgcacagagcagtaaagggcagaaccaggagccgacaagagtctcgaagcctcaggcggggcgccagggaggtctgcagctgacagtgaggggatcagtgccacccaggtcctctatgggattcctgaattgttgtggagactggagcagctgggatccctcgctctcatgttttcagttctctgtggggcttgaaggtgtggctgccgtgtggaaatggactcaggtcattgactaacaacatcaacaatgaaatgaatctgagaaaacaggaaattgagagcaagagaaaaaaaagttaattatactgattttgtataagacccctttgaacacatttttaaaaaatcaaatagaaggtgcccaggtccactgtgccttgtgaatatttgtcttgta

SEQ ID NO: 86 - DNA, 1094 bp, Homo sapiens
gcggcggggaggggcggctagccgcgacggcggcggacggagggggagggccgcgagccttcggaaccagcctcgagggtgctgaaccccgcgcgcccgcctcgccgcggcccccgggtgggggcgtccacggcccgggttcccggcgggcttggggcagggacgcagtccggagattccgggactgcccggctgctgcagcccgcaggctcctctctcctccccgcttcccctccgcactgcctgggctaaaggcggccaagctgaggctccgaaagaaaagggaaaattgcaacccttgcctacaaccagactgacagcataatttcttaggaatcaagaatcaatacagggttatttctttagattaaaccttaaaagcccccttggaggctgaagaagcagaggatagccatgcatacacttgaacgtgaaaaatggtcctctttcattggagaggtcttcctcttcagctaaaccgacagagtggtgaaaagaagaagggaccccttgttgaccaaaataatccagacaaatcaaatcggccctttccagcaaggagtggaacagcccaagggtggctagatcacatcttctgctcacaccaccactgagcaaccctctccaggactgccacctatgcataggtcatgccctgtgcaagagcacataaagtgggagctgaagtcctgcccaggctccattcaccaagcagagcttatgttgttgtgtgtctgtgtctacccagaggatgtgggtcctttttaaaatgtgcaccaatgcatcttgtatgagctggcaccagctcggaccatcccaccctcataccctggtcctatccagggttatattccctactttagaagaattaattatttttatgaacgtatttagtttattgtaaaaaatgaaatatatgacacaaattgaaattaatttcagaggtaaaggtcagaatattaccatgtatgtgaattatgtttgtatgtatatgtatatatcaagagagttatatgaatatacatttttgtgtatcagaagtgaggacaatttaactttgttaagtgtttgaaataaaattattttgagttttg

SEQ ID NO: 87 - DNA, 1651 bp, Homo sapiens
tgggaatcttgtctgaacaacaagttaactgctgttcccagttatatctggtctttcccacccccaaacatacacaaaagatttttgtcattcttggcactggacaacagaagtgataagacatgccagcagaactctaaaggcagaatgtccttccacctgttttatgctgtaagacaaacttccaagtgcgaggcagtgtggagggctgttgccttgaatggcagctgaatgcaccagcgggatccttggcagcaatgcccaggcactgaagtcgggcattcaggagagctaaatggagaaaagaaacttgagcaaactgcttcctggaacactgagaacctgaatgggaaattaagaagaaccagattctttctattcttccaccagccaagagacccattacaacttgcttatcgttgggtagaggttatatccagggaagagggaaccgaggagaagtggaggaaaggaggaaggcatgagatgttggccctaacctagattgttccagagactggaagttcaagaccaaggtatagcagagctggtgtctggtgagggctctcctcgtaggtggcagacagctgccttctcactgtgtgctcacctggcctttcctctgtgttcctcagattttgaagatttgttttgaatcttgaagagagagcagcaagccttttggcctatggattctaagagtcacattccaacaggtgatatcaaaaggacaaggaagcagggaggggtgacttgcacggaaggtgcccagtgagatgtctctgccatggagattgtgctgatgccacaagcaaagcgtttgtacccctctcatccacaagagaagtccctccgggtatttcagatgatacctgaaaggatgataaggcagggaatcagaggctgacaccgctattggatggactgggggagtgaagaccaaaaggtcattttcaggaaaaaaataaattaggaagtacagggataagacagaagccaccaccaataactccacacctacagctccaaagcatgtgattcagaaggatccttgttgatattggccatcaccttgtgtcacaataccagtggccgcagagatttaaataaatgcatcccagatacagagttaaaagcatgccaacaatgagggctgtgtggtttggagaagagcagaagagcacactgctttcagtcaggcagaggcagattagattgcctgccacctccagtgggatggtggctccggacagtcactcaccttctctaaaacccacctccacctagtctataaaatgcagagaacgaacaatgcctactccactgaattgtatgagcattagaaagggtgtgtgcaaatcacctgacatttggcagaattcattacatgccagctgttattgaaagtaattgaaatgttgtcaagctagtcagaggaagatttctaactaaaagctatactagcgaaagcactgagaatagagtgtgatatctcctattaaaaaacacatacgtatacataatacatgtatgtaaatactcaatatttttatagatagttgtctaatgagatcattaaaatatatacatatacataataaagttgaaaagttttctcaataaataaaatatatacatatacacaataaag

SEQ ID NO: 88 - DNA, 654 bp, Homo sapiens
attccaagggagagaagaaagcaaccccaggaagcctggccccgaagactgtgaggtatggtggggccttgctgtgctctggactggacaagaggcaccctgggctctggacacagccagatcttcagccaattgcatctccggcccagggcaggccctttatcttatagcccagtggtgcctctctcctcacctaggaaacaaagccaacaggatctgcaccacctctgcctcccggacattggaaggactaaataagatcagagacctcattcctagatggaacgaggaatggtagcgaccacgatcctcccctcccaggatctgcgccacaagggaagatcagaaccttcagctgccagaagcactgtggcggaaatgtaggtccccatccaggctgatctgagcttggctttctggagcacgcaaacctcgatgcactgaactgctgccggacctcaccttgccaggcccactgtgctcacactcacacatcgctccatccactggaggctgcagaggcaagatccaccaagaagatggtcttcctgtccaggatgcccttccctgagagaagtgtatttaatcttaaattcagatgtttgtttgtctacccacttaaaacaccctgttgaataaaaattactcaaggaa

SEQ ID NO: 89 - DNA, 371 bp, Homo sapiens
gaattgtactgaatttgaaaaacaagcatgaatctttcctataggataggaagcctctgatttataccataaagtgaaatttcatatacaggatgtatcaattaagatttaattcaaaaaagatgaatttaagttaaaaagaaaaacacaggataacttccattcatctgatgttcatatgccctggcacatctattgcttcttataatgtgcttgcttaaaaaaaaaaaacatgagcttttctcagagacactaatataatgaattcatgtacccatcaccaacttctacaattaccaatattcagcctcttccatttacaacctgcccattttctaagaaataattaaagcacatgctacacccataaa

SEQ ID NO: 90 - DNA, 883 bp, Homo sapiens
cttgcaagaaacctcaggacttgagtaacagcaacatgctcaccaagctcctgtatctactggaaaatggaagtccagccttaccaacttgtgaaccttgtctgaagggagccagggcctgccaatggaaccacctccaggagctgcaactgctgttgtcattaataccattgtgtctattttttgagagagataaacttttcatggtgttacattttggaaaaaaaaaaaaaagactaggtgaacagtcaggtaggaaagcagcataacagtcccttaaattctgatcatgtaggacattcttctttgccctgggcctgggaaaatgcagcatgttccagagcaaaagtcctaatgaggggaactaaaccagtgggacccaaaccaatgtcctggctcactgaggacccgttagaaccaaatctctgggtgtggacaggctcccatacttttcaaaaattcccctgatgactaatgaacaaccagaggtaagaaccagtggcccagaggaataaccagcccagctgttgtacgagctcgctaagctggctcaggtcaatgttgaattctctgctaggcagctcctcataagaactggcagagatggttcttacacaacaacaggtgacaactccagactctgccggaagttccaggatctgggttcccggacaatgcatgacactcagtccagcattgcaggtggaagagcgacggtgaaaagaccaaagtcaattaaaatgtgttaaccaaaacaggaaacatgagtgaggtgattgagagtgtgtttaacttagatgtgtgattttatcaatactttcattgttcaaaaactcttattttttaaagatattttcaaaacaaatccaaactttacttttca

SEQ ID NO: 91 - DNA, 766 bp, Homo sapiens
aaaacttaactcaatacatcttggctactttgcctcaacccacggggttccctggaaacatttgttgaacttggccaagaggagattgtatatggatggcacacctggaaaaggggagaaagcacactagttcatctcttttataagtagaatggtcccagggatgttaacctttctgatgctgatagtagatgagtggagtggaggtaatcgtgagaaaacttaaaaacccttaagctgtttggagactacacaccacagtggagcaaaccaaggtggggcctcactgcctcctcagagcccatccctgaccatgtcattggataggatggaagacaaagtctttgaaatggaggctgggctggcaaaagtgatatcccaagtgacacagaaacacagctcctccggatggtgaagtctccgctgcaaaactcacgaaacagcacagaggatgactctagggtgctctcccacttgctccaagttaggcaggtgccctgatggaggcaaggctgagccattaacatgcacagctccatatcctggaagcctctgtagccttgaggagataggctctatccaacaggactcagaataaatgactgccacctcaactgagcagtatgaactgcccacctcaactgggcagtctgacctcttccacagtctttaagaaacagaagagccatttgcattatttaatcaccattcaataatctcctccctccccatagctgcttgagttaactgtcccacaagtgtcctg

SEQ ID NO: 92 - DNA, 2344 bp, Homo sapiens
aaaaggaccttcctcataatcaaaactacattttcaaaataattaagaagtgtttgggagctgtgagaagatcccagaaatcagggaaaatcctttttctcccatcttgttcctaaggaaacccactgccacgagatctgttttccaggccttgaatgcttttattcctcatatctgggttttcttctcttttctccagcctctgcctctgaatgtgaagggaaactggaccagctcagtgtcaagcctacagacatttccttgttcctggggactgagcagtttgaagtttccaaagatgaaaacatctactctgaagagacctgaatggacaagagatgttttcctcttccttaccataataaaagaggactgctcctgaccacaggatatgcctggtccaggaaatggccacatttcccccctcaggacctctacttggatgggctgccttggaaataaggaagctcaaactgaggcagaatcacagcgatttggaaaatggtccaatcagctatagtggaagagcagaatcattgaatataaaacatggagatgtcagcagcaggggctgtgagctgaacagcttcactgggaagaggatatgggtgagaaggtacagcaatgggtacctccattaacaggtaagctggatcctccataggaataggcactagctggttttggatgaaggtgtcgtaagatcagatacacttttgggtgatcagcatgatctgggtatggacatggcagagcaggtggaagggaagggaccaatatgtgtcaataaccatctatgagccaggcacttaccgggaagtataatgtctttgtagttagacagaccagtagtgtctgttgctctggaggaagttacttaaactcaccaagactcagttttctctgtattaaaatgatgacacctacctcactatctggccattgggattaaatatgagaatatgtgtgaaaatttatgtcatatggtaagcactcagatgtttcctggtggaacagcatggtgtggattaggaacatccaaactctgacatcaagctgaacttttgaaatagaggcctccctgctcactagttgggcaaccttgaacaagctagttaaactgtctagagctcagttttgttatctggtgagattaatagcattgaatggtgtaaagcacattctcagtaaatgctcattattatgattatagttattaatgtttatttaactttgaaataataatgtgtaggagctcctcaggtagataatggaaataagaaatttcttaggtcatggaagcatggaggtatggaaaattttggagaacaaagaggagtctggtgaagtagggtggggatactgggcagatgcaaagattgccaagggttatatcataaaggccgggataccagcctggcatcaactgccttagattgggaagatgcaaaactgtggtctggagtcagccctgcagaagcctgtttcctgactttccatcttcaatctcttttctatgcagttaccagagtcatgttttgaaatctcaaatctgagcatctatcctcaaatagaggcctacatggcttccagttcctccaggagaaggtccaaatcccttaagatgactttaaggccctcaagtgttccaggctctgtacgttcttgtgccacaactatgccacaacaaaacagtttttcccccatttctactttgtttttccagctgtagagtcaaagcctcaagaaggggaaagggacgaatggacaccaggtcatgtgccaggtagctgggaaatgaatacttctattttctattcttttttttttttttttttttttgagatggagtctcacactgttgcccgggctggagtgcaatggcgcaatctcagctaactgcaacctctgcctcccaggttcacagattctcctgcctcagcctcccgagtagccgggattacaggtgcgcaccaccacgtctggctaattttttgtattttttagtagagacggggtttccctatgttggccatactggtttcaaactcctgacctcgtgatccgcctgcctcggcctcccaaagtgctgggattacaggtgtgagccaccgcacctggccaaatacttctattttcatctcttaggaaagcatatgatgtaaatcactgttcccatattcaaatttaaataatggcttacctttccggggatgtttgtatttgaatgaagcagcaagtttttgccacactgtaatactttaactttacagatattttgactccttctgtttctgatttgctttcataaatgaataaaaatacattattttacatcaaattc

SEQ ID NO: 93 - DNA, 3342 bp, Homo sapiens
gccatggctcctgaaagaaataaaagatgatcatctttctaaaaagtcttaagtctgaattattagtaacttaactggagaatctcacttttcctactctcgtattttaaccacagttgctctaacacagacctttgaggatcttttcatgacttcattcacaaatacctatttatgctgtacagatgctactaggaaggaaatagggatgtctgttttgactgtggaacttaacttggtctcgtctcttcgtgcatgcaaccctgtccttgggatagctttcttgagcatatctacttatgttcaagaggtaaattgtcctgaaacccccattgctataagtatttattttattactcataatacttaatgctcctaaagttggggtatttttttttttggatacctaaacttcattgagatactttgaactatttatagagaaaacggaaccttctaatacctggcttctatttcttaaaatgttatgatcatacatggcttagggctttatggccaaataacttcactgaacccaggaaaaagaatagatccatctgaaacagacctgtagcttccagaggcctaaattttcggctccatttgtatccttcattttctgtgaggtaaagaagtggaaggagacaagcctcagcccttcccctggcacctttactcttcgcccttcctcctggcatggtggaaagtgcactggaggaggagtgaagggccctaggtttgcatccatattctgccacttgccaaccttaatggcccttacaattgatttaccctcatgaaatttggaatgatttctaaagtctttcctcgccctgaatgttaacattttttgatagtcaggactttctgtagcttcaccttccttatttagtgttatttttttctcaagactgaacagagagggaagctgtcaaagtgtgctgggcacacaccctgcagtggggcaatggccaattctaatctcaagtcattaggctgcagtagcatgaccactgcttcctgtctaccctcagagggtagagacagctgagctcctgtagttggggtcaggcccagccactctgtggggacagtgattagtgttgtgtcaccaattcagggaaggagccaccttgtcttattttccctcttgaattatcttgatatgaccccattataaatttccttttgtaaacctctgtctcccaatttctccttttagcttactttctattgaagtagaggaacagagtacaacttccatcctctttcatcagccctgagagcagaacgcaagcgccgttactgggaactatatccttggctccctggatgtggctattaacttctggcctgccactctatcacatacacatatggagatggtgtcatccatgtaccttaccccgtatttacaacttctatcacccaacagtgccaatggccctgatggtccctctgggagggagagaagagtaagctggagtcaccccttccctgtacttcccacctcgccaggcctgttggtgttagtgtcccttctgatcttggcctgacccctgtgccctgggcactgggctgcaggttggagaggcagcatgatggagtggggataacacatactccaaaaccaaacagaagccagacctgggttgggtcctggcgaaacagtctagaggcttggtgaccttaacctcctaattaatcttcctaagcataagtttccttatcataagttatgtatgataaaattttccttggatgcattcattttagcatgacttgaaattatgtgtgaaggaacctggcccacggaagttgccctgtaaattcagattcactttcccttggacatatggatgacattagctcattacagttatgacctccctaaaactcccaaatattctttaagttcttctcttattttccctttagtttgtagtcatatttcttagttcttatatcagttgggattcccacatcttctagttggacaatattggagaagacaccacattttaactgagttccagtgatatgacaggctttcaattctctaatctcacagaagttagaaaaaaagtagataatcaaaatccacagaaaatatagaagattccattaactctgagaatgattctcaggtatccttaggacctcaagaaagctgttctctcctgggcctgtagagagttcaagtgccaggaatctaccacaaagtagccgggaggtgcagggcagcagggggcacagtgaagtgctgaagggcttctcagtcttctttaattagagtgagaagaaaagagcacctcctcattttagagtacatggtgtgaactcactctcagctgccaagtgagcttcaccttgggctgttttgcatgctttctcctagtgctttaagccaccctgagatgtacagaccaatactggccatcacaaaaatatactcgagtacatagaccattgacactataaagcaagtaaacaatgaagtctacataacagccaaataacaacatgatgataggatcaaatctgcacatatcaatattaaccttgaatgtaaatgagctaaatgcctcaattaataggcagagagtggcaagttggacagagaagcaagacccaactgtatgtcttcaagagacccatctcatatgcagggacaccaatagcctcaaagtaagggatggagaaagatctatcaagcaaatggaaaacaaaaaacagcactctctgtccaacaaaaacagaatatacattcttttcagctgcacatggtacatactcttaaaatcgaccacaattgctttattggccagaaagcaattctcaacaaattcaagaaacctgaaataccggccaggtgtagtggctcacacctgtaatcccaacactttggaaggctgaggtgggcaaatcacttgaggtcaagagtttgagaccagcctggccaacatggcaaaaacccatctcttctaaaaaatataaaaattagccgtgcatggtggcatgcgcctgtaatcccagctacttcggaggttgagtcacgagaattgcttgaacctgggaggaggaggttgcagtgagctgagatcacgccattgcactccagtctggttgacagagtgagactcatctcaaaaaaacaaaaaaaccctgaaataccaaccacactcttggaccacagtgccataaaaataaataccaagaagatctctcaaaaccatataattaagtggaaattaatctactcctgaatgacttgggtaaacaaagagaaattaaggcagaaatcaagaaattgtttacaactaatgaaaacaaagataaaaa

SEQ ID NO: 94 - DNA, 794 bp, Homo sapiens
caatttgaacgacaatggacttcttatcaggagtcatgaagccacatggaagtagcaaacattttcaagtgctgaagaaggggaactcttaacccagaatccttggatatccactggaaacaattcatgaaggacattctcagataaaggaaaactaagagagtttgtcaccagcaaactgaggaagctgaaatatagtggcatgtatagctgatcaggagccagtgaggaaaccccagggacaggtggctgaaaggatttaatagcacagaaattgtatacatcagggtccaggaggtgaaggagatctctttacatgaacagtctacagaaatcttgagtaaggctttggatttccacagtgcattgacctaggcatttaagccaatcatatctaaattcaaatggcaacaaaatatttttaaaaatctttcaaagcaggtgatgctacagtctctgtgcttcacaaatccaagttatcattattggctaccactcctccatatgcacaggcaataagtcaggtattccttccagtaattggggctacaatgtaaacttagcaaagcttccagattaacacatttgtaaaaacaagacttcctaataacctgtcatctgctttcccaatttctctataattttagtctgtagatgacattcttgtggagttttaggtgactgtcatattgcagccatctggcagcctgtttaagaagcacaactctgacattataagatgatgaatcagtggttaaaaacaaaacaaaaggtggttgatgtttattgtaata

SEQ ID NO: 95 - DNA, 3167 bp, Homo sapiens
tactgtaccctcccggcagcctccggcagaacacgcagcagcagcagcagttagcgctgatgcaactatcgttgctgttgccaccgcctccccactgacggggcgtgcacctggggggtacttgcagtttccaggggcaacaagcatctctctaccaccctctcctgcgcccctgagagaggctggctccaagcttgatatagaagactatcatatgaaccagaaagggtaactgaaaccaaagaaatgactccagtatcaagctaaagacatgccttaaaggatgaggaggagcagaaatcttaccagcaaggcaagaaagaagccgtacgtgaacagcctctgctttaggcccagaaggaaaagaagcttacaggagacaatcagtcttacactcttccatggtcacaaacaagaggtccctggatctacagtatctaggcccacatgcaatatgactttgcaactcatcccatcagaggatggaaactatttcttcacccccttgaacctgggctggctttgtaatttgttttggccaatagaatgtggtggaagtgatggtgttaccagaaagagttcccaatccagactcgtgcgagaaagaatttgagaaatgaaagaaccagagcattatagcagaacgaatcctggaatgggaatggaatgcctggatttgtggcacagttgggaagcgtcctggccatgccatgttaaagctgtctccaaggcagtgattcttacccttggctacacattggagtcatttgggaagctagaaaaaaaaaatgcccaggacctgggcaagacggctgaataagaacagctctggtctgcagttcctagcaagatcaacgcagaagggaagctggcagcctgggctcttggagattgtatctggtgccggagaggactggctcccacactcagtgagggaggaattttactgacccagcatccagatgaactttggtgaggagaggagacggagtttcactgttgttgcccaggctggagtgcagtggcgtgatttcagctcacggctacctctgcctcccgggttcaagcaattctcctgcctcagcctcccaagtagctgggattacagatcatgaactggcagccatgtggaaagaagactagactgcgaatcacttaggatcccaccctcggtttagtctagaatactctgcgaatcagctttttggccctaggtaggaaagagacaaatggaagcaaaatagcaaaatggtgaagaggagggttctagaggcagagagccctgcagtcctgagtcctgagtccaccgtttaacagagtgactttgctcagcctgtggattataatgaaacttgcctgttataggatccagttttttaggtggtagcaacatgctcaaggaagatgcagccccttcctccagcctgagagaataaagcatcattggcttatgccaaccatggcaatcccattccccttttctcatgattgatttgggaatgggcaagtgacccagttctaaccaatgagacgaaagaaaaagtctattggtcagcttatctcagaagatttttgtttcctgctataaagagaaacagtaagttccttcctgcctgacttaaatgcaattgtgtgcaaacatgttacttggagctacagcaacgattctgtgaccatgaggcaataagccaaggacaaaggatagaatagtgaaaagacagagtattggattttttttatgatatcattgaactgctggaccaatgtggaaccatctacttttagtctttcatgatttgtgagatgattaaacatttcttttttttagccattatttcttttctgttacttgcaactgaagacatcctacataatacaaacactatccaacttggattgtaatttatctattttcagatctgtgtgttctgtcttactgatttttgtattcttagcactgagtataaggctgctacttagtaagacttcaataaatgactgtttaaaaaggtcttagaggatttaaaaaaaattctgaagttgctgaaatatgaagaccaggaaccaatttcaggttctataaatttctcgcttccttcacttctggagtagtcttcatttctgtctgattctacctttactaaaatgaatgaatgattgagaaatacgaaaaatggctggtatagtggctactgctgagaagtatctcttggaaattcccggaaattccatcagtcacattcagacctaactctctgatgatcaatgtttctgaactcaaaccagtgtacataagcagtggactatttaaagtggtattagcctagaatatctaggacccatgttttatgcattcagtaagcgtttgtttaatgtctgttatctaccaggcacattattatgcattgggcatatagagatgaccaaccacacggcctcaatccttgaaaagcttacagtaaccaaatagggttaacggcctaaagagaggtaattacaagtcttacactcagtcttcttagcatagtatggtgctacctctgagttaattaagataacaaaattcctagatatatatctttgatgaaacggtttccatgaaaactttccaagtttggtccctccccggctgagttcattttggaaggtgactttctgctctcatcacctaaggtccttaacacgtatcctgtgttctccggaggcaccccttgcccagagtgtgccctctgcatggttcccccagaacacctatttcaaaggaaaagaagttggatcattcagtgaagatttggggggccacttttctacgtgggaggattatgagtattaccttcctcccctatgtattagtaaatataaagaaaacataaattaaccccctttctggctgggcacggtggctcacgcctgtcatcccgcactatgggaatccgaagtgggcggatcacttgaggtcagcagtttgagaccagcctggccaacatggcaaaaccccgtctctactaaaatataaaaattagccagatgtggttgcacacatctctagtcccagctactcgggaggctgaggcacaagaactgcttgagcctgggagcaagggttgcagtgagctgagattgtgccattgcactccagcctgggtgacagagcaagactctgtctc

SEQ ID NO: 96 - DNA, 449 bp, Homo sapiens
gccctgttcaaatggttacaaagttcagctagagaattccttctccctgtagagttttaccccctgctcctctggccgccctccggatggatctttgtgttgccaggcaggaatgggctgcttggggacccagtgagctccgagggcctttctgctgcttcctgtacccctgtatttcgctcagctctctgacttgactcagctccagacatctacccctggagaaagagcccaatgagaagtaatctctgaagcccagatttcctaaggatgaagcttcaggagaggccttatcaatcctgacaacaaacttttctcgtcaatttagtttcatttaatggaagttttaaatgtgtaaagttcagaaggctattaaaattggttccagctatctaagatacacacacaaccacacacgcgcacacacggtagagataaatatgttcgaa

SEQ ID NO: 97 - DNA, 1032 bp, Homo sapiens
catttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaagatgaacactcttcctgatcctctcctctagaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacagcaaattctttagaaaaggaaaatacagggaaagggataaacctcactgacttggaggaaatcaagaggagtgagcacagcatcagaaagccccctggccccagactgcacccgctttcctggccctaccttgaaatccatcaggtctgcgttggacacggcattgtacatgggattagctctggtctgacctaggagctggaatgccagtaaaaggaggaagctcacggtggtggtggagaaggagctcat

SEQ ID NO: 98 - DNA, 618 bp, Homo sapiens
acagtttgctggacctcacagaggtgattgatgcagcatccccccgggagccgggtgaaatcacagactccagcagcagcttctgagatgactgtggctaacaaatttttccagcaacacagagctgagaggattgggatctcagagaagaaggagccctgcattcttggcttcatctgcctggagtggagtttccatcatgctgagctggaggtgcacggggccagggaatgagcaagtcgtagctcaaatgtcccagactcttactattcttattgaaatttagtaggttttcttgaataaatgtttcttcatctgctgtatgcccttaggacaattcccaggaacatacatctatattgatatcaatataaatataaatagataattatgtatgtataactttagcagttttacttgttctgctggaaagaaggtctggaaggtttgcagagctgctcatgccaccattccagaagttatccaccagttcattgctttttgcacagtagtattccattgcatgtctatgccacaatttgtttatccattcacctgttgatggacatttgagctgtttcctgtttgaggctattacaaataaagctgctttacaaa

SEQ ID NO: 99 - DNA, 561 bp, Homo sapiens
agtcatcaatggatgtagaatttcaggcttactcttatttcatttcagcatattggagaccatgaattcaggtctcaaaccgtggaaggctggcttgcagttgtgaattaccaggaagattttgtttgtttgtttgcttccaatgagaatcaagatcaagagaggctggagtgcaatggcgtgatctcaactccctgcaacctctgcctcctgggttcatgcagttctctgcctcagcctcccgagtagctgggattacaggcgcccgccactacacccagcaaaatgttgtgagcacctaccatatgccaggcactgttcagtgaactggttgtacaggagtgaatgagatcatcttgattttgagaagtttataatctactcaagggaaacacgtgtaatcaactatgtttcagacataacccctcaaaaccaaagcagaacctcttcaaggagctgagagatgcaagcctggctgtcggtggaaccatggggctgagtcacgtctgcccacagctgctgctgttcgcatccctgggcactgaggcctgaaactccacc

SEQ ID NO: 100 - DNA, 9346 bp, Homo sapiens
ttttaatactaaaaacattaatagaccaaacatctccagctgggtcagctgcacacctttgtacatgtctgatgattcagagtttaaatggctgtagttacaatttctcaggtaaacaattgttttctcaaatttttaccaatccctgcattattaggataaattttgagacagtgtaaaaacctcaaagtacagtagggtaagtcccagccctgttcacgtgaaagccagaggtggcccttccccggcatctgatcgtctgatcatgtgggtgcctggggccttgccacccttccctgtccactgctgcccccctgggcctgtcaagatttgaggggtgcccactcgctggctttgtccccatcccactgttaagtaaggtgtgccttgctttaagcaaactgaatgtgaaaattatgtgtagaagtctgggtttgtttaaaagaaaaactgggattttatctcatctctttaaaagaggtctcccaattcgatttctgtactgggactcttcctggtgtgtttttacatgttcactttttaaaaacattgatgtactcccatccttttaccactaccctatcacatttgacaagttcttgctgtaatgacgacgcaattaacgaacaccaggggagcggtggaaagctgccctcgtgtgtgagcccttcggtgacgcaaagccaccgtcctgttgttttgtgtgtcctaagctcagattttcctggtttggataaattttgtaaaactgggcatagctgtacttttagaaagggatcgttttccttaagttttggttttctctggttcaagcagtctttacatgcagccttttgattgcacatcagggtctcccttttcttttccagatgatgttgcttttcggtggtggtctcacactcctttgaatgaatgtttgcactctagaaccacaaacgatgcgtgaccattgtacagcttgcccaagagggaactgttggaagcaggcagtgacctccacgctgtttgtttgaggctgacctaaactgctatcactaatgtttacccccgtgacggagtgcccattagaacagatcatgtcagttcagttcctgtagtggggttagtaggtggggggttttattgttgttgttatttgttacttttattgctgttaaatgcaaatattgctatttattttttcctttctgctctggtttggtttggccgacacagatattccagtgcatgtggtacctaatggatatgatagaaattatttccccaacttttataaattgcctaatgtttaccttcaagtttgctggatgatttatttttgaaagccacaaatgtgatttttctggatgaattgtttttcttatatatgcagcaatgtaattttacattgatctgcggggtggtttaaattttatttttacaaggcagtttttcagtcaaattatatatttgatacaatacgctaggatagaccggccacacgtcaggcagccgggacaccggagtgtccccaggaggcctttggggctggggtggcccgtggcttgttccctgcgcctctgggaactggatgagtccttcggcgggactgtgacccgctggacagttaaaaggatttttcatgggcattttcctacacataaggcagttccattaggaggagctttagaagtcgacataatccagacagtggacaatcccagtggcccagacaagccatacgacattttcctgtgacctctctctgacccatctctcacgctcatgagaaaaggaatgtacaataaatagaaacagaaacttcctcagtgctcatgcgcctcacttgcagaacgtgagtatttcatttatgtttgaagcccttccccaaagtgaccgaggagttgcactctagctgccgtgccagcagtctcgtctgctgtgacgcttctcggtgcggatgcagtgcacctgtgactttgtcatgggggtgcccctgttacacacacacacgctgactcttttttatgaggaaaatcttcgactcaaaataattgcactgattttttgacaacttctttttacgatgtcccacttcgcatctgctgtacttgtttgagatgattgtaaatagatttgtggtaggagaagtgacatgaatgcaacacgtggctctgttgtggagacactgcctcgtattcagtattatgtgttaaagttgtgtggacttaactctgttccgccctttagcttcgtgtctgttgaccatttatgaaggacaagttcgcctcattttctttttcttctgaagggaagttctagatcggttactaggagaacatggtctcttggtgcctgatgatttagtcctaagcagactcgttgcagtcttgtgaacactgttgtggtctgtttgattcctcgtcgcttaccgtggctctccaaagcatggtctttgagttccacccagcctgggacagtccagacgggaggcatctgctccgcctgctactaggacgcaagggcctccttgcatctctgtggtcagagtcatcttaaagccatgaggttactgtcgtgtcaaagctgtcatttgtgcccgttattttgctggagtagcagcgtgtgctgtagcccccgtgtgtcactctgtggtcaggctaccctgtgtcacacccagcaagaagtttttcagccccagaccagtctgtgtgtgtgtccgagtcacaccagtgccattacggtgccctcgcttatgcttctttcagtatgttttgccatgttattgtctaaagtgaatgtattggcttagccaaatcactacagaaggtggttcctaaataccttttagtttaaaaaaaaatgcagataaaggctacctctgaattctcaatagattcatcatgtttgctcttaagtgtagctgtccacactgaaaacagccaatatgttgcctgaataaactgaattgtgaacatctatctgttcagttctggcttgaaaatgtgtgtgccatactgtgacccacgggcagcccctcctcctctactgtgtcaggtggaccagggtcacctctgttctgcgcagctttgagattctaggattctacggccggcacgaatggcatgggagggttctctgcacgggacggcataacggcatgccatccttcaggctggcaggagcctgcgcaggtgtggcaaaatcttgaaacagcctgtgtcctgcctggcttttcactttcctatttaatataagaaagcacttttttttctgctttacctacaaatgggttgaaaatggcctcctctgtcctctcctctcttttatacactctgtaaaatcacaaaggtgcttcaacaccgactgtcatgcaaataatacatttaaaatagttgcatggtttcaaagacaatgcagacgtaattggcctttgactttgggacctcgggttactctcactccctactgcaaaacaaactaagggttgaaagcaaagcattctgttcaaatccagggccctttgtttgaaaagaacacagggcccacagctggtgttttgaagtagaagttcccactagtggcgcagtggaccgtctgatgcagacttgcaggaagtcggtcctgggaggctctgaacacccctccctgtgattaaccactttgctgtcagaaatgtcattttcccatacactgtgctgtgggcccggggcctccttcgcttctttctttgggttccatatgttgcccgatcttgaggttagcgctcgccccaatttctccatgagtttactctgagttgacaggcgatgatctgacagttggaggtgtctgggtgtttggaggtggccccgttctcatgttggctgctcatcagacattgagtttggccccggcggttctactacgtcactacctggaagcaattgcctttaacactctgctgtttggggtttcgatgctttttatgctgcgttgcgtgctttcattccggaagagctaagtgtcctttgcagtctctctgagaatgttttgtaattctgccgccacgctgttctgtgcggaccgacctcaagaggcttgggcccccgtgggtgtcccactgcctgccggcccagggtacaggctgcttgggtccgctgggctggccttgggctgtcagaatctggtccagggtgtttcgaggggacactgcacagccgctcgcccctcgactcagtcatgggagctgcagcacgcagatccaccgcaagcttcctgcacgcgcatctccggaatgctgcgctgggccctcccaccatcttcgcgtttgtgagaatttactcagaagtgagagaactgaagattcctggtgcttttgttaacacgtttctatcttattggttggtgtggaaatgttagatgtgttgttaggtttttaaatgctgtgggtggtatgattaaagggttaagtcctcacctcagcccccagcccccttttggggggtaggaagaggctgagttatctcctatttaaaacctccttggatttaagtagttcagagttaaagctaaaacaccaaatattaactctttcccccaagtgtctccaggaactggacgttggggccattcttattcagttctttctgtagctccaaggtccttaaaatgagtgagttgatcccaagaacaccccacagcaccaaccagcagggcacagtgcaagcgacttcatagatcggggtgctcgtgtaggggtccggggctcctttgaactctgggagttgtgtgcgcagtcttgggtgggagacggcaggtccctctgtcccaagaagctggtggtgccaaggccttcctctgtctccatcagtgccagcctgatcgcgttctggaagacccagtctcagactctgtgcctttaaagtccggtcctcagtgtcctttcagaatcatgttggggctgcgtttctctggggaactaagcctgtgccattccacaaggcaggcgtggacctccagccttggaagctttctttccgctcctcagcccctgacttgtaaactgtgatgccatgcagtctggagccgcgggggacgcactcggtctcattgcggaaaacacttggttccagtcgtgtggtttctcccataccctgaccaagtccacctctgccaggattgcaggagattggtgcaagacccatctcttatgcattgaccatgaccatcagcaaagcctggtggtcttgttctcatagtcactcgagaagaatatttattgtaatggaagtagattttttaaaaaaggaattggaatcatgtctttgtagaatgtgtgtgtgtgaagtcctcagctgtaaggtgctattcagtcctgtgacccttattttggaatgctcttcattactgttgctctgttttgtgacttcctgggaaaccgcttactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcgtgactcaaatcctacagtatggagggtggcgttgcattgaaattccaggcctgagtttgatagtggattttaatgtagttgttaaaggtatgaattcatgttttataactgtagaggcaagcaagtttttattttttaaaaagttttgagagaataatttataagtttctgtgcagcaaagtggctaattactcattaaatacaggaaaagaatgtagtatctaaatccagctttttcttacctctggtacacttcagattacttacctaatacatattgagggcttttaacccttagttttatcaatttttctagttttattttatttttataaaataattgaaaaagaaccaaaaatgaattcagaagttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatacaattctgaggcttcatgtcattgtctttagttgaataccatgctgtgtgtcttgaagatgtccacgcttgcatgatgctaggtggcaatgccactttaaattaagccttaatcagatgttaaatttgtgagtttcagagtatgcaaaaatattaggcagagtgagtgtaaactgttcagatcaagatgctgtatcataattcaagttatttttttctggagttaaagggaagcattcagtgatacacctctctctctctctctctctctccccctctcccccctccccctccctctctctgtctctgtctctgtctctctctctctctcttgtctagcttggctatggccatagcttgatgaaaatggaccattgtgcatttctgtgacagtcaaaaagacctgttctaaaagtcttgcgactttttcagggttttttttttttttcatgtttctttttttttttcccctccagtctgagatttctgtgtggctgatggagagtgtgatttgggcgtaggtcttatttgcaaacctgctcatgttctaagctttcttcaggtagtaccacctgtcatcgcttctgcatatgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtgaaaagaaaaaaaaaaatgtccaagagcaaatttaacattttacaaacaataaagtccaaactcctctatgcacatatttatagcttatcacttcattttctgtgccagtgaaggggtggccagaaaaaaaatcccaagtaccctcatcattgcttttctagccattcatgccccctcttcctctggcacattttctaagagtttatttcataagcagcaaacggactgttgtcgatttcatctctcctgacctacctggtggaggtgctaatggccatggacagaaaggggcgagccagagctcgtggctttgtggaggcagaggcctgcattcagcagcggccctgtgtgcctgtaagttaggaaggctttctgacaggtaagaaaatgagataggttgatgacttaccatgcttttatatttggcagtttacaattctagacttttcctactatggcgatctttttttacttaattctttggaggtaacaatattttggagtcttaagaatttgattttataccaataagaaataaaaattagggatctttcctgtagtatatagttttactattttaaagagatctctgaattttacaagagaaccaacattccttaatggcagaactttgaaagttgatttgggaggctttttgctgcaggatctcaaaaatagagagagagatgattctacttaaatgtttttaattttctaacttccatcaggttgatacttaagctctattttgtaaagagtaaatcatcctttagtatgctgcataagatgatcagcattcttgcactttctcagtaataagacgtgccgggcaattggctccccaggacgcattgtgtttttaacctaacgagaggactttggggcaggtgattaaatttatataggtacctcaagaaaaagaacctgaatatgctgcattttctttctttagcttttacatgtagcattttgttttgcttttgttatttttgttttgatatatgctttttggaccccaatagactgttgaaagaaatttaaaaattactcttgtagggatatagtatccttaaaaaataaaaatttaaaaaaatttaaaaaaattgctgcaatatctggctcgaaggttgccctatattagaataatactttagccaaatacacctgaggaggcagacactgtgtttataagcagacaataatgttctgaatccttcctgttcatgctgctttcttaattcatttctccatgtcatcaagaggttggataacttatttctaagctcaaggttaaaaatcatgtcacctttttttttttcccccaacacagacctcagaaaaattgcgattgaggaagtagcatgatcctaaatgtgttgctgaaatcaggcagcccgagcctctggtctctccagagagcccgtcttcacatttctctattcctcagcactcacccgaaactgaacagatggggagtggtcttgattgtcaagataaaactggtgaagaaagctaaatgctgagaaactgagcatctattgtcgtgtttaagcttagctgggtcctttctagtttgtttttacagcttactaggtgaagtagtttgcactatttttgcaataaattcatggaaaacctaacagttacttgttttgtttcttactgtgtgtatataaactaatactaaaagtttggcatagtgttttttcacctccttacataacccctaacatgcacagaatgctgtaaatctgataaaatatgatgtgaatgatattttataaagttattttgtatggtgtcaattttgttttgcctcatagtatgtcagcaaaaaattaaataaaagtcctcctatttaca

SEQ ID NO: 101 - DNA, 789 bp, Homo sapiens
tggcctgcatccactgtctggcactccctagtgagatgaacccggtacctcagatggaaatgcagaaatcacccgtcttctgcgtcgctcacgctgggagctgtagaccggagctgttcctattcggccatcttgggtctggattcggcattacatgtcttaacggaaaaatcaactcaagatggattaaggacttaaacctaagacttgaaactataaaaattctagaagataacattggaaaaacccttctagacattgacttagataagtatttcatgaccaagaacccaaaagcaaatgcaataaaaacaaagataaataactaggacctaactgaactaagagcttttgtgcagcaaaaagaacagtcagcagagtaaacagacaacctacagagtgggagaaaatcttcacaatctatacatctgacaaaggactaatattcagaatccacaacaaacacaaatcagtgaaaaaatcctatcaaaaagtgggctaaggacataaatagacaattctcaaaagaagatatacaaacgtccaataaacatgcaaaaaatgctcaacatcactaatgatcagggaaatgcaaatcaaaaccacaatgtgatatcactttgctcctgcaagaatggccataatcaaaaaattgaaaaacagtagatgttggcgtgggtgtggtgataagggaacacttctacactgctggtgggaatgtaaactagtacagccactgtggaaaatggtgtggagattccttaaagaatgaaaagtagaactaccatt

SEQ ID NO: 102 - DNA, 693 bp, Homo sapiens
ttacaggcgtgagccacggtgcctggccccaggccttttagactgaactcagacatcacctccttcagaaagccttcatgatgagtgtttgtgtctgcgcaggcatggcactaagtgtcccatggcacatttggccctcatggaggcctcaaaagggcaggaccagcaccctcttctacggaggaaggaacgggcacagcaggtacatgatgtggtcaaattaacaagaggcagaggccggggtgagccactgcgcctgatcaaggcatcaccgttgaacctcctaagaggaaaacataaggctgtgcaataccaggaactgggattctaggttgccccagacaccaaggcatcaaaagccaggggatccagagaaaacacagacagccaagagagaaactgcgggaaaaagccaaaaggttgagagccacaccatctagaagcttcctgcctgtggtgcggcacagaaacaaggagagtcagcaattaccagccagccaaggtcctggaagctgacgtagagctcgtgccgacggcagacctgccggccgtgggagccgcggacgtcatctgcagggacagaaggggcaaggtcttttctggggttcctgctgtgtgcagctactatggggtaccagggtgggggatgccctgatgagcacatttgtcaaataaatgaatgacaggaaacca

SEQ ID NO: 103 - DNA, 4527 bp, Homo sapiens
agagttccgactgaaatttgagaagctctttgctattcaagtggatatgtgcagttgacagtttgagagatgcatctagggttcagtaaagacaacacaagcctgtctttagggtctacctgtgaactgtgaacacagcaatgagaatgatggacatcacctttaagtatttttctagactttattactcatgtgtttgtcatgaggtgtaacttagtagttcatagtcctataatgtatgttattgactaggtagcatttatttttctaattgtttctgttatagtgctgccacatgtgtttcccagaaacgcattttacccacagttcttagggttggcctgattagtttaattgctgtctgaacctgcttcttactgtgattagttcaggaatctagatcaaactcattggcatttaacatttcaggaagtgaactgagtaacaactaactcagcaggggagtgtagtatgctattatcttttgggaaagcagcttatttgctttcaagaggcagcaggaggatggactgtctttaggtatgaaggcaagaatgattatagacaatatgcagaggaggacacagtgtgggagaatcagggaactgagccactcatggagttcagccaaccttggatccctgctgcacctttggacttccagttaagccaatttgtctgacatatttacttataccagtttgaatcttgaaatatttcaggaataataatttcctagataaaaggaaagacctttcatgaaaggtctcaagtcaaatagggtcaattaggacagagttgctccaattacatatttggaacagatgtccaaatgttaatacttgactaaggctaaagactaatattaccatcacaggaaaaatgtccagggttttttttcagatgtgaaattttatttaaaaattttaaataaactaaatcaaaaaattttagtagttgtactaatttcctggggctgtcaaagtaccacaaactgtatggcgtaaaacaacacaaagttattctttcatggttttagaggctagaagtttgaaatcaacgtgttggtagggccatgctctctccaaacccactaggggaagactcctgtctttcagtgtctggtagccccacttgttctttggtttctggcagcataactgtaatctctacctcagttttttcatgtatgtctccatgtttttttactttctttcttgagatggagtttcactcttgttgcccaggctggagtgcagtggcatgatcttggcttactgcaacctctgtgccccgggttcaagcaattttcctgcctcagcctcccgagtagctgggattacaggcatgcgtcagcacgcccggctgattttgtatttttggtagagatggagtttcatcatgttagtcaggctggcctcgaactgacctcaggtgatccacctgccttggcctcccaaagtgctgggattacagatgtgagccactgcacccggctgtctccatgtcttcttataagggtatcagtcatactggattagggcccaccctaaagacctcattttaacttgattacctctgtaaagaccctgtttccaaagaaggcaaaattctaagcaactaggggttagacttcaacatatctttcggggggacacaactcaacccataacagtagtcaatggctgtggcaggctaaatgtggctcccaaatatgtccatatcctaatccctacagcctgtgaatattaccttatatagccaagaggattttgcagatgtgattctgagattgagagattatgccagattatccaggtaggccccaaatgtaatcaccacagtccttataggagaggcaagaaagtcaagtgtagaaggaggcgatagaaggagagagggatttgaagattaataggctgcttgctttgaagacagagggaagggaccataaaccagaaataaacctctagaagctggaaaaggcatggaaatagaccctcccttaaggtctctggagggagtgcagccttgatttctaccgagtaaaattgattttgtacttcagacctccaaaactgtaagagaatgactgttgttttaaaaccattgagtttgtagtaatttgttgcagcagccacaagaaactaatacaacatctatatagaattttttcaataattggagaaatttgaatatggattgcatattaatattactgaatcagcattaaatttgttaggtgtaataatgtgattgtagctatttaggagaatatcctatttttaagagacatgccaccatatttagggagaagtgccaacatatttgcagtttattttcaaatggttcagaggctgtctgtgtacatgagaagacaaagataaggcaaatgcagcaaaattgtaataattggtgaatccaggtgaagggactatggctggtctttgtacttttttttccaacttttctgtaggtttaaaattttcaaaataaaaaaatgggaaatactttaaaaattgtaatcaaagacattagtacagaaactttcataatgtattttatttttacagtaaaattaatttatgtaaattgatagaattttactaatttcactcccaagttacattaaaaggcttacatatgtttgataatagcatatgtaaactagaactctgaatgatatccattggtcataatacgtactatgtagcggtaatggtgacttttgtgattgcacaagtctagagatgccccaaatgacattgacttagacatctggttattctaaggctgaaactgaagttgaatagaaggttttagtcaaatactgagatgaaaactgaggcagtcctggcgggggggagtgagtgtgtgtgtatatatacacacatagacatcatgcttctaaacatttacagaaagaaagggtagattatctacaaaaaaataagaatcagactgatatgagatcttacaaacctaacccccttctctttcctaaactccagattctcatatttctgacttcctatttgatatttacacttcgatatttaccaggagtcttcaacattttgttcaaaacagtactcttggttttcttcctccaagactactccttactcatatcagcaaatagcagctcttttcaagtgctcagtgtaaaaacctacaattaatccttgatttctctttcagtcagcctatactaaatcaatttcatttaaaatatctcggctactactctgcatctccactgctaccatcggcctctccagtcacattctccaagagcactctatctcatttaaaagacaaaatctctgcagtggcctgtgatgctccttaatggcctacataatccagccctcaagcacctccgtgatctctgtaaaactttcccttggtcactgtgcttcagccacattaaccagcttgcatatttctcacattcaccaagcttgttcctgccttggggcctttgtacttaccatgttctgttctgagaatactctgcctcaagatatcctacaactatcttactgtattcagctctctgctcaagtattaactgatgaaacctgtcatccctactccactccatgttctgctttacttaacagcaattgcacatatggccccctgaataatatacatttagtcacttatttttacttatctgctaattaaaatgtagactttttctattctgtttactgctgtattcccagcatgttttatccgaatgtgcagtggtttcttttcttctcccttatcgtgggaagtgatgtgcacaaatacacataatggagcctgaatgtcatattgctttcatacctgtgtgaattttggtaagaaaggaaaagtagcgattgacaggtaatataattacattaagtcactctcatagttagctgtttattgctttcctgctcttattctcagtccccaggaccaaatgttgaccactaccttcccccacatataattaggttatttaccgaacgccatgcaggtggctgttaaaaggaagatatatacttaccttataaactcaacttttccctgttgtctttctgtctcacccctacctccatgctttaaattaacttttcaggcttaggccttatctctcagtagagccatataaggtatgtgtaaaagcaggaaaatgtttcctggggatgaagctttgaaaagcttttttttttttttcttttggcaataaaataaggtagattcagcacaatacctaataactaaaaaatctgtttttaattgggtggggcagacagcaagtgtgtcatcctggaagatactatttgggattttatgtaggtacataagagaaaaaagtgaacaaaagcaaggggctaccaggacgccgcagtatgcttaacatgtattttctaagtttgtattatgcctttatcttggtacttttatcttctgttctcacttgatctttttgaaatgtattttaaatcctaataaaaatatataaagtctggaattaataaagga

SEQ ID NO: 104 - DNA, 2089 bp, Homo sapiens
taatttgttgactctgtagcatgtcaagaagagtagttttttgagatctggcaagaatattttagagatacatattcttttctaagtatgttatcaccctgtggtgttgagcatatcgtcccaaaaacctgcttcagcaagcagttcttggccaggcatggtggctcacacctgtaatcccagcactttgggaggccgaggcaggtggatcacgaggtcaggagttcaagaccagcctggccaagatggtgaaaccccatctctactaaaaatacaaaaattagccgggcgtggaggtgggcgcctgtcagctactcgtgaggctgaggcagagaattacttgaactcaggaggtggaggttttggtgagctgagatggcgccactgcactccaacccgagcgacagagcaagattccgtcccaaaaagaaaaagcagtttttgccatcagcaaggatatctcctccactttaatggacaggcctcatttttggcagctatgctgtttgagatgtagactgaatatccaaggttcctccctagctcaagtttttacttgtgattacacacaccacattgaattccgtcttcagaggcaaagatttgggcttcatatctcaacagcaaaagggcctgttcagcaattcccttcattttagactcatatgacctcagcgattgcatgatagtagtaaactagtctcctggaaataatggatgtaggtgcttctagaatatgttacagaatttcagacttaacctattaatagataaatggatcttgacttaaggtgacaaaatgaaacttttattattgcttaaaaatgctgtgccaatattgtataactagctcctctaatacttttggtattttggatttaataataagaccttaagcattttaaatgtgaacatgttcagggaagtatgctttgatgtaaatgtctcagatctaagttgtaacacaattgaatacttgtggcttattcttggtttaacttaggaaaactggttaaacaatcccccatttgggcctgtcatcattttaatagtgacgatgttctttctgaaatcttcagggtcggagtcaggctgaatttttttaaaaattaaatattatgttcaaattctttcctttttgccattgtgaaaaagcaaaattttaaatgatttctcctgttagaatttttaaaaatacccacaggttggaccatctttcttatgggttgcacaatgaatttatattttaaattagattaagtagaatgtgaagtacatttcagatttactagttttctttccattgttcattttgggttgcctcagattcagtgtatattttaaaatattggttacataataggtactcaatgaaatggtttatagtagaatatctaagctagcactttattttaaaaagtaacttattaattaatcacacattgatggtacaccttgtatttagcaaatgtttgcatgttgataaaatctcctatgtcttctttcttaaatccagttgctgattttgtaaaatacagttgtgataaagcagcattacgggggggaaaaagctatattccaactggtgttaaatgtattcaacaaaatcttacatcatacagtatttatttcttaattaatagaacttcagtgatatacttggtagatatctcaagccttttgtcttttacacaatggtgctctatcctattgttttcttttcaaagaagcatctgaacacttgcatttctattttcctatccaaaggcatccacatctaagtgtgtttttaaagttgattaaaattatttttctgttaaagcattctgaaagtgtttgtctttacctagaatgatttgtacacactcgtggtcaactgaacatgaatgtcagtagtagtctaattatgggaagggtaaacgtgttagattaaggctcttaaagctctaaaccatataaactatggacttgtatcatgatttaactgttcttagatctttcttacacagtgattcattcctctatttgtacagtggctttatgaaatgttgtgaattgatactgtaatcaataaagtgcttttaaccag

SEQ ID NO: 105 - DNA, 2256 bp, Homo sapiens
gggggtggggccttggggccgcgagtgggagcgggagcggttctgcggcctcctcgggcttcttggccctgggcggagtgggattgggtgtcccggctgttcgcagtggccgcgagtgcggccggacctggagtagtacctgagccgctctggccgagcaaggcgcggggccccggtctacaccgcgctggacccggctatgccgtgacggaattcccgaggccgtagcgccacgcgagacgcgcactggtggcctccgcggcgagtcctggggtctccgcaaggcctcagtgcccgagctggggacgtgctggggggaggcccggccccgtcgctgcccgaggccccgctgtcccggccggaccggcctggtccctggcgtcctgtcgggtccgcgctggaggagagtcccagacagcagagcccgcggtgcagctccagccccgggaagccccgcgctcaacaggttaatactacacagcggcgattctaatggtcacgcttttatttacagctcgcctcccttccgccaagattcacagaacacggcagagtggcctcgggatcacctgcccaagacacctgcacgaccggaagttgggagaagaaattaaggccatgatgatgaacgcagcctttctcgtttatttccaatcccacaacaaaccggagtccaggaactcatgggtgattatcggactattacctagtcgtaaaactgtggagcattggtgtctaaaggaatctgagacagacccgcagtgtctcccccacatgccttaagtcacttctgccaagcagaaaatcatttttaagtaaatgttagtgaaattggttttaaaaaagagaaggggccgggcgcggtggctcacgcctgtaatcctatcctttaggaggccgaggtgggcggattgcctgagttcaggagttcgagaccagcctgggcgacacggtgaaaccccgtccctactaaaatacaaaaaattagccgggcgtggcggcacgcgcctgtagtcccagctactcaggaggctgaggcaggagaatggcttgaactcgggtgggggaggttgcaatgagccgagatcgcgccgctgcactccagcctgggcgacagagcgagactctgtctctgaaaaaaaacaaaacaaaacgagaaggctttcaaaattactctgcggtacactaatttaacagattagatcactttccaggctttaagttggcctttgttctaccctttttttagtgtatgataaaagttgtgttggttcgttgatcagcatgcaatgaactctggctcttgttaatcaggtgactacagttttgtccttacatttgtatgtatgtcatgagtggttttgtatgggcaggaggtaaacaacgcacatttaaatatacttaatgatttatcattccaatgttttctggttgttttagtctttcatttgtctcttgaacaatctgaaacatccctattctaaggctaaaaaatttcctttacaaacttaggttaaacattcctaatctgaaatccaaaatgctctaaaattcgaatttttttgagtactgacgtgaccccacaaatggaaaattccacacttgccctcatgtgacactgggtgacagtcaagtcacaatcaagcctggtgtggtgggcacctgtagtgccagctactcgggaggttgagcaggaggattgcttgagcccaggagtttgagtccagcctggacgatatagccagaccctgtctgtaaaaaaacaaaaaccaaaacaaaaaaaacaatgaaaacatttttttttaaaacgccatcaaaactttgtttcatgcacaaaattatttaaaatatataatataaccttaccttcaggctatgtgggtaaggtaaggtgtatgtgaaacaaatgaatttcccatttagacttgggtcccatccccaagatatcttattatgtatatgcaaatattccaaatcaaaaatatctgaaatacttttgtcccaagcatttcagataaaggttactcaacctgtaataaaaacactcagtgcttgcctgaaggaaaaaccaagaatttgtcatccatccttaaatttttatgacaccctttgtaatcaggaaaccttttaatacctaagaatatatttgatatattctggtatatgtttatcattctgatgtttaatgttctatgttgggcatatatcagtgtaataaatacattagatccaaatacagatcatgctgccttttta

SEQ ID NO: 106 - DNA, 572 bp, Homo sapiens
gtacatgccctaacattactccaaaatctgatccccatcagccctatcagaacactatttaaaagctcagcttacttcaactgtggcaaaacagttatggcccaggtaaacagaagaaggtagactccaccgtaacaaatttagttaacaggaagcaatcccagatctataggcacagagaagaataagagagaaacttcaccctaatgaaatttagacttgagttttagaagattttcctggaaagactaagtagagtcaagagttgagataaagtgaaggcatgaaaagcagaatgatgtggaatttaaaagatgaagagctataaacgtgttaatttaattggcacgatctctcgaagacagatccactgcaaccacgaagaagaattatcctttctacacagggccatttttccacgatgctactacattggccatcacagagcacaatggcatcaccagaaaccaagaagatggtaaggcctggaggtggcagagctgaagaggtgagagaaggaagcctgatgaagaaatacaattctaatggtaaacctagggaatcaggaaatc

SEQ ID NO: 107 - DNA, 758 bp, Homo sapiens
ttcccggcggggtcctgcggagttggcggaggctcctccagggactggggcaccgatctgcgtagaaacgggtggcggggaagagaggggaggagagctctgagtgggaagcggagccgggggcctgggacccgtcgcgtcagagccaggcaagtgaaccggagcaaacgacttccgatccagtctgcgctgttgcggctcccgtttgggatttgatttgcagcatctttgagcctctacgacaaaaaaccgcgaagcacgcccagccctcccccggcaccccgaaaagcacccactccctcccggggacacagctgggcgcgtccacacccccgcagccccacaccatgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggccccagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaag

SEQ ID NO: 108 - DNA, 1525 bp, Homo sapiens
cagactcccaatgtggctggcaactgcgggggtagaagaactcaggcaaagtaggcacaggaatgggggagatgagagccaagggacaaacgccgagaaagcgttccgacaagcatgtgtgttcatacatgcatacccccaacaaagggcaatgcactgtgtaacagaactgaacacaatttaacaaagctgctcccagccttcctgtcacctctttggcagtagggcaggccatctcaacttcggacacacaaagacattctcttcaggaggaaggctgtcctgtgtggtggggacaaggcttcagttgcaagatggtcgtctctccttcttcctgaataagacaacgtaccactgttataagattccaagtgaattccttcagaggaagagaaggacaacataagaaggcgtggatgacagactttcagttaaactaacaaagaaagaacactgcagcaccatctatgcctacctttttctcagcgtttataaaaaaaaattcatattccctacaaagcaaaactatggtataacaggacaactaagactgccctggcaccagagaaactacaatctagatgtgctctgcttccagtcggccgagaagcctgcagcaaatcacctaaacacttaaggtctttgtgtgccatccacacccaactgcaactagagactttcattagcccctttctgtctcagagctttcggtggttctacaagtcaccagcctggatctctaacaatgtgtctctccaaagctgttaatacattcacatccaaaatatctccagccacgaaatcctagtttagaggttgcccgtccttgttgaagaaacatttctacacaaatacctgttgcctataccagatggccataccaatacccaaatactgacaaacgtttaaaagaatttacggtactcccttcactttagaaatgttaacagttcaagtccaacagaacttaaaggaaaaaaagagaaatgttaacagtaagtaaggcatttatttaacataatctcaactaaagtccaactaaagagcttccccaggcaaacactccttttgcacttcattttgaagacaaaagaatgcacaagttaaaatcctaatattaccattttattaaaaataacttttaagatccaatctgtggccaatattcgatctggatgcaaaaccctggcttccagacaggccagccaggggcactgctctgaaggtcattacttaagtatcccagtctcctcagtctgacagacctacccctgcccagccaatctccacataacagctagttgttcataataaatcccatcagatccccgcttaactactccccttcaaaggctccactgccctcaggaaatagttcaaccaccttctgtagaaaggccttctaaaacctctctccgagtctgtctgctaatctctcccacttgacactccccaggtctctggccagctgaacttcccgggcatttcctgaacaatgcccctcaataaaccacatgcaactctc

SEQ ID NO: 109 - DNA, 4128 bp, Homo sapiens
gcggcgaaggcggcggctgtcagagctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagagaacagagctcggagctctggaaatttggaggcaactgatatgtgctcatgtctgcatctgtgtgggttggctgtatctcagggacagagtctgcagcaaaaaaggcagtaacagagaagaattttgaaacaaaagattttcgagcctctctagaaaatggtgttctgctgtgtgatttgattaataagcttaaacctggcgtcattaagaagatcaatagactgtctacaccaatagcaggattggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacatttaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaaggtactgagatgggtgtgattattgagtttcgtatgcttttcgaatatggtaggatgttaaatgtggtaaaaagaatggctcttaaatgtgtttcatagatcatatattaagcttgactagtgagaatatttttcatccctctatttttagttatacatatcttgaagccatttcttctgttttagaatgtcagcatatgatttgctaggtctttttttagatgcatgacttcagtttattggtatttttcagcttaccagataatttgtattgttcatgatgagccatgccatgtaatgtttttccttttttgattgatcttagtggacatgaaaagaatcctttaatttctcagcaaattagcagaacagagtgtggttttgcaaatccagcttcctctcatggggaggcgtacggttttgaaagtggttcggactctgaggatgaacgaaggtttcctgacatagttttggatgacttagccaaccgtagattccaagtgaaaaagaggccccagaatttcatctcgaaaatcacctatcctaattcttgtccgcaaatattttctcctgctgatatgtttgccatggggctatatggactgacgaggtcagaaatacttgtcctggatctggctgtctattatgctgctgattttaattcagaaagtaacaccccaaattgtttgttatgtgcctcttccttttaacacagcttctaatgaagtatctttggcccgtgtgtatctagctatccttgagttaaaatgagatgctgttataataactttgtcctaggagctgtggtggtgatgagaatggaaactaatttgctttgttcacagtggtgtaaactttgtgaaccagaaagcatgccatttgtgttctgtgtcacaaatgctcatacagtgtcttaaccggttggatgttttgaacagtaatcagaggaggatttggggcaccaatgtggagaactggccaactgtacaaggaacttcaaagtcctcttgttatttggaagaggaaaaagcaaagacaagaagcatacccaacattgtaaaggatgatctttatgtgcgcaagctcagtccagtcatgccaaacccagggaatgcttttgatcagtttcttcccaaatgttggaccccagaagatgtgaactggaaaagaataaaaagggaaacttataagccatggtataaagaatttcagggattcaggtttgtcgttgtgcatgtttctgtcacaccagtgttcattcagtaccccagctggggttctatgtgcatgttttttataataataagagagacagagaaagtctaattagttctctagtatctgcggaacctatataatggaaatgaatttctgtttaaatttaaacctgaggatctagatcttaaaaagccctgttctatacatagtcatagcacggcattatttttagtagttctgtttttctccaattctttgtctcattccctcttcccttcttttcttcatgtcactcacagtagaaggaattcagactctgaggatgaggactcaggttctgacagaagcgccaccgtttttagtagagcacaaaaagcagagcataggctagacggcaactgccaaagaccttcactcttgctggaattagctaccaaacgggctgtaaaatcaccggactcccatgcagccaggagaagcagtagtgcttcggatgagcccaggtgcccctgtctgcatgagcctgcctgctgcgggtctggcctcagacaaccctctgcctgcttctgctgctccattagcctgggacctgattgcactgaatcaggaaacctgactcacttagtggacttagtacaaaagcgtaatgtataacacgctgctttctgtgcaactacatcagcttggaagtctgtaggattcaacattcttctttagcacaataatgtgtgagacaggatatatttacatgtggcagttcttttgaaaagccggttcaaaaaggcttgttagaaagtttacctaatttcacggttttgttgtgtgtggagatgtggaaaaaggaaataactttcaggtggagactgggaagggcaagtctagggaaaatgcaaagggaagattccttgagctcttttataaaacttcagagcaatttattttccctttttcctgctgattacatatacctattgcataaagtgcatgatgcacaacttgtgaaactttcaaagattattccttcttcttcaggggacacttaggccactgtggcaaatggaatgagaaagggataccaggggccaggcggggtggctcacgcctgtaatcccagcactttgggaggccagggcaggtggatcacttgaggtcaggagtttgagaccagcttggctaaaatggtgaaaccttatctctactaaatatacaaaaattagccaggcatgatagggggcccctgtaatcccagctactcggaaggctgagggagatgaattgcttgaacccaggaggcggaggttgcagtgagcagagatggcgccactgcactcagcctgggcgacagagtgagactctgtctca

SEQ ID NO: 110 - DNA, 802 bp, Homo sapiens
agggatagctggtgtgcgtgcagcggaaggcgctaactgccctggatgtggagacccgcggactggacgtgagaggcgggcaggggcagttggggcagctgcccctacaacactgaagaattggaataggaaagagtgtgggggtaggggacggggactctttgtctgcagttggaatgcgcggaggggcatggtggaatgtgtcgcgtcccgggaccggacgacaggaggcatgttctgcgctagcaccgtgactttgttcccagcgtggggactgtgggagagatggagagagactggtacagaaatggtgagacaaggagagagccataaagaggaagacagagagaaagaagacaaatgcataaagaggttcagagacgtgtgactgtggagatcgaaggcctggttttagggctagcgaacaccttctccctttggttttggtccacagaagactggtgatacagactccttatcagtgtaattgtggggactggtcaccagctcttgcttgagcttttccagaagaaacttcactactgaaatattccaagaggacttgatgctgccacaaagagaagagaatgaataaagttgtcggctttgtaagagccagacaaacagagatacccagcactaatcaactttgtggcaaatccctccacagcctaagaaggcgcagcagcagcatctggcctcgctgccactgggaggggagaagagaatggtggcactgaaggacatggcggatggggcagtaacaaccacgcttacactgctgggccgctccaacaggtag

SEQ ID NO: 111 - DNA, 3000 bp, Homo sapiens
agcctttgatggggagagtctgagatgggacccaggaacatcaccatgaagctgtccaggatggatgtgggaccctctgtcagaccaggccagttctcttaatgtaagatcagcaggccaaggtcctgggatatgggagctcccaggaagtggactgggatgcctgagggatccaagaattagcagtgtcctgtgtggtctcgctgagggaagccaggcaaaatctagcggctcagctgtaacagccggagctcttggctcccaagcaacaggaaacaattctggcttatttaagcagaaaaggactttatcaaaaggatcttggggaactcacaaaataaccaagagggctgaagaatacagttggtgagtcgaccaaggaggctgcacagcagtcaggaccacagccaaagtcaggcaatccagggatgacctcgctgccaaatccaggactccctggcatacactgccaccttgggacgtggatatggtccctgtcgccccaggaactggaatgccattgacttggcgactgccaccatccaccagaatggacttctgtgctccttgcatctctgtattattagttcccaactccaagcctttgatgggggcatctgatggattgagcctaaggattctgatggtgcctgttggctgcttccgtgatgtctggagttgcaaaatgtgccagaaagcagaaggatacaccgctattcagagaggattttcttagggacttgaagaaattgacctcaaaatttcagtagatgagaggactgtggctggcctgtgtctttggcactggttgttggagcccaatgaaaaattctacattgaagactaagggaaaaagaggtttcattatagagctgggactgattgcattttcaaaaggtggctgcaacaatatcccacacacttttctgctgtataatctgccacttctccatcaagtagaggagacaatttctcccctcctttgaatctgagtgagttctgtgactgttttgactgatagaatgatgtggaagacagactgtgtgacctgaaaggtgaggtcacagaaagccttgcaacttccacctggcctgtgaagaacacttgctcttgggatactccttcttggaacccagccaccatgctgtaagaagcccaatctacatgcagacaccacatataaggcatcgtagtcaacagccacagttaagttcccagccggcagccaacatcaactaccagtcttgtgagtgagctatcttggacatccagcttggttaaaccttcagatgactccagccccagctgacacctgactgcaaccacatgagaaaccaggaatgaaaatccaccagctgagcccagtcaactcatagaactgtgagagataataataagttgtggtactaagccactaggattggggcaccatgcaataataggtaaccaagacagtagcaactttggttagacacatgagccatgggatgacacataattaggtatatttttaaaaacttggattcagctttagggcaatgtgtccctaacatagagaggcactatttcagttcacatctgctgcctctgatcaaaacactctcttgcacttccagagagagagagagagagagcaaatgtgtgtatttactgacaggtgtccctttgtgtccccatctgtgtgactgtggagctcagtgtctctcacacattctagtatgatacttggtgccatatttgcaggtcctgaggtaagaacccatgctgttgtcttcagagagtttcatgggttggactgtgccatatatgggcaaaaatccacccacacgttttcttttaatcacctttatggatgtataatttacatatatacttttttcttattactttttatttatgtaatttattcattttttgagatagggtctcactctcttgcccaggctggagtgcagtggagtgatcatggctcactgcagccttgacctcctgggcttaagcaatcctcccacttcagccacctgagtagctgggaccacaggcacacaccaccactcctggctaatttaaaaagttgtttttttttttttttttgtagagacagggtctcactatgttgtcaaggctggtctcaaactcctgggctcaagcgatcctagtgcctcagccttccaaagttccgggattacaagcatgagccaccatgcctggcatcttttgtggatgtgtaatttacatacgtacaataatatgtacctattttaagtatacagtttgatgagctttgacgaatgtagcccacgaaaccaccaccataatcgaagtatagaactttttttttttttttttttgagacgaagtctctctcttgtcacccaggctggagtgcaatggcatgatcccggctcactgaaacttccgcctcccaggttcaagcgattctcctgcctcagcctcctgagtagctgggattacaggcacctgccaccacgcccagctaatttttgtatttttagtagagacagggtttcaccatgctggccaggctggtctcgagctcctgacctcaggtgatcccccctcctcggcctcccaaagtgctgggattacaggcatgagccactgcgcccggcctatagaacattttaatcaccccagagatgtgccccctgtgcagccagttccctcctctcaccccccagcccctggcaagcattgatttgctttgccactatcaatcaatttttgtcttttctggtatttcatatgaatggaatcatataggatagatttttatgtgactacacactattttagcataatatttttgaagttcttccatgttgttgtgtatatctatagttaatttctttttctcactgaattgtataccactgtatgatgtatcacaatttgtttattcattctcccgttgctggacatttggactgtttattgtttggggctactatgaataaaactgctatggatgtttatgta

SEQ ID NO: 112 - DNA, 2618 bp, Homo sapiens
ccctgctcaacagcgtgctcctggtgatactgccacccgtaacgggtactggctttgctaacatcctgacgagacgtcggggagagacgggaagtggcaggttgggcaagatagaggaggaaaggactctacctcatggcttgtccagaagagggcagggccacccctgcagccaggcctcccgggccctggaggtaggagggggacgatggcctctaagagcactctgagaccaggagcctgttctctcgggcctgaaggcttcgcttccactgttctacgctgccgccctggcctggccacctcccctccactgtgtggctggcttttctctgccttctgctgcctgatgggatctcccactcacctccacgaggatctgagaggaaagggtgctgaggagaggagcgtggagtgggcaggctcttgatgccaagccaagaatctgcatggctcatttgaaacttcgcagtgccctttatctcttgttctcttttatgtataagctcgtctttctcccatacagttgtaaaccccaaagggtagggactgtattcggttccttatttatatcctgtaagacagtgactctcaaactcatcagaatcacctggggagttttaaaaacttgattcctccagaaaccataaagaccaaagatttaaaaatatcaccatattaaaacagaatgaagcaaaatccttctgtaaagctaaacaaacaaacaaactcatgaatcagtcagaagaaattataaacaaggggaaaacagtatttggaatatagatggaagacacactaatttctttaatttgcaacaaatgtctataaataagaaatatacaaacaactcaataaatgctgggccaggaatctgaactggcagaacatggaaaagaaataccagtgaccaagaaacatatgaagagctgctcatccttcctcagaaataaagagacgcaaatcagaacaatgccagaccacttttcatgaatctgattagcaaaaattataaagtttcatgatgcccattgctgatgagagtatggaagcagatgccagtgaatgcaaacttggtggattttggcacctgtgtgacaaggtggggcggtggttctcacacctgcatgagcttctgaatcacatgatgaacttttaaaaacatagattctctgcgcccccatcccatactgccataaggcacccgcgtgtaactaagggcacaatttgtgaagttcgaaatggtaatagagaccagactagtaaatttcaactaaaggaattttgtcaacatacatcaacatttttaaaacatgagtaacctttgacccagcaattctactgatgggagctgattctgaaatttcccacagaagagtatcaacgtcggcaagaatggatgcccacagcagcattatttgtatagcaaacaacctcaatgtccatcaataggaacctggataaataaactgtggcacactcttagatcttttaaagagatttagtaggaactccatttgctgatatagagcagtctctgagttatgttgtgcaatgaaaaaatcaagcagcagagcagtataaatggtgtaatccattttccacataacttttaaaatgacacaccatatactttggtaaatgcacaaattctttttcaatggaaaatctacaagaagctgataacagtggcaactttgagggaaggatgagaagagaggttcttacctttcattcagtactgcttgattttcctacttcctactttgtgcattgattagttttagtggagaacttcagtaagtgtcatctgaaaggtggagttatgggacaattttggtttctcctttagagttttctgtaaaggatattcaataattgaagattctcaggccatataccagatacaccaagtttgggtggagatgctggcatgggactctagaaatcagcttgtcgtgtgattctgctcatcagtcaggtttgagactcactgcagaagattctggaagaaaaatgctctcttctctagctcaggggttatgaggatgagagggtggggtggctgcagcccttttgtttccatgaaaggagaacctgaatgaccttgtgcaacctaaggtcaaagaaatgcatggctggcaagtaaaccacagagaggaacttgtccgctggtacatcagtaggccacagaatcatgcctttcccgaagaaggacgtcctgtgtctagacttttcagttatgaagccaatacgtcctctttgttgtttaatgcagcttgagttaggtcttttgtcacatgcaatattaagaatcctaactgatagacctccactgagacaagctgagtatgtctttatctcttgcagactgaaattgcctaatttataaagtatttcatgatgtttgcaagataaacccttgtctgctgccttgggctacatctgatgattgcctgcaatatttctgcctctagaaatgaactgtcaaaccaagaagtatgtccttggaatgcatcctccactttagcaaaagaattatgtgttttgtttgctcttcatcatgtaactcttgaataaatttggatgcaacagattaagggcataaccaggaaata

SEQ ID NO: 113 - DNA, 550 bp, Homo sapiens
ggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacaaatattccctctgtatacttgcatttttttctatcaattgacgcttacaattatttttgcaagttggaaaaaaatgcagtattaatttcatttgcaacaaatttaa

SEQ ID NO: 114 - DNA, 599 bp, Homo sapiens
accccccgcgcaccgccgcccggcttgtgcccgccaggcagcagcagccgcagccctaggagagagacgcgagaggccggagccgggggaaaagtcaaaagccccttcacgcacagcctgtgttaaccatgtacctcagtcccggcgcttcccccacaaactgagagcgacagggagaatttccgcacagtttcatccttggacacttcaggactgagcggtgcagtgaaatctttctggataaaagaagtgggctaatggaaggagagacagaccaagtcccaatgacattgcctgaccattttcaccttcgccatcagcagtctccctcacagcattggtgtgggcaggtaagaagaaagcaaggccctgaaagaatatacattggaaaatgagcagtaatttgatactcttgtggaagagcatgactcttcgccccagaaaggccaatgacacctttactacagcgtaaagatcaaagccagggactgtgaaactgcctcatgatgtttctcccatgagacctgtgtctggatgtttatatggaacaaaacatggaacagaggcaatagtacttgatgtgtcttcagctggggctt

SEQ ID NO: 115 - DNA, 1751 bp, Homo sapiens
cctttcctagtgtccccatctttgctgccttctgtgagtttgatcatgtggactccatggaggttggccactgctgggcaatgcagccaaacaaagtgagcaaaagtaggctggagggctccgtgggtgactggggctaggctgcctctggtgccccaagaaccctgaagccaccttgcagctcttctgaaatgggttgggggatccagctatctgtaattgtgaagtgaagaggatgtgactgccaggtaatgctaaccccgaatccttggtgcctgtgttatgcaccatatgctgaatttcggttccagctgtgtgctaggctgggtctgatctggcaaagaggaactggctccacagctctgggcagaatccactgctgctcccacacagagaagaccaggggaaccgcagtcccactctgagtggaaacccttgacacgtgttacacacaaacaacacttggggtggaacaagaggtttacaatgatctgtctgggacccataatacaattcagcatctctttagagcttcagtctatcaaacattttcagactatttcatttaaccttaacagttattgaaatgcttgggggggaaaaaaacctccacatttgagatttccatagcagaagcatcaccagcagcctcaacagccattcaaaaagatatcgtctgcaggcttgttacctcttatcgtccctccattgtattatagaactcttattcttagagagattgcctggaaagaggtaaagtatgcatagacatggtcagccccatttgcagctgaggaaatgagactcagagtggcaaagtgactttttcagaatcatagcagtaaatggtagcattaggaagctaagcctgatcatcctgttcttgtcctgttgaggagatagtgagagcaaaggaaagtggcaacaatgaaggaataaaacccagctcgtccccctgttcctcatgcccaacccttgccaagacttcaggtaacagaaggaagagaacacatggatgggcacatgctgggcccggaagagctgtgcatgtcccacagaccacgagtgtggagcccatggccgtgtgaagggggtggggtcccagtcctagaagcaggatcatggaagtggccttggaggacctgacgaggaagcctatgatcttccaggtacttttaggtgatgtggatttagacactggatgtggctgtgaagcgggcttttgcttttttggttgtccggcatccatttaatcacgccccagcttcctgcttgggaacttccactaacgctgtcagtccatggacttctagaggagctgaatctaccgctggctcaggaacaggaacctgacctgggcctaagctaatgaatccatcaaatttaccttggcaaagtgattgcctcaggaatgggcagtgacccaactagagccaataggacttttcccaggtatcctgaaacagacagtctttttctcatggatgtggacctgagacagtatagttctgggagttgctgacaaccatcttatggtcatgagctgatttgagattggcttcaacaagcaggaagtggaacagatggagataaattggatcctgaattgtggaaagcttacaaagggcttctgcttctgactacgatggagtgactggtatcagatggccctcttgtcaggaacaaccataaaagctatacttcacccagctttttgatagcatggagaaatgtcaaggcagctgggattg

SEQ ID NO: 116 - DNA, 560 bp, Homo sapiens
cacatactaacaaaaaaaagaattcaacaaaatgaggagagaaactatcatggcaccatcctcaagcatgaacaatttctaagagtctggagaaaagcaggagggaaggcaaaccacaaagaagaaacctcaaaatagaaaatgccatgatcatatcagattccttatggatgactttcgcctttccacctggatagcccagatcagcttcaacctagaaaacattcatcagcagttttagttgctgcagcacagctctatttagagttatgcacatcccataagatttaaatgtaggataagaagaaaatgtagcagcagcagcagcagcagcagcaagaaaaaaggggactcccctatggctgctgcagctgataaagatgcatccaagaaaacttccaaggaatggtcaatgtgtggcacagctaactcagtgaaggccaaactgctgaagaatctatttgtcttaactagctgaattcaccaatctgtttcccaaaaacttgttttgtgaaatattttcctgtaatatcttcagtgaataaaagatcttattctta

SEQ ID NO: 117 - DNA, 745 bp, Homo sapiens
agactgctgtgctagcaatcagcgagactccgtgggcgtaggaccctccgagccaggtgcgggatataatctcgtggtgcgacgctttttaagcccttcagaaaagcgcagtgttcgggtgggagtgacccgattttccaggtgccgcccgtcacccctttctttgactcagaaagggaactccctgaccccttgcgcttcccaagtgaggcaatgcctcgccctgcttcggctcgcgcacggtgcgcgcacccgctgacctgcacccactgtctggcactccttagtgagatgaacccggtacctcagatggaaatgcagaaatcacccgtcttctgcgtcgctcacgctgggagctgtagaccggagctgttcctattcggccatcttggctcctcctgtaacaatttcttgagatgaagatcctgaataccaaagagggccgctgacaggtctaggagtacacttctagcacctagcagagagaggcttcactacatcatgcttcctgacatctctccctttgaagagcagtcagactcctgctttgctcttcagacttaatttgggggtttaacaggtgaggttgctgggggaactcttttacaacatctctctgaaagaatccgggctgccagtttcatttggtttgggtgtcagtagcatgatggaaagacaaaaaaacacaacttgacatctgcagaaatgggttcaaattttacctgcaactcaccaattctgtggc

SEQ ID NO: 118 - DNA, 500 bp, Homo sapiens
cattctaccttttcctacaatgaatccaccagcagaaattcctgtacacatcttatcaacaaagaatttgaacctcaaagagtggctcaaagaggtcaggaggcaccttcaacacttttattggagatctccttgtctagatcatcagattctcactgtgttacctaggctgcagtgcagtggtgcgatctcaactcactgcaacctctacctcctgggttcaagcaattctcctgcctcagcctcccaagtagctgggattacaggtgagtgccaccacgcctggctaatttttgtatttttagtagaaacaggtttctccatgttggctaggctggtctcaaactccttacctcaggtgatccaccttgcctcagcctcccaaagtgctgcagttacaggtgtaagccactgcctggcctaagatatttattttaaattgtatttatggttagaaaaaatattcatttatagtgatgtaaattatctgattgattaaa

SEQ ID NO: 119 - DNA, 562 bp, Homo sapiens
gaagattggaggggatgagtcaggggcaaggaaggattaacagattctgcctcaagtcctggtgaaccaactcctctccccaagacagacacatactagtgaaataaattggatttaaatcatcacctgaggcaatcctgaaagagaaaagcagtcctagaaaagagtggaggaaaagaggacagccccattctctttgtgaccacgaagactgccgccatgtggttgggagccacgtaacttcttttagtgccagctgagattcttctgccctggaactagttcctccgagttattgccaggcctggagattgaattcctgcagctggaaggtggggaaagcaaaatgttgtgagcacctaccatatgccaggcactgttcagtgaactggttgtacaggagtgaatgagatcatcttgattttgagaagtttataatctactcaagggaaacacgtgtaatcaactatgtttcagacataacccctcaaaaccaaagcagaacctcttcaaggagctgagagatgcaagcctggtacagggtcagcatgactcaaaaaga

SEQ ID NO: 120 - DNA, 641 bp, Homo sapiens
cactagttgtaccaataactaaccccaaggaattggactcagaagagcaatacaaattgcagccttgccacttacgagctgagagatcttagccaaaataactcaatctgtctgagttgtattttttatcagtcgactgaagatgaataatattcaggctacaagtttatcaaagagttaatagagatggagtccatgttgcctcgcctggtcttggactattggcctcaagcgatcatcctacctcagcctctcaaagtgctagcattcaaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactctagcctgggcgacagagcgagactctgtctcaaaaaaaaaaaaaaaaagttggcctaaacagggacacacagtgtggtccagagacctggtgacagtgtgtgaattgttaccagttcacagagcagtaagtattacaaaacttgggagtaggtcattagaaattttatagggatttcagcaatgt

SEQ ID NO: 121 - DNA, 644 bp, Homo sapiens
ggggattgggcagtgcaccagaagaatctaccacattcccgaggtttacttcaagatgcaattgggcctgcctgtcaagcctttgcagtaaacattccatgcatatctaatgagtgacacaaacacagcttggtcaaatccaagatgggtgttcctgatctgcctgtagctctcctccaacccagactcctttcaaactgtgcctccaccatcttcaatatggagcttccaagattgccctgctgccctgcatcaagcctgcaaaagaggatagggggtcaggccactcatatttcattggcccaaattcagtcacatggccacactcactgcaagggaagctgggaaatggagtctagctctgtgcccaagaagcaaagaaaaacagatttgatgaagacttagtcaatctctgcaacaatgaaacagataagaaggcaaaagaaaaagaattttacaacctgaggagggagagaaaattcagttaacaaaaagatagactacatgccaaggtagtctgcagaattctacctacccaaattatgtgttaaattgtgaaagaagttatgataaaaataggatgagggtgaaatttgaaaaatgctctggggacacatagcacactccttccctggtgacacagt

SEQ ID NO: 122 - DNA, 1747 bp, Homo sapiens
gtggccctgaaaatcagatattccccccttcctgagagttagttttatttttattattgaagattgtagcagtctattgctacatgtgcagtcatttccaaactatttttgcaaagactgtattccttctgtgtgtcatcactgaagtctctgttccttagtttgtgtttaatagtttgacatagatttccttgaaaggagttaaaactagcagaaaaatctctctcccagtctttccagtctttgtagattggttctgtgctgggcttttccattaatacttagccaggcttgtactgagcctaacaatcaggcccaaaagcgtagggtctttgcagatcttgtctgagcatgcttcttgctgtgtatgcacgtagttttctaaatctccctgtatgtgctgttgaatattctaatttcccaaagaaactcctttgcagctttttctcacagaacatagatggttttttggatatcttgaccatagtctttcgacccaggtgtttgcggttgttagttcaccttacacttttttcaagcattgcctactgcttacgatgagtgctctgtcaatcctttaagtagccccagacaggctaccagagacttaaacaagaatttgtaagttctgctcagcttcctctagaaatggggatcagggtccaagacagaatgcagttgctgatttcaagactgctgcaacaccagggagcttgtgggggaagggcaagcagaaatgtcacaaagctttcttgccattttaaagttgcctgttcttgactcagcatttgcttcattgctataaactttttactgtttttcagagttctgataaaattggctatgcctgttcctgctttaaaaaatatatatatattttttagggattggggtctcactatactgaccaggctggtcttgaacttctggcctcaagccatcctctcatttcagcttcccaaagtgctgcaattacacgcgtgaaccaccacacccagcccctgcttgtttttcaatgtgcctactccaccatgttgctcaagtatgtatattttctaaactaccttgtagtgttgtgatgggaaataaatccctgagccttttgaataactcagagagatcaaaaacttagtttatcctattcgaaggattagaaaaatgatatatctttcactttttcagggataggctcctcattagaaggctcctatgtgccgatgctgtacaagacatttcatttctcttaatgtttacaacaagcttgttgccaaggctgatcttgaactcctggcctcaaacgatcctcccagctcagtctcacaaagtgttgggatgtctggccaactaatgactatcttaactcttgtgtttcaatgtttatgccttcttttatcttgactgattgtatgactatgtcttctagaacaatgttgaacagaaatggtgagagcagacatccttgctttaatatttcaccattatatatgatgttaggtatagatttttctcacagatgccttttatcagattgaggaatttatattcctactttgccgaaaggtttttgtagtatgagggggtgctgaattttgtcaaacactttttcggtaataattgagatgattggttctgcagtcatcgagatgtggattttctcctttattctgttcgtgagtgattacactggttgactaatgttaaaacaaccttactttccaggaataaaccctattatcttttttataca

SEQ ID NO: 123 - DNA, 704 bp, Homo sapiens
tctgcaagagtcctgctcgttcaaggcctgcatacaggaaagaagcaggggaaaagcgttagaaacagcttttgttctacagcattttaaaatataataggtatattgaaaagtctgattcagttacaatcagtgtatggaatcacaagaagatccataagaaacaaggtgctggatttctccgttgtgttcgtctttttccagtgccatcaaccacctcaaagacactggttatcagaggttggatttatgcaaacttgggccaaaggacagttagaagacagtaggtgccgtgctgggcagtgaatgaatgaaccttgccctggggttaacactccagtgggatgaacagacaaaccccacaagcactgcatacggatgtttagcagcatctctggcctctgcccaccagatgccaggagcacaaccacagttttgtcaagcaaaagtgtctctggacattaccaaatgtcacctgagtacaaaaatcacaccagttgagaaccactgctctctgatgattcactatgatctgtgtaataattctcacactaatctttgctagagacaaaaaggacttgctatataattttagtacctttctactggtcaaattttaatcatatttcaaaatgaatagcaaagaggtttataatcaagttttataaaaattccaaatgtaataaagttatatttgtaactta

SEQ ID NO: 124 - DNA, 444 bp, Homo sapiens
aactcccagatgccataaggttgatttttcagtgacccttcagaaggccagtccctttggctcctacgtggcactacaggttccatacacctgggatgctgaggccaagccagagcttctcggagtctcgggctacggcttttccctagtgcaatggagacagcaggagacaggtccctaagcaagatgcctggatggtttttggagctgtccatcctacccaggtggggctcattaaccataccaccttggtgagcagctatggagcacatcctaaccctcacgggctaactacctgagatagcctctcaagcttttggagagcctcatacttgtcttgggacctaaacaatgaatgacaggccagcaagcgctgatttcatgctttgtgtggtcaggatgatgtgctcaaggggctggtggaaagatccgatttctctggtg

SEQ ID NO: 125 - DNA, 554 bp, Homo sapiens
aacttaaagaagttagatagatctgtagtcccaaagtacttacagagcaatttattaagacttgggttcctgagaaagttttattctattactcagttattgtcttcaatctgccattcactgaaaggtttctttggccttaattcaattctctatctcctacgctatcagtgtttttgttgagcacttttctatccagacagataacaggatttggtgacagctttcaatttcattactgctaaaacttttgtaggtatacaatttctctgtgtaggctggtccctgactgtgatttatttagctcattatttattggcctgtaaaactggcccaactctgcaaaataactcactaattcttcccatgtgaaaacctctgaagatatttatcaacacacattgataaaagaagttgtgtttttccttacttctttatcagcatcattgctttgcccatctttgatgatggtattatgaagaaggatttgcttctgaagtataggtatgattgctacaaataaaatatgcctcctacaaataaacaaaaacctt

SEQ ID NO: 126 - DNA, 428 bp, Homo sapiens
caccgctttgctcccccaggaacaccagcttgaatttcctcagcggattcccgaagtctccgcccgtggacattgtggaactagaggagcggccgccgcctcagcctagagacctcccggaccgatgctgctccagccagctgacgaaaaaggcgagcggaagggcggccgccgccgcctcccggcagagtagcctagcaccgagcgaggcccgcggctgggaagggaaggagggcggtgtcggcaggagccaggggtgtcctctggcttcccaaagctagggccgttccctccttccgcactcggctcccagacctggggaagagaagctgagggtggcggagccggaaccgcagacgtatctgggacctctcacgcgcagcgcctgagcttccacagctgccgccgccgccgcagcccaacctgct

SEQ ID NO: 127 - DNA, 589 bp, Homo sapiens
agaaagtgctaggcacgtaggcgttcaggagacagtcacggtactcgtttccagacagaagtcatgaggaacaagagggaaggtgctttcccgtgtgcagcgcttggggagactcacacagacagaggatctggcatgacagggaaaggaggaaatggcttctgttaatctctccttcagcttctcccgcccttcccatgcactcttcctgtttccctttccagttctcacggtgactcaaggaacaacgtgtgaaatgaaagacctcaggtgctgtattggctcttgacagctcttcagaagaaaatacctcctgcctgttctgttcagtcctggtgcaggtgagtcactgccttgccagccaggcaagtattttaagaaacaaaatctaagccagaaccagcagagaaatacgagggatggattagcgccattagctttgatggtgtcttgttgtcatggtgctaggaaaatcactatcatttacagtcccactcaccagctgttttgctagaatttttgacatgagaggctggtggccaccctaacacaggcgtgggacatgggtgtgcacacacacgtacacctg

SEQ ID NO: 128 - DNA, 790 bp, Homo sapiens
tgcaagcggggaaccttgagctacctacgccagcgttctggattattttccaaatttggttcctgataatctgagaaagctatgcgctcagtaagagcagggaccttgttttatcaaactttgatctttcattaagcacacagtgggcattcaacaaacttgtgtaaacttggaatcagatttagcccaggccggtgcggtggctccttcctgtaatcccagcactttgggaagcctaggagggcggatcgcttgaactcaggtgttcgagaccagcctgagcaacatagcgaggctccgtctctacaaaaaatacaaacactagccggccctgtggtgcagacctgtagtcccagctactgaagaggctgaggtgggaggatcccctgagcccaggcggtcgaggctgcagtgagctgagatcgggcctctccattccagcccgggcgacaaaaaatccagctaagtaaaaattggcaagatcctgtgacaagatcctgtgacaagatcctgtgatcaagacaaagttttgcccccaaaggacttgaggctatctgggaattccatgtttgacagaagcgctgacagcataaccaagcaaacaagaaggtattcagggacgctgaaacggatcttcaaagaagactcagtgggtgatttttaatttctgtgtagtattatagagcttaatgcagaacataccaaaaccttggagaggtaatgatagggtcatgcatttcataaggcagagtaatgccctgcaacaacaaaataaagtcaaagagttcta

SEQ ID NO: 129 - DNA, 576 bp, Homo sapiens
ggtcactgaggaagaatataagttagcctcgtagtgaccatgtggaagtcctgacctcgcttgcagacttgacctctggatgtgacaagaaatgctgaatcagcaaatagagtgaacgaacaatcaagatgagatggctgctgttgatgtgattctctaggttactacctttcttcctgctgcaaatgctgcatgacactaagcttacaggatctagaagcagactacaaaaaaagaagaaattcactctgaagactgaagaaacactaggctgatcttaagtttccgaaatacactctgtaacactacactgattctttgaatctcttgcaaaaagaatcaaaccaggacaaagttcaacagataactggtcaaatgcttaggaatgtctatgtccaccaagaatatggaaccattaatgccatgcttcaggtaaacttgttacaaaatttagtcttcgataaattagtctctgcaaatgatttaccattgctctacattagtaagctgaatgtttcactaacaaataagaaaataaaatatttcatgtttttacagctaacaacttagtaatac

SEQ ID NO: 130 - DNA, 964 bp, Homo sapiens
aaatgggccaagggccccgggcttggaagggcaggtggcgcctagacccagcgttcccgctccacaggtctccaggagttcgcccggcgtttcctctgcagcgggtgctactctagggtctgcgacctcccgctggactgcccagttcaggatgtgacagtgactcggggcgaccaggctatgttttcttgcatcgtaaacttccagctgccaaaggaggagatcacctattcctggaagttcgcaggaggagctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacggtggggcggggcgcggccgcgtgagtgagcggggtcgggagaggggtggggctcgtgcctggctgacgtgcgcgcccccgcagtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggatgttctttcgatggtactgcagtggcaactaacaaaggtatctttcctccttccctatcctatttccatcctgaaaataaagaatatatttcaactctagattgtttcatctccgaaggtggtcactactaactcaggtaggaggaggtgcagcaagcccacacatgcccagatgaatatggcccgcataatgacagtgataggcatagctatcccagtgcaagttaggtgggaacccagataccccctcaggttact

SEQ ID NO: 131 - DNA, 394 bp, Homo sapiens
ctctgttcacggaaagggcctgggagctgcaacacctcaacagcaacaagcacacctgctacctagaacttggtttctaaaaaccatcctcctctaaaaggaaacagagctctttgaagaaacgggtctccctatgttgcccaggctggcctcaaactcctgggctcaagttatcctcctgcctcggcctcccaaaatgctgggattgcaggcatgagtgaccgcacctggccacctttccacatttaagagatccctgggatactgcgaagcaggagtccatctccagacatgaggagcaggtgggctaaaggaaacaggactggggagtcttggaggggcagagcaatgcccagggacacagaaacttttgaataaagacaagagagaccga

SEQ ID NO: 132 - DNA, 1191 bp, Homo sapiens
cttttccgtctctttctttttatgtcaccaggggaggactgggtggccaacccagagccccgagagatgctaggctctttctgtcccgcccttcctctgactgtgtcttgatttcctattctgagaggctattgctcagcggtttccgtggcaacagtaaagcgtgggaattacagataaattaaaactgtggaacccctttcctcggctgccgccaaggtgttcggtccttccgaggaagctaaggccgcgttggggtgagaccctcacttcatccgttttgtctgcagctcgatttcttggttccctgactgggaagcgaggtgaatggcggatggtcaaggcagctccttaggcggcttaaacctgccctgtggaacatccctgcaggggactccaaccagcccgagcaacacggatcctgagggcgctcctggttaggcatttgccccactgggacgcctcgccagagcactgtatggcaggcccccatggaggatcaacgcagtggctgaacaccgggaaggaacgggcacttggagtctggacatctaaaacttgaatttctagtaaaccagcaccagcctgaagatcacattctcatcgaaaggtggaaagaagaaaaactcgagccagcctggaaggaccctaccttgtgttgctaaccaccaagactgctgttcgtacagcaaaaaaggatggactcgtcacaccagaatcaagaaagtgccaccccctccagagtcatgggccacagtcccagaggaaaaccctgccaaactaaagctacgaaaaatctcttttcatctattctattactcttctttctttcctcgtgctattgctgaccatctagttattaacataaccaagtcaatttcacctcaaactattgcatttaatgcttgccttgttataccctgtggggacttgccaagtcaaagacagctctctacttcagaaaagtacttctgtccctcctgactctcctcagactggacattagtaaactaggaccatttaatccagggagatttcgataaagaccccagtgccaaccaggagtcttgtcccctgatgtagagtttttatgccgtagttggtccaacgttctgtggaccactaaagagcaagaatggactgccccaaccagtttttgtaatttcctaaaaccatacattcgttttacta

SEQ ID NO: 133 - DNA, 3325 bp, Homo sapiens
aatttgggaacgagatgcccggggatgcaaccagccccgcgctcggaggcggcggtcggagttccgtgcgcagagggcacacaaaagcctcgaggatcattgcctcgaccccatcccccaccgcgcggcgacgccccctacgggctgggacacctccactctcggactgctgccgggtttccctccggctgcgaccctggaggatttgatggaaatgctacaagagaagcaggctctccccttctgaaatgatgagtgataatgaccatacaggtcaacttttccaccacttggagggagcctgtcaaagaacaaaggcaacagagaagagagcagagctgaggttgggtgagagggagaaattcctgagtgcttgaatcccacatgccggaagccgcaccacacttggacttctcaatacaggagccactgagaaaccaagtcatgctgaagacctggaaatcccagcaggctgcaaaccagctgcaactacaatgggtcagcccttttgagatgctgctgactacccacttatctgccaagttagccagtgttaagccatggattcaccacgctcagataaaacctgcccctctgggatccctccagaaaaaaacaggcatgctgttgtgaaccctaagatggccttaagttaatattcaatgcccagccaaagaccctaaataagaagtcataaaggaaacatgtgcttttcaggttggtattattctccccaaaacccttcttgcatgcaggatgtaatgaatcagaaatagttgttagtaatttttttttttttgagacagagtctcactctgtcactcaggctggagtgcagtggtataatctcagctcactgcaacctccacctctcaggttcaagcaattctcatgcttcagcctcccaagtagctaggactacaggtgtgcaccaccatgcccaggtaatttttgtatttttaatagatacagggtttcaccacgttgctcaggctggtcttgaactcctgacctcaagtgagccacatctgcctcagcctcccggagtgctaggattgcaggtgtgagccaccacacccagccatgaatcagaaatactttttaataggcttaggattgttctcttggattccttaagggatccactttaattcttgggtgttttttttttttttaatcatggtgctccaacaagcgggatgccagtcaggtaatcctgagcacttcagattcaggggtgatgtttgcatttcccatcattatcccacaatgcaccccttagcattaagtagccaaaaaggcagacaaccatattccccatgatcgaaaaattgatgaatagaaaaaaggggattaaaaccagcccaattgtcccatagaaatgatattacggtttttaaaagaaacataaaaattaaccttcctgtttttaaaatttaaaacttacatttatctcatctgaattccttcctcaaaaaacagacactcaggcaaaaacaaaaacctaaaactcatcagatcactgtatccagacagagacgccagacccctcatccatcatgattgcttctatactcctccttaattcctattttcccacctttcctgctatacaaaacccccaattttagtcggtcagacaaacacatttgagactttatctcctgttctccttggctgcaacaccccgttaaagttttcttccctggcaatagttactgtctcagtgattggcattctgtgtaacaagcagcagaacctagactggaaccctggtgtttcagtaacattaccttgtagtaaatgctgttgtgtcatgcccagattcactttaccaagcccagatcccacagattaaagggctcagctccacaagacttcagacaccagccacaaatggggtccccaggtgacccacacttctgcccagtggactataaattcaagggttctgtgactttccctacccagctttgataattcactagaatcctcacagaactcaggaaaatgccatacctactattacactttattatgatggacacacacgagcagccagatggaggggtactgaggaagcatctgaatgcaggaggctctgtccctggagagttgggatgagccactctcctggatgtgttcaccaactcagaagctctccaagccccattgtgtagggattttttatggcagtttcagtaagtacacatgattgattaaatcattggccattggtgattgaactcaatctctagcccctctcctgctctcagaggtggaagagcaaggctggaagttctaaccttctcagtacatggttggtttttcctgtgtccaggtcccatcctaaagctacctaggccccctctgcccaacaagagtcttctcattagcaaaagagtaatttccaagggtgttaggagctctatgctgggaaccagggaccaagagtaaatatatattttgtattttaccacaggtaccaatcaccctccagatctaagaatggcttcaggctggggctgcagtcacctctttgcccagcttctcccctgccctattctgcttcacttgcatccttaaaggttccacccaagagctcttctacaagaaagcacctataaagccagacacattggcttatgcctataatcctagcactttgggaggccaaggtaggaggatggcttgaggccaggagttcaagaccagcctgggcaacttagtgaggccccgtctctataaaaaataaaaaaattaaccaggtgtggtggtgcacgtctctagtctcagctactcaggaggctgtggcaggaagatggcttgagcccaggaggttgaggctgcagtgaactaagatcatgccactgcacccatcttgggcaacagaatgagatcctgtctctaaaaaaataaaaacaatttacaacagtaagcacctgtacacaagccccatctccagtcctgtttctagggcttccaatttaacacacctagaggctgggcatagtagctcatgcctgtaatcccaatactttgggaggctgaggcaagtgaagcacttgaggtcaggagttcgagaccagcctggccaacatggcaaaaccccatctctactaaaaatgcaaacattagctgggcatggtggcacatgcctgtaatcccagctactcgggaggctgagacaggagaatcacttgaacccaggaggtggaggttacagtgagccaagatcacaccactgtaccacagcctgagcaacgaaagaagactctgtctaaaaaaagtaaaaaataaaataaaacacacctggagctttcta

SEQ ID NO: 134 - DNA, 392 bp, Homo sapiens
tccttggaggggcttctgggtggccagccgtgtattgttgcttggttgtgcttttagggttgtctggcttgtgtgggtgctgggtttgtcggtgcagagagcacagctggttccaggctggcttcagaaggctgcaggcagattcctggggagagggtgacactatagcgccagttcttcttacagccttgttctgcactttctaaaaatattcctgacaaacagctaatgggcattttggccattctattgccaaactattgctgccatttcaaatggaatgcttctccttcaagcctgttcatcttgacttatatgatggggatagattcatccgtttcatgggacttcacaacagcccactcaccagaggctctttgaaaacaatcaag

SEQ ID NO: 135 - DNA, 781 bp, Homo sapiens
gaaacagactgcaggacatccttggctgagggagccctgcccaactcagatcactgtggtcaccggcatggcagagaggctctgggtgtcgggatgttcacaggaggcccaaggactgtttgagattccattgatcctgaaggcagtggacagctgcttttcaacaggagagtgaagtgctcagactgggggacggttcaaggaattttaaaaatgtgaacgctgagacactttgaagacagtcatgactatggcctttgtgaggggtgacctcttgtgctatccctgttggaagtttgcttcctagaacatctgggaataggattattgctgacgcaagacgataaagaatgaaggagaggtcaggagttcaagacaagcctggccaacatggcgaaaccctatctccactaaaaatacaaacattagccgggcgtggtggtgcatgcctttagtcccagctacttgggaagctgaggcaggagaatcgcttgaacctgggaggtggaggttgcacagccttggtgacagaaggagactcagtctcaaaacaaaaggaatgaagcttaaagtattttcagaaatctgaggggaacatcacctgtgctttattggttattttgacaagtgaaatagaggacaaactgctttgatttgagttgatgtctacacatgtgaactcatgagaaacagcaaagcccacaatccacatggacatcatcatcgttcgggaacaggcatggtctccattctttccatgcacacgccccggcttcaaaaa

SEQ ID NO: 136 - DNA, 1646 bp, Homo sapiens
cagtggcttaaggggtgcaggggtctggagaaatgagactgggctgtgggtgagggtgtaggtctgtaccccttaccccgtctttcttcaggaggcccacagcccctaaagaccatctgagactctggcttgccatttgtcacatctcccttgccgcacccacagccttcagggacaagtctgtgagactcctctttcatctctacccacgggttttggccatcagaagcaggtccacatatgcggccactgtttctgccgttctgctagaggagtgggatcagctgcagcctgcgtccctggggaaagcaagagttcctgacggagactctgcagtttgtatgcccgaacccatattcactttgaccctgacccatcctcagcttggccttggggctctccctcatctctgacccttccaactacaccccagttgggcctcctctgctggggttcctctgggacttttgacctggttgcggggggcgggtggagaacctccctttcccctagatgaagcccagaaacagcctgagctggttttggttcctcttcttcacacctacatgatgaaatgagatggtccacgtggacgggctgtgtcgcctgtgatgctctggtcacactgaagtcatgatgtgtggtaattgtctatggagaggggtcatagaaagccaggctctggggcttggaccagcttcaccgtgcgctatagcagcttcccctcccggctggtgtgcagggtggggctggaggtatagtttatgaccagcctctgtggatgccccagcccaggccctggttctgttggaaggaggctctcagatcgagggtcgcatagacagggtctgctctaggtctgccaggatcggcctttccagcaggatgggtccctggcatacccaccccaggacctggaatcttcttgttcctggttcttagccatctaatttttgttctatttggacctttcattgatgagaattagcagcccgtccccaccccccagcccctgccttaaagaagtggacattttaagcggctcgagttggtcttcgagttcaagaggacaaatggaatacagaatgacgaacctggcttatggccaggagcccccagttccttttttttttttttttctggcaagtttgtgtaaccaaaaggccccagttcttagctcaacatgagagtgtaaaacccagcgttcaaggaatgtgaaccaatacctggtatgggcaaggacaaggaggagaataggaagcagaaggaatagaaggacccagactaactccagaggaaaatggtgagctaagacctttactgcatcacaaatcaataaatacttattgagaagctgctacatgcaagattctcctgcctgtaccactacgcccgaggtttttgtactgtgacactgagggacagtctgccaagctgctcacggcccttcagtgagtgggtgggggcggaggagagggtctgtgttctgaggggacattggccctggagacagggtgtgtaggagattcgtgaagggggaacgaggcactggtggctggctgaagagctccagagcccagatggtcctaggactcctgggctcctggctagaccctgagtgagggatccagatattggaatgcctg

SEQ ID NO: 137 - DNA, 3059 bp, Homo sapiens
acactggagcaggaagtcggcctgtggccggccatgttcatgagggcgcgtcccttggcacccctgtagccgctatgtttcccacgcccgtggcaggcctgagagattatgtttgcggggggtgctttttttgtagcttctgtgttcgccatatttgaaaggggcagacggccatgttcgtgaacggcgcttcccttggtgcacctgtggccgccatgtttgagcgaggaaagccaggggtctgtgcggggatgctgcaggacacgagaaccagccaagacctatggcccctgcagccaccgagggctcgagagcgcccctgtggacttggctgggcccttcatggtgacatccaggaatgcggctgagcgcgggtgttgacctcgctgtttgctggaatgtttgggttcttggaccatgtcagtgacggctgtgtcaccatggccttgctatccccaggaaaacctaacatgcaccccgcgcctgtcctctgggactcccatcctcctcctttgtctgacccctgagaggcttaccgtttccccagggcagccccggctgtggccctcggccctgctccaggcggccatgtcagtgtcctccctcggcgctcccaacaccctacctggctctgcgatggccaccctggactcctaaacaccccagaaagggaagagatttaagaggaaccttgattcctgccattctgcgcagtcgtgggtccctcctccacctggggccctcaaggggatttctgtccgcactcccagccagcgacccctcccagttcctgcagctggagcggccctctctcctgaacattcgggcacctgcgtctgtcactgcagccagagggctggagtgtcttcggtcaactcgccatccctgccacggctggaggccacatgtcccagaacctaccttgctgggatgggggttggggtggcagaggctgaacgcgtgtgaggtttgggggaggacaagcggagcggggatgtgtgggaggtcctggtgtccaccgtgaggatggtcacaccccatagctttgttgatgctgtggctgtagcaggcccagtggctccgctgagcctccctagcaccagtgcccagtgaagtgtggggggctggacataggtggcctcagttcctgggactcccccaaagctctggtttcccccctgctcccaggcttcaggtggacgagttagtgaccacccccactccagacctccctcccctagccacccccacagttataaaaaccttcattctcatatggaaccccctttcctgaaatccgtagagtgactgactgctttcttgagtgaatctggactgggccacatgatgatcgctgtacagagcagctgagctcctctgtctcagcctccctgagttcacagcaggctctgggcatcatctccgtgtcatcctaaggccacgggcggggttcccaccaaacaggagagcagctctcccgagatgaagccttctgatagccctagaaccaagaggaaccgtgtggggttgggtggggtgtttactgtgcactcctgatgttccctcccagtgaaggacacccacctgggacactgtggcccctggccctccctccctcccctcggtggcagagagaacttcctggtgggtgacagcccatggtccacccttgccaggtggattcaggcaaaatacgccaggctgtgtgctgaaggcatcccatctcttcctcgtcccctctcggctggatcggggtggggcagcgggtggtgagtgtgtctgtcctgccagttcagcctccaactggtctgctgtggggcaggagcccacctggctctcctgcagagctgcatggcctgccttgcctcacccgtgacaacagagactttggttctccatctgcagacgcatttgtcttgtttcttattcggtccagaactcgggtgggaagaagggtgatgttatttgggtcccctcaagaccttgacaacagatagtttttaatatcacattttaaagccgccaactttctctcctccactttggtatttccctgatttttaaacagaatgtcggctctggaggcagaaagcttgggcttggatctgggccctgccacgcagtagctatgtggccagggaatacatagcttccggatctccgatccctacagtaaagtacagataaaaatacttttcattgatgtgtttgaaatcgaatgagatagttaatgaatgagtaagtgctctgcaaactccagagcggggtgcgcgttctgatctgtttcatagaatctgacacgtaccctttcccaccccagcgtctctgaattgggatgcatctgacagcaagtgtggcatccgggctgcagttgccgttgtctgctcacatgtgaattaaaaaaacaatctcagcatatgaaatctctaatcgcgtatgaacttggtggttattcctggtgccgtgtggataactgcagcctcaacaccccagtccacaaaccacgtacggaccaactgaggaaggagtaggggttcttgttgttgcagaaaaccctccctcaacttgctctagaagataccagcattcatacttggagtgggcatcagcagcttggaagacacagcagtgggcccctcttagcaggagtgccccatctcatggctcccgacgacgacccagagggtgatgctgcgtaggggctcacggacattggcactctaagtcagagatgctcaggtgaagggggctctgatggtgaggacattcagaaataacagagattggctgggtacggtggctcacacctgtaatcccagcactttgggagggaagccgaggcaggtggatcactggaggtcagcctggccaacatggtgaaaccccgtctctactaaaaatacaaaaattagctgggcgtggcggcatgtgtctgtaatcccagttactcgggaggctgaggcaggagaattgcttgaacctgggaggcagaggttgcagtgagccaagagtgcgccactgcactccagcctgggcaacagagcgagactctttgtctc

SEQ ID NO: 138 - DNA, 918 bp, Homo sapiens
gtcatcaagctgcgcgggggcatagacgtccgggtcgggcgccgcggggcggaagacgagggcggcgaggtcgggttccgggcgcttggagaagatggtgctgcggcggctgctggccgccctgctgcacagcccgcagctggtggaacgtctgtcagagtcgcggcctatccgacgtgcggcgcagctcacggccttcgcactgctgcaggcccagctgcggggccaggacgcggcccgccgcctgcaggacctcgcggctgggcccgtgggctccctgtgccgccgcgctgagcgatttagagacgccttcacccaggagctacgccgcggcctccgaggccgctcggggccaccaccaggtagccagaggggccctggcgcaaacatttaatcctgggctgtgcggggccgaggccgcttgcttttccttccgggctctacagtggcatcaatgtggaggggtcattccgggcactgcgcgcggcttcgaatcccgactgggattgttggcctgcagacatcccacgcataagagcctaggccagaccgcccgctccgttgaagtcttgtgattggacaagacacagtgtggagacagccctaagcctaacagagatgaaggtaggctgggtccagacacggcacctacggagagccacggaccgaagccagagagcctttcctctgcaagtgggactgaaactcttgacagatgctgctcaatctgactggtatagcaggacagttaattccagggacgatatggatgaaaagacaaccctacagctgccaaattcctttgattaaatgtgtgagctggttgataggcatgagtgtgatacttctcaggcaagatgtgttaagaataccggggactgtaggcctatggtaataataaacacgtattttatgaaa

SEQ ID NO: 139 - DNA, 1424 bp, Homo sapiens
agatgcaaaccaaggaggctggaagataagagcagagccatcaggacacgagcccctcgcgggtatgaaacaggagtcgtgggagcaaattagtaggtgcactgcatggagggacggaaggggcagggaggagcatctgaatgtaagatttcagagaagctcattttgtcagcatttcagagcttcctgtgtgcagcatggatctaaagctggtggatgcaggggggtgaacaagacaacatcttcacttcctgcatgctgatggcagaagtgagacatcagcgaagaaacatcacgatcaccaaattacgatgaacaccatggaggaaacaaaggacactgtgacaccaaggaaggaagggaggttacttttcatagtggctgtaaatagaactgaaggctgaaaaacagctgttaaaatggcttgtttgtttgaagatgaatgagagtacacaataaaaggaaaaaaatttggacacagacacacacagagggatgaccacgtggagatgcagggagaggatagcagctacaggccagggcgagaggcctcagaggaaaccagtcctgctgactctttgaactcggacttccagcctccagaactgaaccactgtcttcctttatcccaggatgtctgcaaggaagaaaatgtcctttttctagcatttagaggccaccaacattgaataaccacactggggtagacacagcggcgaagagattcctgctgttcccatcacagcagccttggagatgagaagacagatggatctgaccagaagtctggagaacttcgagaaaaaaggaggaggacacaaaaggaaataacaaaaaagatgcatccggagcaactatgaggatggtaaattggtgtctaattctgaaaatcataattggtataaatgctatgtactgtggaaggagggatgaagggtagagggaataaaaaagaacatgaagttagaatccttggcatgaaagcctgccatttatacaagcaaacaaacaagatcagggactatcaactggctggctgaattggaccaataggcaggtttattcagccccacacttcaaaaattaggagatctccaaattaaaatctgggaatctgaccttttgtaacaaatcagaggatttgcaacaccaagagcatcatcacaggcaacgaccagcttggatgggcagcggctgcccctgcaggtgggtcaggtgctcttccgttggacacagtctccaccactccctgtcgcttgctccttgctccccatcagcataactgtttgggccttatagcatatgcatttatcactccctactaggacgtccacaacatgaaatgagagaacgatttggtaagttcaacaaaaggcatattatgcagccaccatacattctttgtggaaagagaagtggcataa

SEQ ID NO: 140 - DNA, 278 bp, Homo sapiens
gtacaacaagctctgtggttttatttctcctaaatgggaggaaacatagagaggaagaaaagtatgcaatctcagttgcaaatggaggcaggggctcaccatgttctctgatacgattgtaccgcccattggtaagaatcagaggctgaaaagattctgttactgaaactcaacacttagttgatacctgctacaactttaactactcgttgactgtttacggcttttgctgtaagttggagtatggtgacaaacacacaagtaagtttgcaaaggca

SEQ ID NO: 141 - DNA, 1756 bp, Homo sapiens
ggagaatgcgcgggtcgagtgctgtagttcgatttttgcgtgtgtgcgttgcttgcggcctttgtgcctttttattctttgcttacctttatgatataaagaccttatttcttacaaggaggaaaagaccgctgacttcagaaacagcgggaaccccagctcgtccccggtaattcaagaggaaacgcttgagcaattactgatgttgtaaactgggatcagaagacatacatggtatcgtatcccaggcaaggcacagtggctcacacctgtaatcccagcactttgggaggctgaagaaggcagatcacttgaggtcaggagttcgagaccagcctggcttacatggtgaaacccatctctactgaacatacaaaaattagctggacatgatggttagctgcacctctactccacgtgttcctcccttcaggtcccaggctgatggagtagcctctgtgtgtttgggatgttgtcagtcataatggtggacacaaaagagattatgacaaaccgtgtattgtctcctacaatttctgctcacagaagtggacaacatcacttctttccacatttcattgaccagagcaagtcatgtgaccaagcctgattcaaaataggctggagcaaggaggagcagcaaacataacattcccagtttacagctgaggaaattaagcttcaagttgcccaagtttatagaatgagtcaatggcagaggttgaactcagatgacaaaattggggtctggacgtgtgcaaggacttttccaaagtcagctggaaaggagctgcttagctgagaggttctggctccagagtctcctgtgaagttgcagtcaagatgtctgctgggaccccagtcatttgaagccctgtctggggcaggagaatctaggtccaaaatggccgttgcaggagtccttatccacaccatgtgggacctcttcatagatgttcgagtgtcctcatggcatggccactggctttccccaaagtaagcagtccaaaagagggtaagacagagcccacactgtcttttatgaattagccttagaagtctaacacggttacttccaccacattcattagtcgttaggtacagctcacattcatggggaggaaaatcagggcctgtctttagataggagatgtatcaaagaatttgtggacatattttaaaatcacagcactactcttgatgtactaagtcagtgactcccccaggagtctcacagagaattgactccttgcccacctatactacctttgtgggtagagactccagtagtgtgctggttaatgttcaaccagtggctttctagaaaacaaaatgtatggatacatatatatgttctaagttttactgatatgaagaatgtgtagcacagaatttataaataataaaatatacagtattatttattgtaaattccataaaacctgttgtttttcacaaaaggttttagtttatttttcccaaatgcttgtattggtaacattttctgtattacctttttatgtccagacaatcaacaaaactgaaaaagcccagccttgtagcatttgccagttattgtgtaaatgtccccactatggtggatttcaggttaccactatgatatcacagaatgcagaattggaaggagattcacagcagcaccccattatactatattttcaccatacagatgcagtcgatgtaaattacctgaggagcataaataataataaaatgaagttaaataattcggaaa

SEQ ID NO: 142 - DNA, 709 bp, Homo sapiens
tcctcgttagattgtttctgtataaaacaggtttatatatgaatacatacattaaagtaatatatacaagatatattctaaagttgtttaaaaatgattgtctttgggggttagatttagagatcattttcatttgttggctttgaagggcaactgaccaacttttttatacataaaggatataaactacaactattttcccactctgtgtagaatgtggaacggaaacagtgtgtggcacactttaaatgatgctaaacttctacagtgtgtaaactggcttgttcaagaggccaaagtgcttctgttgagaaacactgatgaccaatctcctctttgtggtcctgtgatactgtgaaatatatatttgatcttcctccctgtttcccagcatacaattcctaaaaccctcagaatctgcaaaataagatttttttttaatgctaatgattgactgatggctggaggctcctagagagcctcaggattggggctgattctcagggctttcagtgccacctcccaacctctgagaaaaagagagagagagagaggccaggagttcgagaccagcctgacaaaaaatggtgaaacaccctctctactaaaatacaaaaaattagccaggcatggtggcacatgcctgtaatctcagcaactcgggaggctgaggaagaagaatcacttaaacctgggaggcaggttcaat

SEQ ID NO: 143 - DNA, 2585 bp, Homo sapiens
agaagtgccgagtcccggccgggggcagcctcgccgccgctcagctcgggaatccctgccccccaccagcacctcagtgggggatactgcaagttcaaggtggtttaaggcgtgaatgaatgaaggagcaagcagtaagccccgacagcaaggccaccacagccctcgccccacagggacgcctgagcaaggacccaagcaggggacaagcaggctcaccccgcccttgcggggctgaccacgaggccccgtccggtggaacacgccatgacgatctgaacctgccccagccccaggactctgagtgcagcaagaggggagccgggctggagagtggggagcacggagactgtggcctggatggtgccagagcaaacaggagagaggctgcccaacgcagaggctgcagcacagaccagagggtcccggggctgactgggtgggggcagctcccagcgagaggcccctgggatttgggtaagtagaggcacatgcagactctggccacagggcacctcgcgcacgaggggagttcaccacacaagctgagcggagggcggacgcaggagagcagcggtttctcggaagccaagggcggtcatggagccccacgccacagcgcttcccacggggccacaccatccggtctgcggagggggctgcattgccgggaaggaccatctgattctggattccagcctcaccctgggccaccgctgagtgtcccaagtggccccttagcccccagggccaggcggcatcccaatcccctagggatgtctgtgctcagaatgtggcacacacgccccggcagggccatcctcctcctcctgcacccgccacagccgtggattcggggtctctatcgtgggcagaaattcacacagtcaaggtgagggtcccaggagcagctgtgaccaggccccggctgccagggagagggggtcttcagccgacggggcagacaccctgagatggacccttgtccaggggagggccctgccacccacaattccttggcattcctgcaccagcaggacgggctgagggaggcgcctcaccagtgccagcgcccagcatcactgtgccccggtggagggggaggcccttccgagcctgggcctgggtgtggatgagggcaggtctctcacctctctgacctcagcttcctcaactgggaaggggggccacagcacccccttaggggtgatgaggaagtgggagctcagggaggaccccgggcagggctgcctcctcacctctcttcggcctttggacactggagctcagaggaccaagtgaatgaatgaatgactcgatcaatcaactgatccatgaatccatggacccctgaacagctggacagctgggctgtgggcaggacaggggactctggctgaagccgcgttcatatgtgttcagctttgtgagtggggcgaggttgagggcttattcagtgggggaggtgcacggcagggccagtacccttggagggtcaggccacaggggcggggacacctgccaggatgcccaaccccagaggcagtgggagctgttggggagccgtggtcccagtcagcggtggcttgatgagggctgctcccacttcatccgcaggattccagccgcagctaccccacacccgagctgtccctagtcgcccaccgcggccggacaaagccccagcagccaaggtgctccgtggggagggtttcttgggtttcttgaagccagtatttcccatagtatcttacgtcccagcagaggcctccactgtgcccggaccagcggcccactcagtgagtcgagtgtgcacctggcacccctctttctggaaatccacgaacaatgggctcccagcagaggactgaggctgagcaggccacttccctggagctgaccccacagctgtgtaggtacagggtggccgtgaacacttagggctctctcgggctgtgcgcttcttgttcactgcaaggagcagggtgttggctcctgaccaagccctgtcactgctgcccagccacacgtggggccccttcacccacccctgaccacctcatgcaggtgaagccactgtggaaacagcctggcagtcccttgaaaaatgaagtcataaaccccagcaattgcactcctgggcctctgacagagcttgcacgtcccctccaaagctcgtgttaagctgtgagccccagtgccggaggtggggcctggtgtgtttgggttctgggggtggatccctcatggctgggtgccatgaacccactcaccacagtgagttctcacgagatctggttgttgagaagtgtgtcatacctcccccacaactctctgtcttttgttccggctctggcaatgtaacaagcctgctcctccttcgccttctgccatgactgtaagctttctgagggctgaccagaagcccagcagatgccagcaccatgcttcctatacagcctgcagaaccgtgagccagctaaacctctcctcataaatcaccgagccccaggtttatctttacagcaatgcaagacctgactaatacagcaccagctccccaaaataaaaagaaatattcaaac

SEQ ID NO: 144 - DNA, 377 bp, Homo sapiens
ctccgcctgcattctgcccctgtggaggagacctctggttctgcaactgcctgggagagtctaagtcggtgatggagagttaactggcctggtggacacatacctaccatgtcctgcaatctagcttaaagcttacactttaagaaacagaataacaagaatagattctagagctgagtttaaaccctggctccaccactgataagctgtgtgaccttgggcaagttgttagctggcacccagacacattgagaagatggtcatctgaaagccaggaaaagagactgctccagaacctgaccatgctggcaccctaatctcagatttccaccctccagaactgtgagaaaatacatgtctgatttttaagcccccaa

SEQ ID NO: 145 - DNA, 647 bp, Homo sapiens
aacaaaacactgaccttggtccacagacaacacccacgtccacgtggtgggtgggactggctccgtcagaggatgggaagatgagaagtgcttgtcgcaggcctggagatggggaccacccaggcatgcaggggatgctgcctctcctccatccaacaacaagcctgcgtgtgcccagccccctctggtacacgcattgctccccatcctcggcattgatcaattgaaaataagaccttggaagaaccccttgcaaagctgacattgtacgagccaaggcagtggccccggagagggtcagcgaggggcctccactgtctgagtccgctcctggcaacgcctgctctctgcactcagaggcccggtcccggcagctgccacgttgctcagaagttctggcagggggagcctgaaacccctgtctgctggcgacactcccggagcagcaggaaatctctacattttattttttttcttaacagacaaaagtatttgactccagaatgatttccaggaattacagtatgagaacttagtctttgagatttttattttcttcttaaaaaaataaaaatgaaatcaaagcagaagacactggttgagcagacagcacactagcacattccacttcgcaacaaaacctgcgt

SEQ ID NO: 146 - DNA, 2810 bp, Homo sapiens
acgatggagatgagcggcacccgcgggcggtcgctgaagacctcggcctgctgcaccagcgcctcgcgcacgctgtggaagtcgctgaggaccaccaccaggtagtggccgataaagaagctgaagatgctgccgtacacgcgggctagagcccccagctatcaatacattacagcaggatgagaaagacccaggcctttgacatcccaggctttgacaggcccaggcttgacagtgtcttggcacaatgttgtgggaagaataagcacaatgaagaggtgcctcaggaaggtattttcaacaacaaaccttcaacaccatgaactgctacttctaacggaggtccgaagcactaacacagccatttcctgtctctctttagcagccttgcctaatccacttacagcatcttgccaaatcatcatccaaattcccttcaactttactcttccatatgtgctcctagtcttatgttcatgtgggaaagaagcttgtgattttgaaactccatttcacagtggatgtacagatggtctttataaggtagctactcggttctagaacacagaatgtggaacagaagaaaatccaattagtaaccttttttcttttttttttccaagaggacacactcagccacccacctcatgggactgctatgagaatgactgaaataattaattgtgaagagctttgtgcccctgggagtaagaacactatgacacaactggagaaactggttattttaccaaggcttaggctggaatggtgtgctttcctttaaagaatcaaacttgacttatggagccaataaaagcctcttgggaaaactggcctcatacatgtctacacagtccctgtatagggttcctgacctgtgatatattataaaacaagaaatttagttccaatgtatccaagctgtcccttcggaaggtgatcagaagagagaaatgagtttggaaaagaaaaggaatagctgaacaagagcaagtgatttcagaaatctaaaccctgagaaaacatgggtaacagagaagaacttctgctgtgatatctacttctgcagggagtagagaaacagaagtagaaggtaaatctgagatgagcacagagatatcaagtgaattgcccaaggtcaccaactagtaagcagtgaagccagcatttggtactttggtagctctgactcggcaggctgttctacccctctttgggaaaagcgtcgcaaatgagcacacagcttcagggtgaattcttacagcaaagaaaaggaaatgggatagcacagccctgctatgtcagaagaaccaacatcagacatcagtggattctcatagcaacatctccccactgcttcctcttgacacacaggaaaaatgttccagaatcaactgggaagactggcatttcatttataaatgtaattcccaggctgggtcggtaactcctccaatctttccaattacgttcatttcagatataggggacagaaatgctccagaaaagaactagaccatatttggaggaggagagaaggagtacacccttcatctgtgttgtgaactatgtggaggagagtagtatgttacagtacagagagtcttggggaggccatgtgcatgtgtcttcaggcctccacctcctttcaacttgaggagctctgcttttccttctattttagaggggttacccaaaatctcatctgaaatctgggttccatggctaaagaagtttaaaaactgatagtgccatgacaaagccctggatcagaagtcacaaaacaagaatccaagaatctctctctcagtttggccacaaacaagtcatgattaatcctgggccaactacttccttgggaaacaccaccatctctcagtcagcaaagacagaaccagagagagagactctgcaagttcaggaagaaaggttccaactacttttactctccgttgcatctcctaatgtcaccacttcctcagagcagggtttagtcactactacaaaacattgctcaggaactgcagagccactagcctggcatgtggtgacacattcccaacacaattctctaacattctgatttcccttgcaaagataaattcaagcgaacttagaactcttaaagatcagattgagattgaatgccattggctttctccccatacctatgctcctacacatctcttcagcccagcacagggttttaaaagctcactgcttaacacagggctatctcctctgctggttatgagctgcaaggatagagtccatgtcctgtttgtgttggtgttcctggccactagccaagaacctgcagcccagccctagaatagcagttgaatgaatgtggcagcccacacactcaaagacaccagaattatcttaccctttcccagagagcttcaggtacctttcttttcctaaatgagtcactaatgtgtctgtataaatatggtttccatatatgtcacagagcccaaacatttcatctgacttactgtggtttactttttgtgactgcatttttattatatcttatataaaaagggggatataacagaaggaaaaaacagtaaagcaaaaacccatatctagcttcagagcattacatatccactggaagccctaaagcaatgctccatgatcgcatggcctttccgctgcataaccctgaggtcattttttgatacataattctcaaagtatgcagtgctgaaagaccttgaagagctttcttaaatgatgttatggttaaaatttctatgattgcagtccttgaaatcataaaagaataaatacatccttgg

SEQ ID NO: 147 - DNA, 2228 bp, Homo sapiens
gatgcacacgaggaagaggaagggatcctcgcaagctttgaaaggcgccgtcaagtcaaataaataaatgccctacaacaccaacccaggactgagatctgcatgctggaatgacggtggtggtggtggctttcagtattccccaggttttgtccggagcaccggcacgccctctcttgaagtccgctctccgcacagtggttagacgggaagatccggagctgtccagtgtcttgggtaatgcacggcatcgcctgatgtctgacgctagaacaccacgtaaagtcaagcagagggaagtgaatgcgccctaggcccctgcaggccaccaagaagagctagagggagttggtgcaatcctagagatgccggcaggtgcaccaatctgtggcacacgtacgctctccaatggaagacaactcaagaccacaccaagtttgtattaaaaaagtactgttgtgttactttttaccaacctccaatcattatacaaaatgttaaaaaatacacaaacacacacacacactcacagccatagaggttatcgcaaaagatcaacccagaatctttcagaatatgacagatgcactgagaaggcagataaattgattcaatatacaaaaggcctctttcctatggaatttcattagattaaataaggtgttccctcctcacagcctcatccttatgagcaatcatataaataatctatttaaagtccttgaactataacttgtataatttttagttttccccctttgaaggggcctaagagaaaggtttgagaaaccagctcttgaggggggcaggggtgaggggtaagaggtcctgtgcctttcattcatcctgggagcttctcaggattgcagcatttccacctgagtgttcattcttgtacattttctcatctttctcctgggttcctaggatcttggagattacctagtccaatccttttacttcagaaacaaaaaacctgaggctcagaaaggctaagtcaaatgcctagggtcacacagggaaactgtgggagttggatccctgagtcccagtccttaaactggttgctacatgacattctagaacctctccccaccaactccctttttaaagacagggtctggttctgtcacccaggctgaagtgcagtgacatgatcttggctcactgcaacctccgcttcctgggctcaagccattctcccacctcagcctcccaagtagctgggacaacaggcacatgccactacgcccagttaatttttctaattttgttttgtagagacagatttgccatgttgcccaggctggtctcgaattactggcctcaagcgatacgcctgtttaggcatcccaaagtgctggggttaccggcaggagcaattgctccgggccagacttcccttcccccgcccacacccccccaacccggcctagatccacaggcactgtaatcacagctgacacactcgactcggaatcagcatagagagcactctgaaaattgtcaaatagggtccctgaaacttgtataccatacttctcctgaagatcttgaagcatctttgtgtttgctttttttttttttaacttaaaatatggcattcaggttttatccctctccccgacgccatgtttcctttctgtattagtcacacacgtgatcctaaagtctgtcttccccactttaactggggagggctggacaaggtggaattccaattgcaggagacaggatgtgacatgggtgaggtgcccaaggctcaccgactgaaacttcgatggctcttccctgtttccttgtgcagggccccccttctctccactgctcacctggctctcctcctcccttcctgcctgctttgcagctcttgctactattttccttttctttccctgctcccaccctggcccaatttatttcacagaaatatcacagggccagccaggcacagcggctcacccctgtaatcccagcactttacgaggctgaggagggcagatcacttgaggtcaggagtttgagaccagcctggccaacatggtaaaatcctgtctctactaaaaatacaaaaatttgctaggcatggtggcaggcgcctgtaatcccagctacttgcgagggaggctgaggcaggagaatcacttgaacctgggaggcggatgttgcagtgagccaagatcacaccattgcgctccagcttgggcgacagaacgagactctgtctc

SEQ ID NO: 148 - DNA, 251 bp, Homo sapiens
ggtacttctaaacttcgtggaagagccctgtttcataaatctgagacagccttggtctgagggagcaaagacagagaattcacgtgctgcccaggcatagccacatagcaggtggacatccctggacacttttctgaccctcattggattttcctggaagtacggagagttacatccagagaactctgaacattttggaaggaccccaatcctgcaaacaatgaatggcaataaatcctgggactggaaag

SEQ ID NO: 149 - DNA, 1284 bp, Homo sapiens
taagtcagctacagcaccgacctccaggagttggtgcagtggcctggggtggcagccggtgtgcctgattgccctggtcgggcgttcagggcagggagcagaatggccactgcagaagggatgtgcctgtgagtggtttgtccccagcaccaatctgctgtttgcggacatactatgggcagtgggtgctggccaagagctgcacgtaggttttctgttgactgtccatgcagggctacatggcccatactgtcagccccagctgtggaagtgggggctcatgaatggagtttctcatccaaggtcagtcgcgctggtggacggccctggctggaggcctacatcaccatccagggactccccacagtggccctcctgttgccctggaggctcaggtctctgaccttccatctcccatctgcaaagcactggacactggggttccgggcagatgcacggagtggcctggacatgcccatcacagccctaggataacccagacgggccatcgagacctatccacactctgtggagaccaatggaggaaacagctcagtttcaggctgtgggcgtctgaatcaaagcggggactgggaacaaggtgctcagcggacactcagcaaacggcctgaacgccgacgcctctcccgtctctgtctcctgtcttcacaaaaggaaaacggaatgcctttctggcatccacccagctttcccggatcccctgccagttgtcattttcagataacttgaattttatattttatgccaggatttttaagcccccaggatcttttcacatctgcacagcttggcttggaatcctcagctaggaccatccttcctccccaagaaccagggcctcatctagaaggtagggcagggaaatgagggtccacatgtggtccggcccctcggcatacagggagatgaccaggcctgggaaatgtgcccttcgacgggctggtgacaaggccaaaaagctgggcaaacacattgcagagatcctcccaaactaaaaccactgagagtacaagtgcaaaacattcccttttaagccagtaggggcttgacagctggagaacttgaaaacaacagggcacagttcacaaaatcaaaactcatggaaaactctgcgcgggtgagtcagagtgccagcgccaagtttcctggcatgcaagaggaggctcccccgctcaggcagatttttttaaacatctttttaataaattgaattgagacctaatttacataaaataaaactgacccatttaatatccagtttaa

SEQ ID NO: 150 - DNA, 4888 bp, Homo sapiens
gcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaa

SEQ ID NO: 151 - DNA, 850 bp, Homo sapiens
cggccgccccggcctccacgcaagcacccgagcgttactttcgtttccgcggcaaacgtctggaggcccgggtgagggaagaagcggcggcggagggttggggattactccgacgccgcggcagccttgcccgggcgtgctgggggagggcgcgcgaaccccgaccaggggggtcaccgggactgagcccggcggcctccggaatgttccccgcgcggtgccagtccgctcaccgcgcccttctccgtggccgcgccgtccagccaagtcctgccgcgctccgtcggccccgcccggatggccgcgctctggcgccccagctgtgggtcccctggagtcgccgcgctccggcagctggcccgccgtccgcgtcgagcgcgcccggctggagggcgtggactgttcgcgctgcctcctccccctgccccggcccttgccggggaggaggaccgcgagagcgccgccccgccgctcgtgggacctcgcgcccggggtctgagtcccggagctctcttgcgggctagaggatcgcggactttgttttcaagcgagtggggcggcctacgtaaaagaggaaaccgaaacctccgcgcgcacgagagggagaagggtctggagggaagcactgggtggattacagcgggggcgctatccggaggattcagagctctgcgggttagcataggcaagttagcattcctctaccttcatctgtaaagtggggctgttgaggaggaaatgtgattattttgcagccctttaaaatggtaattgtgaagtctcgagcaaagttggaactgcatgctattcatgtatattaaaaatcaaataataaaattatatgcacatc

SEQ ID NO: 152 - DNA, 524 bp, Homo sapiens
gcgagcaggcgcgtgtgacgtcgggaggcgccgcggctcctcggccgccccactcggtggtcccctgtctggatccaaactgctgactggctgacccgagtggtcacatttgccctctggggcttttgaaaaccttaaatcaaaattgcttttgaatctgacaactcctgaggctactttcgcggcctcggggctgtttcatataaggacgcgagttttcctgatcaggtctgtcggccacgttacgatttccaatttgcgatccatcagttacttccattgggtcttcagcccccagggactgtggatcctagaccccgcggagaagcccgtggactggagctgtgtcagctctgatggaacaaaaacggaggcacagagaggtcaattgattggtctaatgacacagatctagcaagtggtggaaccaggactgaatccaggtaacttgctcctgatgtttgtccattggtgctctcatacttttttccctctctcttcctgttagaatgtgcttccaggac

SEQ ID NO: 153 - DNA, 366 bp, Homo sapiens
aagttcccttcttgcttttaaacagcttctcagctccttttgttttaccactagctttgcagagacttgttaggaatttacagcttgtgattgcttcacttttttggaaatggctctatggtttcaaacaacattaactttaaaaaattaacaatgctgagcgtggtggttcacacctgtaatcccagcactttgggaagctgaggcaggtggatcaccggaggctggtcttgaattccggacctcaggtgatccactagcctcggcctccaaagtgctgggattacaggcgtgagccaccgcgcccagccggtttttcaagtataaaacataacattgggtcaagccagtgggctggaccatcca

SEQ ID NO: 154 - DNA, 442 bp, Homo sapiens
gttcgagcgctggggctgcggttgggaaactactggaggatgtggtgcaccagaataagagaataaaccaagaaacaggaagacgtgatccaggcaacaggatattccagtatagtgttggaaacagaagcccagtagtgaaagctacagctgccatatacttgcagtggaatcacaggagcaatcacaggtctttaatttaattctggagtgtgagcaggaaccagttaactacattcattgtccaacccccactggtttgaaagaagactccaaattcttggcatatgaatcagctgttcggtagctccaccttatccctgcagcgaagcagcagaaccgccaatggcggcacctcaggattcacactgtgggtggtgaggccttccgctgaaggaggtactggtggatgctctcagcatctcgctttagccaggcagca

SEQ ID NO: 155 - DNA, 1210 bp, Homo sapiens
gcgaacttgcagacgttgcggccgcgcgccgtgcagttgaagaggtagcagccgagcacggctgccgggggcgcggggcgccggggcagctccaccacggccacggagcagcgcggctcggagcagcaggccgccacgcattgccgccagccccgcacggccgccggcgcccgcaggaagctggcacccgccgccagggagtccttggtgcggatgatggcgtcaggcattgcgctgtagccgccgctgcccgggcccgggcagtcctcctgggggccgccgcccgcgcgcagctccagctccagctcctcctgaggccgctcctgctgcagttgccggcggaactcctccagcagctgctccacgcccgacagctgcgcgtgcagttcggacagcggcgccgcgggcggcaaggccgcacggccgcttggcagccacaggcagagcagtagcagcccgcgcagcgccccgtgacgcggcggtagccggcgctgcgagcccgcgctctcctgggcgacggaggccatggcgacgagagccaagggcagcgagccgaggcggggctgagcgcgggaggaaggcggggacgcgggcgagcgcgggccctgggcccctcctgcgcggccgcggctggctctaggccccggcctcacagcgcggcgcccccgaacccggctgctcccccgaggtcgcgggcgccggcgggaaccgcagtagcgggagacatagccggcccagccgggcaccgctccttgccctcgccggagactgcccagcgccctgcgcctctccgccccggcctgcggcgcgctgggtggcgacgagtcggcctcggcgttgatcagcaccaggtgtgtgcgaacagtggccgcggcggggtggagccttggatgaaccgttgtccacattctgttttctgagtcaaagaggaggaagatctgtccatcgaaactgagctgccaagatccactgccgtgtccttcggctttctgctcacaagacatcctggcctgcagggtgaggggttctgcccccatcaaagagagatcagctctggccttgacagatattgagcccccatcctcttccacttgcaatttcctggtcttacttgctctgccacatcctggccttgcctctagacgtcttgcggggtgagatgaccttcctatttgtatttttacatgaaaactataaatgcctctaacct

SEQ ID NO: 156 - DNA, 663 bp, Homo sapiens
ttttttttgtcgggaaagggcttccccgtgtaactttacagcagttatcgtagataagacttgcaaattacagatgtggacggtgagggaacgggaatttcactgaaagcgcctgagaaccagtaagagacctgcaacagctttgtgctccactggcgaatgcttcctcccctaatacacattatgtgtgcttggagacacaaggagtaagatacagcccctcaagggactcgtcatagggagaggacacagctttgggaataaaggggccacaaaggaggagagaggagtttgctgaaacttcccaagctcccattccagcagttcctgaagggtttcccctctcttctaggctggacaatggaggaggcttgaaacagtagctggcaagtggtagaagagatggagcagagaagcaagaagaagcagactcctcactccttcaccagggtggatttgctggtttgaagcagacctgagttgggagaggagagaggcgagaagttttaattggatgaaatatttctttagactggtctatacttttttctttatatctaaaattcactggaagagctatgaaatctgtccaagatttcgttcagttcaggaaaaaccaaaaccaaaaccataaccaccaggtaatacacatgtgactcagat

SEQ ID NO: 157 - DNA, 221 bp, Homo sapiens
tcaggttgcctcgctgacccatcttgtcagtccctggatcagcccagcacttcctctgaggccccatctggcctcatccaggcactcttggtatacaggtcccacccgtctgtattcttttttagtccattcactaatgcacaatgagccatggtctgtgctattttgttttttgccttttctgtttccttttgtataataaatgtttacacggaattgtt

SEQ ID NO: 158 - DNA, 2199 bp, Homo sapiens
attggccattgtctcctaggtttcttatagtctagaataaatcatttttcattacattgacttttgacaggctggaccagatgtcctacccttttggaattgtctagttatttatttgtagtatgacatttctttattttattcctgtatgtacatcaaacttgaagttagatctaaagtgtcagtcaatttaagtgaaacattttatatcttaggtaatgtatacttcatgttgcatcttattagatgtttttaaagctttatatatatatataagttgaatcttgttgactttctcaaaatcctgaggaatctgcagtgcatcaacatctccacagtaggtaccataaatggttaacagtttctgtaaggcaactttgcactagcctattttgagcatagaacacaactttgaagattaaatcccatccagggactgattggtagaagacaactagtcagggaacataggagggaaatacttaattgccataaagtgggtagataccagtccacaaataattctaaattaactacgaatatgctgtttcatgtttgtagactcatagatgttttgtgttattagtggctgttctggattataaactcccatgagaggttattttaaaatcagaatttttaatttttaatatttatcactactgcttatatcctcactttaacctacctaatgctgtttcactcaaatgtcttttctttcttccctgtaacagttgtgcagaagattctgaccttatttgaggcttacatataggtttggagatgtggaaaggagtggaaaaagaaatatgtaagctgaagtgccaaactcacactgaaataaagggcatggcctaccagctgacaaggagtgtctggtttcaagatggcaaatgaccctaaacatgatagacaaatacgttttacataggtacatgcacagataggcacatataaatccacatttgcaagcaaaaagtggaacctgtaaagcagaatttctgaggaatctctaaaagactaatactatatggaatttgaagaggaaacccagagcagaagcacatagtgaagtactgccacaaagatgtgtgacgccactaaaggtgctctagacccacaagaaaggaaaactgggagcaggacaactatctggatattgactgcacatgccaatatctcagtcagactaacagaatcagagctttaggcagagaaatgaatggttggagagagaaggcaatgcccaggtgccctgctttgaaatgtcccgcccatccccaaattagtctgaaaatttcaaatgttgtataaattcccttcccatcaaaagtgtcccataaacagcagtggtagaagagttttaactgagtatcacagcttcaatgatgagtatagaaaactccaaaaatctgaataccaacacaatcaaaaaagaggtacaaaccacaagtggaagaaccatctcaagaaataatgaagcattcatggaatacagattagcaactctttaaaacagtattgccaagagaaacagatggcattgcagttgtcagatctcattaaggtcttatatctgaaacagttccactgtcttccataactttcataactttgaacattttggctcataggcgaaagggaattgccttatttcgaatgagactttggactgtggacttctgagttgatgctgaaatgagttaagactttgggggactgctgggaaggcatgattggttttgaaatgtgaggacgtgagatttgggaggggttggggtggaatgatatggtttggctgtgtcctcactcaaatctcatcttgaattcccacatgttgtgggagggatcggtgggaggtaattgactcacggggccaagtcttgctgttcttgtgatagtgaataagtctcacaagatctgatggttttaaaaagaggagttcccctgcacaagttctctctctttgcctactgccatctacgttaagacatgacttgctcctccttgccttccaccatgattgcaaggtatccccagccatgtagaactgtaagtccattaaatcctttttcctgtataaattacccagtttcaggtatgtctttatcagcagcatgaatatggactaatacagaaattaaaatgatgcctgacacataattgcttaataaatattagctattattatttgacatt

SEQ ID NO: 159 - DNA, 2461 bp, Homo sapiens
cttagaagaaggctgactattcctatgggagagaccacacagaaactaaaaatacttggaagaggagaggggctcagttgagcccaaccttccagccaactccagcagggtggcaagtatgagagtgaggatatcttggagcctcagcaacctgtgctatccaatagctatcagccacatgtgactactgagcactcaaaatgtggagcatcctgcatgattctatagcactcaacaggtgtctgccaagcggacagactacagacccctctggccgcatgatgctgagcttccccttggacacatgaagattaagttagtcaagcatggagattcctccctctccttcacaaactccagatgtttggcatctccccaatatcctaagacctcctggactgggaacaaaatgagcgtagtgaaagaggaagcagctttagagaaagcaccacagggaacaaaccaataaaaaagcaggaaactcagcacaagcctgatttatgtcactgcacttctctactctcagccccattcccccaaactcccagcaagcacacaagcacacacaggcacacacatgcacatgcgcacacacacatgcacatacacaacacacacacacacacatgccttctgccagcagctctctttctcactctcacttttcttttcaaatgctggcatttgaaaaaatcccctattttgtttcaccctccttttctgcctccctaaagagcttccgaagaggagttttgatggtgcatctgagtgttaatagattcgggagtgtgaagctgttgcctgaatctcattccctgagagtgcctttctctttttaatagctgagaaagaattgatcaagcctctgttttagtctctgtttctaaacagaaagaaagaaagaaaaaggaaggaaggaaacaaggaaggaaggacatacaacgtaaaaacaaaaacatttttacgacgatccctttttcaacagctaggggcaatccagtgtgttcagttgtgttagttctgtgtctgtcaggagaaaaagccatgtagaagtgatgatttagttttcttggtgggaacacaagggaagctagttgaaagcaatggttgtggggtcttgaatggacaggcaagtccggtagtcagaagaagattttgattagaaacagaggaatttcttccaggaaaatacattgtcttcatgacaaaccaaaaatacaccaaatgttctgaaaactgccctttaaaaagaaagaacagattgttcaattgaaacactttcctgaagccaattgttgcaggctgccagccaccttcagtaccagccacccctccgtcctccccagggccggtataaggggtgcatgagagacacgtgcatgcagaagactccaccatgatgcctggctcccattgcactgtcccagagcggcgtagtggcagctggggttagtgctatctgtcatgaaagggcattctactccggttggcagagaacactcacacacggggaagctgagccatcagtgcaggagttaattcccgtttgcaataatactaaggatgtcgcattcatatatactcaatgagcactaaaggaatcataggaatatgctctcacaggagataatgtagccacagtagataaaggaggatgtcctggaagaaggggaaccttttttaagccaagggagaaaaccactgaaaagtaaatctttgcatgtagctgtgcagctctgcagatctaaaatctgtgctttttaaaagtatactctgtggagtagcagtccacatcaaaaggtcacagtttaaaagttttgtattgtgcttgggttatcccttaagatgttagttatatcatcacaaaagaacaagagtaaactgtaatttactatttttggagtatttttttgttgttaggcatttgaaggatgaggtgcacagtgcccaagagtatgtcacagcggcaatttccactttatgcagaattaatactcaattacttatctgcttacctggaccttgagtgaataatagattcctaataaagggtttttgagcaaatggacaaattggatgcatttatgttatagcagccacaacagcaaaagaaaatcaaacacttacaaaacagaagtcaatcaagttttaactagaggagacaccaaagtatcatacagtggaggaaaaattcaaatgttctgcgccaagctcctatcatgccaattgtacatgtttgtgcgtatgtagggtagctagggttggatgtgtaatcatccctaaaattcatttggtgaagaaaaatacattttatttgaaatcattgtctatttttattcctgccaatattttgtataacatagaagtctgccccagagtgtaaataaataatgaggaaggtcacagatctaaatatactatcttggttcaataataaaaagagaattttttcctcgtaaga

SEQ ID NO: 160 - DNA, 301 bp, Homo sapiens
tgctgaatcataaggtacgcccacaccgaacactagtgaattgctcttcaaaatgatgtaccacagtctacactctcattgtcggtgtagagaagctgcctgtaacctagtcaggcattatattacctagctttataactttataatttttgccaatcttatggtcataaaatcatcttataagcttctctctgcttggtgaccactctgctgttgatccaccaacctccagctggtactgagcatctgccatttttctgctttgaagaggcagcataagcaagaggactccatatagttc

SEQ ID NO: 161 - DNA, 1674 bp, Homo sapiens
gtgattgtcagcttcccctcagcaacacgcacatggtgatgcactcagcagttccctaattagcatttccagacacagtgaccacattgcagtgacacctaccgagatcttggtgaagatgtagaggatgagagacaggacagacatgtacacctggatcctctggcccccaaatcgcttcttcagatactgcggcattgtgaccacacctgctgcgatgtacacagggacgaagacccagccaagggccaggagcagccaggttgcctgggagagtggggagaagaagaaggtatccaggtcctggatgtagacagaggggcggcttcccacccagaggcagtgctgtgctgtgggaggcccccgaacagagaaataagagacctgggacctgaccccagtcctcccgtgtgaccttggatggatccctctgtctcctccagaccttgatttcctcatctgtgaaatggattctcaattgtgaaatggattctcgattcaccatgtagcctcccaggcatctctaaggatcctcccagcactaatgccagagacagaggtgggttagaccctcagtattctggagaaaccaggccagcttccttacgttccactcgaagccacctacggcaaggcctccggcagcccctgtcccagccaggccgatgaacaagccactgcccacattgctggacatcagagatgctccaatctgcaaggcacagttgggtcaagggtcaggagtcaggagtgatctgaatgaatctggagcgaggaccatgagtagtgaggagctgatatttgttgggtacccactgtatgccaggcactgcattcataaatacatttaattccacagatatccgcagggaggggtattagtcatcccaggttacagaggaaggaactaatgtaaggaaagatgaattcatggctccaggtcacccagtgagtaaatggtgaagtgggaaaaaagggaaagtgggaaggaagcctggaagtggggagtgtggacctccgccctgaggccatgggtctgagggcctccaaaggaaggaagctgaaggggatagggaagccccacaggagggaaggaaaggccctcccaccaccccagggatagccaggcagagggaggagccgagggactgagcacaggccaggtcgacctctgagttagttctccaggggcgcagccaagcacttggaggcagtagagagcaatgatgatggtgagcatgatcagggcagtcagggcctgtgcagcatctccaggaaccagctggccttctgagtttggggactcatttaatcctcgccacaaccctcagtgctacttttatccccatcttacccatgagtgaactgaggcacagataggtaacttgcccaagtctcagaactagtaagtgaccaaatgagaattcaatccctggctgtctggctccagtaacactacacaaatggtgcttgccacttaatgagcacttggtcaatattctctcttattattagatgggatctctgactgggaggggagaagggggagaggaaggggctctggagcctgggaggaggcttaaggagacctcggggagagggctgggggcagctaggggcagagccgtgttcctttttgtatactatgtcaccacagtaaaatcacttcctcta

SEQ ID NO: 162 - DNA, 543 bp, Homo sapiens
gcctgcctagacggtgctgggagcgcgtctccttgaacgttgtcccgcctgggattgcgaggatagagacttgctctgttgcccaggctggagtgcagtgacacgacttggctcactgcaacctctgcctcctgggttcaagcaattctcctgcctcagcctcccgagtagctgagattacaggcatgtgccaccacacctggctaattttgtatttttagtggagacggggttccaccatatcggccaggctggtcttgaattcctgacctcatgatccaccagcctcagcctcccaaagtgctgggattacaggcgtgaatgtaatgatttttaaaaagaaaaacatggatgtaaagaaagtaaagcttcgttttgaacagttatgatggtaacaaaactcaaaggagcaactaaagcagtgctgcaaccacttttgtctgtcttagtaattctgattagtgtacattcctcccccaccaaccattttgagagaaatttgtctgaaaacatgatttatgaaataaacataagtgctgaaag

SEQ ID NO: 163 - DNA, 4140 bp, Homo sapiens
ctgttggtttagtctgaaagctactattaaatatagtaaatattgtaattttattttgctgaagtttttcagtcatctcttgttgaatgaagctcattcattagtagatcttcatgagtggctcaggggtacataattgtctaagttatgtgtttgaagctgtttttctattatagtgttttatactgaaggacagcttgactgaatataaaatcttggttcacactttcagttttttgaaaatttattgtcttgctttatatatattttttgagaaatctgataccagtctaattattttgcccttgtaaattatttgatcacgtatccctgaatcctcgaggattaaaaaatttttttcggcctggctcggtggctcacgcctgtaattccagcactttgggaggctgaggcgggcagatcacgaggtcaggagatcaaggccatcctggctaacatggtgaaaccccatctctactaaaaatacaaaaaattagcctggtgtggtggtgggcgcctgtagtcctggctactcgggaggctgaggcaggagaatggcgtgaacccgggaggcagagcttgcagtgagccgagagtgcgccactgcactccagcctgggcaacagagcgagactccgtctcaaaaaaaaaaaaagaaaaaaagaaaaatttttttttcaagtttaaatagttttactgagatgtgtcttggagttaacattcaaagtttacttttccagttaactggaaatccctttcaaaatgtagattcagatcctttttatttctgataatttttcatggattataatgttaaatattctgttccattgttttttatttcttcttcaggggttccaattatatgtgagttatttatcttttgttcaactttctctttctgaccatttttccttcttttctgtatcgtatttatttgtttatttttgcatctatccagtgtctaagttttcattagtctgttttcctttggacaccttgtaatttagtcttcatttataattcccccccttccatttctttcttgaattcaataatctttaaatttactcgtggtttttttaatctatttctgttttttatattttgaatttccaattcacggtgctttttcatatccccaaatgcttatctgaggattttattcagtttgatatgttgtgttacaattttcttctgatttaatggttgctttttggtagagaattttcatcagccaatgcatgttaattattgtttgctgatttctcatactaccattatatagatttagtccatttccttccattcatttttttgaatttgaggggttataagattcctagttcagaaggactctctctgtcagcatagaaaatacaatttctttagggggtgttttttttaactttatagtagagggagggattatgtatgttccagttttttgttttttgtttttgtcttgcaggaccctgaatttctcctgttgcttcttttccccttcaccatccagttgccaaaaggcaccttgcctattctttttgctctctccactccctgaagctatcctgtaataagtgttgtgatactaagatactttatatttttgcacctaggatagaatttctatctctgctggtgattttagaccaattttaggcctgccactagatccgtttttctttattctgtatgttcttctttggcctgcccttgcttgctacaaaggcttatggtagaaatgtgaaagatcactcacttggatttggtgcttttaatttttttacttataagtatttgacatttggctatatttttcttcttgttaggctgagggtgtattttgtatagatttatttattcttcttgttctgtatcgtttatgacggacataggtagctgccattttattttattaccgcgaagtcctcacctattcactcttaaatctacctcattgaagacttcaataactatttgttgttggaagccataatgaaactgttgatcaaattacccaatccaaatcaaattaaccaaaaagactttcttcagtcttcatattaattaccttccctgcagaacagaacatggttgcccattatgtgaaattccttttacttctttggtggtcctgtctgttttcttatgcctaattgttgcttacggtatacttgctgtttgtttgtttgtttgtttgtttcttttatacactcattaagtgagttctccatctaaatatcccataaggcacttcagaatcaacatatccaaaaggaaacatattttactcatctccaaatcttttgtttctccagcaattcaagttttggtgaatgaagctatgaacaatccagtaatccaaaccagaaacttgagagtcatcttttttacacctcccactttgcatctctcacattgaataagcaatcatgccctgagccatatactttcttagcatctctgccatcctccctatcctctttggtatggcctctcttcagactgcctccttagctctcttctggatcactataacagcctaacaattgtatcaccttcagttttgctctttcttccatatgactatcagaattatttctctggaagatcatgtcaatcactccttctcagtggttcttcattgcctataggaagaaatccaaactccgtagcatgagagaaatgtttttcataatgactttatcctgcctttctattgtttctttcatatcatgcccagctcagccccccattcaatgaaaatcatactaaactactttaattccactaacatgttgtgctagttaagcctctttacctttgttcatgctgtttttactcagaccactccattccacaacatacacttgggggatacctactaattttgaagacccccttcagccctgatgttaaccttctttgtggaatcattattgacatgatggatagaattggtcagatgcttccttgttcatcagttgtactaggcacagcattctaatgtagcacctattacacattttaaaatttgtttacatgtctcccctcatgtaagtttgtaggactggtacctgaaatatactaggcttaccttactgacattttgaaatataagatagctttccaaggcttgcttttgcctcctgattcaggactctaccattggcatcatcaggaagaatttctaatagtattattgatcagagtcttctggaagtttctgcaggttacacatcaacttacttttccctgacaaaataattctgcatctagaaacacaaacaagtagtcaaagaagttatattggaactaagagatgaattaccaaaggaaaactgaaatcaagaaacatttgatgaaattcaggcaatgtcttcaggtgccagaggacacagaaatgtcccgagaaccattcacatgatcttaaagaaacttctgctggttgtcttgtacctttgaagcaggtgtgattgagatggataccttaatttttttaaagtaaaaattgttcattctcttatgtactttagcatactggtattcttatcaaaatatgaaacagcatcaagtttaatattaattataaaacacatggtatatttatatttctgctctttattttctaaagttaactcagttaactctccatataggtatttggacatgggctgtaaccactttttagaacaaatactgtgaagattgttttattacatgacattttatgatgtgagattaacacctttgtgttagtaaacatcctagattgttcacttcaatatagatttttaaaatgtatagttatacttgtgcaggatactagaaaatgaaaatgactgttcacacatgctttattattcagtaattttacaagaaaatattactgtttgaaagaaaatcatgcatgcctaaaactgattctgttccagttttataagttagtatactaattttaagacattgtgtatatttccttcacttaatttctattttctactgcatttctaccaatataaaaaacaaagaattcagttggttcctttctagagggaaaatttgttgtgagtatagtactgggcatcacatgctgcttccctttgtggctttgaataaacccttattttcttgtcc

SEQ ID NO: 164 - DNA, 1491 bp, Homo sapiens
gcggctcactcccctcggatggtctttccacccgagtttttcccgggaagaggctctcaagactagccagtgcaggaggaggagtcgaactctggatagcctgtttataaagccctaactgtgccgatgttgaccgttttctgaaactcctcctccaaaacccacgccaaaccacaagatgaaggaaattcacacatcaggatgccaaaaaccatggaagacttctgatgttctgggagggttgacaaagatggaccttaaattctagaatttaggtattcatggttgagatcctgaagaaaacattttctgctgagcagaagcaatttaataattgcctcccttcatttcagaatccagaagtgtctgcagccaaccaaagagggaatgtttgatggacagaagttggaatggaaggagaaaatggcttattttagttaaaatgttttacttttggaaatttttttaaaaacttattttcacatatcacataaatacattgttaggacccctcccagggccatagaagtggcctgcacagacatctggttttaaagtggcagtacagaagcaagctggtttcactgtccccacagaaaaccaaaaatatacagagctgtgattttccccagcaacagtccagaactcatatatgaggatgagacagatcctagggccataaagaaaaaaacttctttggaaaaaaactccaagcagatgttaaggtcgatcacaagacttctaatcacatactgagaaaacaaaagcatcactgcaggaaatccctttaaacttttgccttatggcaaatggacatatgctcaaaggtgctgaacacatgaaataaggctgtaaaaatctactaaacaaatgaaaataattacattgcaaatgcttttttccttagagcacttgttttaagaaatgtatttctggaatacaagctagaagtggttttgtcctgctgctgagggttaaaggcaaacttaaggtctccagcctttggtgtgacacatgagagcgaataacaaaaagaaggtcttgagttttttgatagttaggcatattttcattataatggtatccagatatgtgatatatctgatatataatacacatatagacacatatatgtctctctatatatttgtatataggtagattttattatatgtgaaatctgcatataactataatgaaagtctcaactgttacctcaataacctttaacctgactacaatatttaaaagttcaatctcactaccagaacacaccctgacacttctgattctattttgctttatgttttgcatattgtttgtcaacttctatcatatgacttagtatgtttattatttattgtcctctctctccattgaagagaatttttgattccttaaagaaaatatttctcacatgatcagttttttaatttacaaaatatctcaatgtcaatgtacccatttcaaatatatgtgtgttaaacatta

SEQ ID NO: 165 - DNA, 1798 bp, Homo sapiens
aattgtgccagtcacttcacagctgtcgccttttccagcaccattgatagcactaactcggaatttgtattcttcacctgcttgtagatcagtgactgtatatcttgttttcacacatgcctctgcattcaccttgtgccagtctcctaagtcggccttacacatttcaataatatacccaattatttccatgccaccatcaaacactggtttggaccattctaagctcacagttgtctttgatgtgtctgttactttgaccactgtgggaggacctggtgggttgacgggctctctacatttaatgagtcttgagatgccacttgcaggtccaactcctgcagcattttcagccatgacatggaattcatactcattgccttctgtcagaccagtgactttgaatcttgtttcagagattggtcgtttgctgatcacttttacccatcttgtgcttttcttttctcttctttcaaggatatactgttgaatttcactgccaccatctgattctggccttgcccatgtcagggtaatgctgttgcctgttatgttgctaggttctggaatgccaggggcatcaggaacagctgtaaaacaaaaacaaaaccccaaatcaattagatgcatttgcttggaaggttaaacttttgacatagtaccgcttagtaaaaacgcaaacttactatattgtatttgagcaaccactggatcagaatcaagtggcctgccaacaccaaacttgttaactgcagaaacacggaattggtattcattgccgtttattagtttaatggcagtgtaactttgggcttcacatttatcctcaattagtgcccaggcaagtctgctggtttcccgtttttcaatgatgtagtgggttatgggagcacaaccgtcattgagtggggcatcccaccacagagtcatcttctccccagtaatattggtgaatcttattggcccaactacttttcctggtgtatctataagaaaaagtttctagagttagtttctttttccttgtccattaaaatacaactaggcatgtctctaatccaagttcataaattgtagcattaagaagctattttaaaagtaccttgtactttcactttaatttctgcttttgcagaaccagatgcatttttggcttccactgtgtatacaccacgatggtcccgagtagcatctctaacaaataggctggtggatccaagtacgtcggttatttccatattcatcctcttttcgatttccactccatctttgaaccaagttactcgaggcactggtcttccttgtaccaaagctttaattctaaggctctctccggacttaataatgagaccatcaaagtattcagggccaaactctactattggtggaactataaaagaaagagaaatactatgtattagtttggcttaataaagacatacataaatatatatttttcagtagtgccatatcacaaggccaggaagagtagtgacttctactgtgctaccaaagcctattttgaaagtaggattgataattgagaatttggactatggggttaaatatttgcctattattattccctttgtaatgcctgtcatgtttttaattttgcattgctctttgtaaaaaggaaagtgaaacatttacagatcatgtacttcctaatactgctgcacagtcacacaagttcttttaagaggccatcagctgcattcaagcaaggggatgattgtgttgttggatgtatgttgtattttaataacttcagtaaagatggacacttattctcgag

SEQ ID NO: 166 - DNA, 1600 bp, Homo sapiens
tacacacacgcaatgacccacgagaaagggaaaggggaaaacaccaactacccgggcgctgggctttttcgacttttcctttaaaaagaaaaaagtttttcaagctgcgcgggcttcctgtgcgcggccgagcccgggcccagcgccgcctgcagcctcgggaagggagcggatagcggagccccgagccgcccgcagagcaagcgcggggaaccaaggagacgctcctggcactgcagataacttgtctgcatttcaagaacaacctaccagagaccttacctgtcaccttggctctcccacccaatggagatggctctaatggtggcacaaaccaggaaggggaaatctgtggtttaaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttatttaaaagatttatcagtagtatcctaaatgcaaacattttcatttaaatgtcaagcccatgtttgtttttatcattaacagaaaatatattcatgtcattcttaattgcaggttttggcttgttcattataatgttcataaacacctttgattcaactgttagaaatgtgggctaaacacaaatttctataatatttttgtagttaaaaattagaaggactactaacctccagttatatcatggattgtctggcaacgttttttaaaagatttagaaactggtactttcccccaggtaacgattttctgttcaggcaacttcagtttaaaattaatacttttatttgactcttaaagggaaactgaaaggctatgaagctgaatttttttaatgaaatatttttaacagttagcagggtaaataacatctgacagctaatgagatattttttccatacaagataaaaagatttaatcaaaaaatttcatatttgaaatgaagtcccaaatctaggttcaagttcaatagcttagccacataatacggttgtgcgagcagagaatctacctttccacttctaagcctgtttcttcctccatatggggataatactttacaaggttgttgtgaggcttagatgagatagagaattattccataagataatcaagtgctacattaatgttatagttagattaatccaagaactagtcaccctactttattagagaagagaaaagctaatgatttgatttgcagaatatttaaggtttggatttctatgcagtttttctaaataaccatcacttacaaatatgtaaccaaacgtaattgttagtatatttaatgtaaacttgttttaacaactcttctcaacattttgtccaggttattcactgtaaccaaataaatctcatgagtctttagttgatttaaaataa

SEQ ID NO: 167 - DNA, 838 bp, Homo sapiens
agagccaagacccggccctcaagtcctcctattagggcagcactagggctacctctttgtcagcagaacctttggatagccgctgatggggtgagtcagctttctgggcccggcagaccttttgggaatccctggcttttggggcacaacatcctggggaccaccaaaaagccctttcacctgagctttgggaaagaggaacagctccggctgtgggtggctcatgtcaccatctggaagccagctgggccacagcagacgcgctgtaagctccttggaggcaaggattctgtctgcttcacctctaaagcttcagcatggcatgtgccctgcaaatggcagtgccagtggacatatgctagatgagtggatgaaggaccatcccacatcagctcatcgtggagtatgcagctcagtcctcccgcctctcagggacaacttggatcttcaccgttcttcgccactaagaattccagtcatctacattcagagggaagctgagcaaactggctcctgcccacactggaaaatttctctgcctaaaccagcttccctaagccgaggggagagtccaagatcccgaagatggcagggccgtgcaggctcctgggattaagacacaaacaagccctgttctcaggctgacagtaaatggttcagacagtcctgatgacttgtgcattgtgactgacacgggacacagccacggaagtggagtcacggtacccaaaaccagagaggtcagaggccagacacttatctgggctgcaggacctggtgcccacctctgtgggtctttctcaaagactatggcagaaacttcctggttccaagggac

SEQ ID NO: 168 - DNA, 760 bp, Homo sapiens
gggaaggtagaaggtggggtctgccggacgcgtgttcctgccaccaggtgcccgctccccgcgaggccggctcaggagcagaaggaagcccggtgccagccagccttcctgaaagaccaagcccgcgccatccggcttcctccagtggacgcctgcaggacccaggaacactacatcaacactgttggcggggacctggacacagaagactcctgtttcaagaaaatacaatcatctctcaaaggctgtaatttatatgcattttaaaactctaggcattgaaaaccacccaagtgtcccaaatagaagggtaatatataatcaatcactcagtgtaatattatacatcctttaaaaatgttattgggaaatgttttatgatctgtaagtccaaggaatcctctcccaccatttctttccccccgctgttcccccatacccacacttctttgttccaattggcatgtaaatttggttttcccgccaaatgagtcagtcatgatgggaacctcaactgatttgaacagatgtgtgtcaatgttacttggaaaactagatgtcaataaccagggtcacagaaaaaggcagtggtcacaactctgtaaaaatgtatgcatgcacacagacaagaactaaagtggaaccccacacaggaaaacagtgggctgtactccagtgctgggacattgaatgactgtatgctgcttttgatttccgttaatatgggcaactgtccaattaaaaaaaaaactcctaagga

SEQ ID NO: 169 - DNA, 386 bp, Homo sapiens
tatatatatatatatatatatatttagaaaatgggtagaactatgaagagacatttcactgaagcagttatactgagataaataggcacataaaaagatttccaacatcaccatccatcaaatctcagatctcagcatattctgctttaaaagactcatcttgtcacatttcagtaagaggcagaatcgagatttgaatccatgttgtctggttgcaaagacaaagcttttaatgatgatgctacagtaacaatgctagttatttttgtcctttactcaccatctatacctattttgttagtatctcttgtaatttttaaatggtttatcttcatatatcattgtgattgtggtaactttgtattaaatctatatttttatagatc

SEQ ID NO: 170 - DNA, 733 bp, Homo sapiens
ggcctgtcctggggacctggcgaggcccggcctctgccagccaagcctgctggggacgaccgaggtagcccgggctcggcttaggaaggcagcgggactcgaggccttggggtccgagtccgaactcgctcctctagcgccgggcggggagcgagtgggagagcggccgcgaagctccagtgttgaaaacgcacccctcccagctttttgcaaggcctacttgggggcggagagacaagcaagctgtcatgttataagcagccctttgaggggtccatgtgatgtcaaggaatgaagtctctagccaacatttaatgaggaactgaggcccaccaacaaccttgagtgagcttggaagtagctccttcagcatcagttgggtgtcgagatgactactgacagcttgactgcaacttcatgagagtcttctggaccagaaccactcagttaagtggctcccagattcctgatcctcagaaactctgagaaataatgaatgttggttgttttaaaatggtaaattttgaggtattatgttatgtggcaatagatagctaatatataaattatttgaatcaaacaatacgttaaattaaagctcagaagaataaacatctgtaattccttaatttgttttcccttctattctacagaatagaattttacagatgaaccttgtagttacttgtgcaataagagacagtatgttgtattgattaagtgcagagcctct

SEQ ID NO: 171 - DNA, 2008 bp, Homo sapiens
gcgagactccatctgaataaacaaaaaaaaaccccaaaaaacaaaaaaacaatgtcatggtattagttaaggcaagtgatattcgctaccataacaaaaatctctaaaaatcttatggcttaatataattagaatgtactatttgccccggagaattcagacagatgtttgtttctgctctagtcactttccatatagtcattccaagtccagtcttcttccatcctgtggctccgacttcttccaagaccttaaaatcctttctccttccagcagatgcagaaggagagaatgtgtggaggattatgtagaaggatttcacgagcctggcctggagaggacacatcacttccaactccattccattaccagagcttagtctatttccagaagattataagcttcatgggggtagatgctttacttcattcatcactgcatctccaacgcctagcacagagtcctgaattacaggctcaataactatttactgaatgtgaaaacagagctgcttgaagatatatgaggctaattgagcttgtgcatttgttggctattgctgctacagtggatgctgttgttcagtattcagatatcaagaaacaactagccaaagtaaggaggaacgaggggcccatgaagctcagtagagcttgtgataatatttgcaagagaagactacctgccaaactaacttcagaaaaggtgtttctggttgaaatcgtcgtgcccaacattccaccaggttcctcacatgttgaatacatcaaagcctactccacccatctggaatggacaagcagaaatgactcactgtgttttccaattgcactcaagacctgtctccatatgccctcctcctctgcttgagcagaaggtgaaagaggttgtgttgactgtggaatttggccattgaatcttgaagacaaatgctctttgacttcactacaacatcagagggcacttggccaaggaagactagttagaaccagcctttttgcaaacacagctgaggtttttatcctgtcttttcttcatcacaaaagtagcatggagaataatggacaatagagttcaagtggagcaagaactgtccagaatttggggaagaagtcacatatcagtcctggccatgataactggggcacatgtactatatccaagttgatatccttaatttggggaaagttttcttgcctttcccacagcctcccaagccattgacaattcccacattcaaaacattctcattcacatttctgattcactttgggctacaggaacaacagatgttgagtacttctagggagcaaatccattatagatggaggtaggtcttgcaaacagagaggtagagagctttctcgagacctttggaccaagcagataacatcacaaggtgtaccttatgctaagtgcctgatctctaagaccctccaccagcgtcagagagacagcatgctcacaacatgacagctggtcatacaggtgaagaagaacatgaagaccagcccacccctgaaaatgacagatcaaactcagcttcacaatgtctcttattccatcgctaatggtgtttaaaaacacactttgtcttaaggaacaaggggaactgaccacgtgttcatgacggttcatttcttaccctctgctttggcttgaccaaactttagtcaggtatctctcctccacaaagattcctagactttggctgtcccccaagtttaagcaagcactgaaacactaaggagcagaacatctgttaacagctcatcctgaaaatcaactgaccataggaaaaaacactccctattgagatatcctggttttgccacctgctcgcccacactctatgcccttctcctccacaaaggtctggctggttcttctccctccatacaaaggaaaagcttatttctgtttgattttgagacatttgcagatatctgaggttggcatgttcttcctattgcaatagtctttttgagtaaagtctctctttatctaa

SEQ ID NO: 172 - DNA, 496 bp, Homo sapiens
acacaaattaatccactcaaatgttggcaagtggagcagagtcccaggacaggtacagaaacacccccagttcaaggatcttcacacctggatttaggcctacacctgcaactaccccagatggagccatctcagccatgacaacagagaatgtaccactctcacgtgaggaagaggggtaggcagtgctcctgtatcaccagctgttaatgagaccctgaggaaaccacatcatggagatcagcccttctctcctgtaaggaactcatcctatgaaagagcaattggtggctgcaagagctgtctctgggacagctgttcatgtctatatctgcagggtaaccctcatagtcatatgcagtcatatccatagtcatatctggagtcagtctccagtttgactgagtgaatggagaaactaaacatttattactgaataataacattaataaaccatcttaatgatagtaataataaacatattgatgagtattaa

SEQ ID NO: 173 - DNA, 1453 bp, Homo sapiens
ctactttgaaaggggatgcttgaggctgaggtagttttgagggaaagggggaagttctagtttgatttgtttgggagattgctgtcctttcataactgaagcaaatgcttgaaatgtaaaccatgtgtgatacgaatgatctgagagccagtgaccaagtctgcttttccctgagctctcctgctgccgcctctacctttctgacatggccttccatttggaacttgatatgtgtacaagtgatctgttggccactgtttcattcatcctgaccactgtatccgtgtaatgtgatctgagctacaacaggtggtatgggatagaggcaaggaaagcagagagagccctctgaaatgaacactacccactggtgtgtgtagcacatgatagtctgtaggcatgagtctgaatgttgttctcacactcctttactagagtattcgttccctctgaaggtagtttgaacatggaaacacagttctatacctagaaggttggaaagtgtctgggactataagggttaacatgcataattgcaaagattgtccgaaggctgatggaaagcagagactgaatgggattgagaacagatgcgaagcttgatttaaattacattttattggatgctgcagccttaagagacgtgactgctttacagtttgtttccacactgtgggcagctgctgtctgttctgtgtccacagtaggatcctgcccaataaggagcagcctccccacctcattgtgtttgaggcttggcgccttcctcttaactgtagggcttgagtcaggaacatggcttgactcgcagtggggctgctatgtatcctccctggcttccagccaaaatcacattggtagattcaaaggggccaaatttctttcccctctatctttccctttcccctggttttggaaatagagttttctgtctactgatttgttagtttccttttcttctcccctcactgtcaatttctaggtcattgctgctcttaagactttagcagttggaacagggttggttctgtcaatgatgcatgaagcagacttagtgtccctgcttggcttctgctgcccttgtgggagcaaaagctgatatatgtttgtcagtaaagtcttaagtgtaattcagactgctgaggaagaaagccctttccttgctggcttttctccctgaagctgagagcttcaggaaggtggtaggagttttagtgggatgggatgggatgggcttgtggttagcagtttttgccaggatcataggctgcttcacttagagtagtggcaaagatgctgacctacattcttccttttgaaggtgatggagtgtgtgtctatatcctggtttatctctctcccccaccccaaggaagctgattaagcttccatagagtgttgggtgttgccatggaaagagcatagacaaaataaattgtgtgtttcaacccca

SEQ ID NO: 174 - DNA, 552 bp, Homo sapiens
gtttaaattctttaaaaattttaatcttttaaataaatcagatgttagctatgactatattaaatctcatacagtattataatagggagaaaaatggtttcaaataggatcagaacttttaagactttattataaggagattttcaaaacctcaggcttttcatatgtttaaaaaaaggtttgagtcatgggtcttagaggcttttgaaaaataacatttaagttgtcaaaggaatttggttcttaagatatcctttgtttttaatatggtgcacaaagttgacagattgtccctgccgcagtgtccagggtcacctctgggcagctgctcctggcttggacgtatttctcatgaggcagacttttgccagccactctgtgtaactctgacttcctaaatggtgaccgactttttagagactgattcctagtaaaactattttacaagtgatcccactttaagttctgtgagtaagaagtctgatcacctcaggatggtgaaaccgagttcttctggagaacatattggaaataataaagttatgtgcctga

SEQ ID NO: 175 - DNA, 2135 bp, Homo sapiens
ataaatgaaattgggccaggcgtggtggctcacccttgtaatcccagcgctttcagaggccgaggcaggcggatcacctgaggttgggagtttgagaccatcctgaccaacatggagaaaccccgtctctacttaaaatacaaaattagcggggcgtggtggcgcatgcctgtaatctcagctactctggaggctgaggcaggagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccagcactttgggaggccgaggcgggtggatcaccagaggtcagaagttcgagaccagcctggccaacgttgtgaaaccctgtctctactaaaaatacaaaaattggccacgtgtggtggcgggcacctgtaatcctagctacttgggaagctgagacaggagaattgcttgaacccgggaggtggaggttgcagtgagccaagatcatgccattgcactccagcctgggcaacaagagcgagactccatcttgaaaaaaaataaaataataaaaagcagctcatactagggaacttggtaaagcaacctcatgctgttgtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggctttttttttttttttttttggatacagcaggatcttgctctgtcgcccaggctggagtgcagtggcatgattaaggttcactgcagcctcaatctcccactctccagcgatcatcccacctcagcctcttggatagctgggaccacaggcacgagctaccatgcctggctaatttattttttgtagagacggggtttcgccatgttgcccaggctggtctggaatttctgacctctagcagtccacctgtttccgcctcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgc

SEQ ID NO: 176 - DNA, 566 bp, Homo sapiens
agcttcccagcagctttgtttacctaagcaagcctgggcaatggcgggcgcccctcccccagcctcgctgctgccttgcagtttgatctcagactgctgtgctagcaatcagcgagactccgtgggcgtaggaccctccgagccaggtgtgggatgtaatttcgtggtgcgccgttttttaagcccgtcggaaaagcgcagtattcgggtgggagtgacccgattttccagtgagatgaacccggtacctcagatggaaatgcagaaatcacccatcttctgcgtcgctcacgctgggagctgtagacctgagctgttcctattcggccatcttggctcctccccccagatgaggaagctggaacttgtaggggatttaagaacctagccacacatcaagcacttggtaagaggtgaagctatctatggtttggtgactccaagctttcagctttacattattctgcctctcctcatctgcttctgcaggcggtcatgttagcacagatcaaagtcatgccatggtcccagtaccttttttcttttcaaaagttatctcaagttgt

SEQ ID NO: 177 - DNA, 562 bp, Homo sapiens
gcccagtgcgccaccgagagccccgggcagggggccgccctgtgccctgcagggccgcggggccgcgtagctctctcggtgcggcgggtaagtgctgcccggcgtcggggcgtcccgcgccgtcggtcccagcgtgcccggccgctgcctcccggggcaccccgcgctgcgcgcatccctcgggctcggcgcccgccccgggcccctccagccgcgggcgctgcctcggcgcccgggggacgcgcctccgctgcgggagctgccggcctgagtcctgctgcccctccagatcccagtccagctatagcccccaccatggctgagggaggggtaccctcgccagggcctggtgcctacttcagcaggaaagcccgactctccttccgccaccagctgcatgacatagcatcggccaatgactccaccatttgaaggggacgacgaggaggtgaacctccaggaaggcttagcaagcttccttccccagatttctcagcgatcctaatgtccacctccccaagtcctttctaaccttctcatcaaatgtgttcatagttgctaa

SEQ ID NO: 178 - DNA, 2129 bp, Homo sapiens
agcgggagatccgagcgtctcggctggtggaaggggcgaggagctttgcagttgtgtgcgagtgtgtacagggacagagtcctgagcaaggaaacctagaagggagagaggaataccatggaattgagtcctgtctggtagcactgacagacacagtggccagccaccctcatgccaccctgtcctgccatgggaaggaacagcagctctagagttcctatgggaactctctttccttctcactgaactctagcttcatcaataactcagtgcctctggccaagtttttagcctctgggacaacatccactatatccatatgaggcactcatgtaacacggtgattaagagtacagatgctgaagccagcagcctaagtctgaatcctgactgccaattattaatataagttgtggaaccatggtcaagttactcaacctctttatgcctctgtctcctggtctacgaaatgaagctttgaatctgctgttattaagttgctggtgctgaaataacacttattatttatgatctaactgaaatgggaacactggaaacttctttgaaactgaagaaaaaaatgaaaaagaagtttttacaatcaaaactgccatgaagactgctttacccaaaattttggtccacagctttcattgaattacttatcagggcaaacaaagtttagccatgtgaacacgttccaattttgttggaaataatttggatccagctatctttatacaatggtgagttcgtattgcatctcatggctaaaatactgaggtaaaggcttttggatctttgtgtgtgtgtgtgtgcatgtgacaaaaacaagcaatggggaaaggagtccctatttaataaatggtgttgggagaactggctagccatatgcagaaagttgaaactggagcccctccttataccatatacaaaaatcaactcaagatgaattaaagacttaaatgtaaaaacccaaactataaaaaccctagaagaaaatctaggcaataccattcaggacatgggcacaggcaaatatttcatgacaaagatgccaaaagcagtagcaacaaaagcaaaaattgacaaatggaatctaattaaactaaagagcttctgtacagcaaagaaattatcatcagagtgaacagacagcttacagcatgggagaaaatttttgcagtatatccatctgacaaaggtctaatattcagcatctacaaggaacttaaacaaatttacaagaaaaaaaaacaacgccattaaaaaatgggcaaaggacgtggacagacacttctcaaaagaagaaatttatgtgggcaatgaacattttttttaaaaaagctcaacaccactgatcattagagaaatgcacatgaaaaccacaatgagataccatctcacaccagtcagaatggctattacttaaaggtcaaaaaacaacagatgatagcaaggttgtgaagaaaaatgaacacttttatacgttggttggagtataaattagttctacccttgtcgaagacagtgtggtgattcctcaaagacctaggggaagaaatatcatttgacccagcaatctcattactgggtatatacccagaggaatataaatcattctattataaagatacatgtgcatgttcattgcaaaatagcaaaaacatggaatcaacctaaatgctcatcaatgacagacttgataaaggaaatatggtacgtatacaccaaggaataccatgcagccataaaaaggaacaagataatgtcttttgcagggacctggatggaaccagaagccattatcctcagcaaattaatgcaggaacagaaaagcaaataccacatgttctcacttgtaagtggtagctgaatgatgagaacacatggacacatggtggggaacaatacacactggggcctgttgcagggtgcggagtgggagggagagcatcgggaagaatagctaatgcatgctgggcttaatacctaggggatggaatgatctgtgctgcaaaccactatggcacacatttacctatgtaacaaacctacacatcctgcacatgtacccctgaccttaaaataaaagttggaaataaaaaaaaccctaaacatatacctac

SEQ ID NO: 179 - DNA, 4215 bp, Homo sapiens
aagggaatctggtgatatgtagcagaagccaccagggcctgctccaccagggagaacgcggagcagcagagtcagcggaaggagtgccagtgcgtacacctcctctctgtttacaaagcaaagctgcttgtaagaagtgcgcttgaggaaagagtgcattttacatttcatcacttcatcactctgtttattaaaatctttgttgacttgatatatacattcagaaaagtgcatgtatcaaaagctcactgatttttttatacactggaaacacttgtgtgaaataccactgaaggattcactttaaaatggttgtgtattaatgcaaatttcacctcaacaaacaaaaaaagccccagaactcaagcagccccgcagagcccccttgagctgcattttgttggaagtgtcggggtggaatcaccagggtcaacggtttcccatttccactcccgctggcacgtccgcagacccctgccggtcccacacgcaccccaacgcttgctgtcttctcatttctgctgggtgggtggtagtatgatattgtggctttactttgcatttccttgatgtttaatgaacctgagcaccttttcatatgcttctcaggcatttgaagttttataatagttttaaataggggtcttttttccttacatgaaactttgatgagagtgatcatttcttttttattccccaaccatgatccagttcagaaaacatcaaggaccttgctgcctctccaggaagtgtagcaaaaggcacctgcctgctgtgctggggaagagcagtgggccaggttagccccctgtccctggtgtgctacacttacaggtgggcattgggctgaaggactctctggcccttgctgttgggtcggggatgcagtcagaaaggagcatgaagggcatctgtcccggcagggccatgtggccagaccaggaagggctgctcaaagaagaacaaaggcttctctgccctgatggagatgctgacaccttcagaaagacgtgtttgtggcatcggcgtcatttctttctgtggctaccaaggccgagaacttctctgtgctccacctcatggccagggttcttacagccgcaggccttctgtgtgcattagctagctaacttgtttcttctttcattcatccaataagtatgactaaactcctgcagtatcttcagcatcggcaattccacactaaataagtaaaacccttgccttcacagagatcgaaaacaaacaggaaaactgtaatgtcatgttgggtgtctggagctgtggagagaaatgaagggggccctggagagccatggctgtgccaaggccagggtggcgtcctggagaacctgccttggagtggagtgctggatctggggaggggggagtgctgctgggcatttcatggacacataggcaggaggtgggcaggagcactgagagcaagggggagatgggagagggcaggggcctggtcagggtctcagggccctgggcgaggaatttgaattgcagtccaggtgagagggatgggaaggacaaggctttcagtgagctgcctgggctcttagagagtgaccctggctccctcatggaaaagcagccatctggcccttgagttcagcacctctccaagctccttcctgtccctagactggcagggacttccagggacagccttggccccctttccgctctgccttgccatctcccatcgcttgtcatcgcttctgtgttgggtttgccctctggtcctgttccctagagccatgctctggtcatgagtgttacagggccagggcagggcctgtcaggggaacagagtgcagaccccctctgtgggcccctctgggccctcgcatcccactgccttggagaggagagagcaagatagaaacaggtcctgagatgaggtggcggcatacaagctatctcacacttctgcacccttccaggtgcgtttctgaaatgcatcaatgctgtgagatctacactgacttcagggatgtggcaaaccccctatttcttgtaaccagccagcgacagtcattgtggagccctgcctgtgccccaggcagccctgtgcactaagaaagccaggcctgggagacactgacttgtcgtttgcctccaggcgtttttagttgtaacagactagttcttgtttcccatcacctagaatctgttgatctgtctggatcttagttcctgagcctcctgctctgcaagacgcaccctgcacatgcacgctcacgtggggcacacacacccaggtgcccatcatgccagcaggtgcacagttggagaaatcgactccccagaccagactccccagagcgcggggagcggccaagtgtcctcgcacaaactggggtggaattgatacaggggccagggaggtccctaaacactagtgggaccctgaccctagccagcatccaggctcttgacactgttgtgagaaggatttcaaggatgagtcagaaaacagtgaaagtacaaagatttattgcagagtgaagagtacactcttgcaaaaagaaagtgtgggggcagactcaagagagccacagaatggggtttggggctgctatctttatgggtttctttaaccgaggggtggaatattcatgaaaattcctggaaaaaggtggagatttattggaattgtggtgctacccattctttctttcttttttttttttttgagttggagtttcactcttgttgcccaggctggagtgcaatggttcgatcttggctcaccacaaactctgcctcccaggttcaagcaattctcctgcctcagcctcccaagtagctgggattataggcacacaccaccacacctggctgattttgtattttagtagagacagtgtttctccatgttggtcaggctggtctcgaactcctgacctcaggtgatcctcccacctcggcctcccaaagtgctgggataacaggcatgagccaccgtgcctggcccagtgtcacccattcttacaccaaataagggtgtcctggaactgtcatggtgttggtggtgtgtgattgagtgcgtcagtgagcagataatgaggtccgaggtgagacctagctcaaatccagctctgcactgggtccggtcagtcttagccagcttggtccacaccctgtttttcagggtcagggcctagtcaccctatagcctccagttatatgaaactgttgcctggaatgtgtattcttctgtgaccacctgtattattcctgtcacagaatcgtgacacagcagcagccctttcccagtgtgtggggcacagttacattcctaggtgtggaaggaagacctttgctgcattaaattatccccagcatctgtttgctgcttttaacacgagtgacttaaagggacatgggttagaagaaggagggaggagatttgtgccagggatgaaagaaaatggctaaaagatgaatgaaagttgcatatatctctttttcttctgtaaataactcatgataaaagggaataaaatttaggttttccccacttggaagagacatggccaaacggagtgtgtgcttttcctaaaccaccgtgaaggtagcatgaaaaccaggcttgctcttcagagactaggaggctcctgttttgggcactccatctgccctgctgccgtgaaagctctcggacccaaatggcttcctgtgatccactgtggtctgcttattatattcccttcagctatgtttataactctgtcaacagccacagcgtgagtaccccaatcggataacaataacctaaaattttaaatgctcaaaagtcagaaacattttaagtgacaatatgatgctcaaaggaaatgtccattggagcattttagattcagatttttggattaggaaggtggatgtataatagaataactggtaagtataatgcaagttttcaagatccaaaaaagttcaaaattcgaaacacttctgactccaggcattttggataagggatacccaacctatattatgaagtggtagcaagaaaattacattgaaatggaacattttttcagtttatgtatccttttgtgaggtttttatttcaaaatatcacagtccaagccaaaaaatatacgtgggtgtttcagtttatgaaaactgtaagttatgtttacttttctatatgtatatatttttttacctcaataaaatgatagccccaaa

SEQ ID NO: 180 - DNA, 634 bp, Homo sapiens
gagacagataaggtctggatcagaaataaggcaatgaaggatgaaaagaaatggtttggcaagaatttgcaactgattagattaagaagagagaggcaaataagctagaaggaggaatctgaggtgaatccaagattttagactgtcaaagggctggaaaaaatgaggaagtccaaagggggatctgagatgcagttgactttagaaattagagatacccagcagaaagttaaaggtcaggactaaagctcgaagcaaaggtcaggactgcaaatatatggctgaatgtctatcatctaaaagtctgtagagaactgagtatgcaggagtgaaccttgggagggaaacatcagtgcaagtcaaatagaattaagtaagccatctataatcctatttttggccttccacaatttgatataattttatttctttgtacaatgtggtctacattttcagttatgtgtgtaagaattagttgttagtgtatgaaccgtcttcactatgctagtgagtcagctctgtgtaggacaagatgaactggttttcaatattttaatatcccttgtttcttcaaggagatcagggattatacacttttcaaattctaaataaaagaatgtgctttgtttcttaa

SEQ ID NO: 181 - DNA, 888 bp, Homo sapiens
tcgggctgggaatgcgtggcccggcttttgaggatttcctcggtccccgggcggaaatagctggaatggaggggcctctcgattggagacttactggtcaaatatttacttttgttgatcactggaaacgctacctaccacgcattgactaggaccacagtgaggagggaacgctttagatgatagagttttgtttgggggcttttttttgttttgttttattccaggaattcaggaaattgccccagaagtccgatttctgatgtgtaaaacctttttttacagaaaaccacgacttcctggaaaagtcttcaccgtaaatattaatctctttggcatgaagaggaaaacactgcagctaatttttcatgggataacaaaaatataaactgcaatttcttttattttttccctttcgatggtctttttaaacgaggagtaaagatttcaacgccaggtccattttccaaattttgtaccagaaccttgaggatgcttgtctctcgcgcgcttctccgcagaccgaaccctctccggaactcagagctgttcacccaagtcagcggaggaggcctcctgggacttgagcctgagggtggcgaagaaccctaggcagagatcatcaacttggtaccgatgagtgacgcggagcttgaacattccagcgacttgctccagggccactcccagttaagaggctgagtgttaactgcaagaggctgagtgttaactacgccgttggctccaggaaccgaaccgggtttggatacagacccagtcacaccatccatgaaaagctgtttctataatatgaaaaattgttaaatgacgctttagtaaaagccatttaaagatcttttctaataaatttttcatctttccaaacaa

SEQ ID NO: 182 - DNA, 332 bp, Homo sapiens
ggagagccaccttgtgacgccccttctgcctctcaccagcttccccctttctccccgtcctgtacggttccccctggagccagaaggaagcccggtgccagccagccttcctgaaagaccaagcccgcgccatccggcttcctccagtggacgcctgcaggacccaggaacactacatcaacactgttggcggggacctggacacagaagactcctgtttcaagaaaatacaatcatctctcaaaggctgtaatttatatgcattttaaaactctaggcattgaaaaccacccaagtgtcccaaatagaagggtaatatataatcaatcact

SEQ ID NO: 183 - DNA, 571 bp, Homo sapiens
agttgctaaagccaggccagtgagacatagagctgagacaggcaatgggagccctggattaggggaagagaagaggagagaggtccataccgctgcacagtgaggacaagctgatttcctgaggcatcgatgaggctcatggcactggcatgggagaggttggtgcaagagaccccattgattgccaagagctggtccctctctcggagtcctgctctgccagcctggctccgtcttcgaatctgagatgttgaaggagacactgtagactgaggaggaggagaaggaggaggaggaggaaaaagcccatcatcaacacacacatcaaactcaacttcagagaaattaggaagctgggaagccatgtaaaccaaaagcaggagacaccagcagaaccaacgcaggaagccagggaagtgcagaagaacagggcagggggcaacccaggggggaatcttcactgttgccagcaacacacactcccagcaggagaggaccctcagagtgagaacgcagagctggagaagtgaagaaggagcaggtggtgcccggggaagtccaggggtgtggg

SEQ ID NO: 184 - DNA, 815 bp, Homo sapiens
aggcgcacggcgggtatagtggttccgcaaccttgggatgttcggctgagcgcctgcctaacatgggagcgcctgcctaaccctcctgactggagggtcagcggcggggagtcctggccttcaatcggccatcgccacggcagaaactggggcccgggctgcgtccaggcccttccccgtccgtccacaggtctcatgggcgcccggactggggctgatgtagtttcccgacctctgacacataggatctggagattaaagctgctctgctaataattaggttcccacctctcaagatcattaggagcttcttttccaattcctctgttttgcatgcattggaaggatctggagctcaggacccactacctccccggcccactgcaagcttgaacatttgatggtggacacccctccctgactttgtattatgattcacaggctgctccccagaatactgaagaagaaactctaggagtgagacccaacaatctgtgtttaacaagtccccaggcccctggatcctcctggaatccctgatccctgttgctccctggcggagttttctagtccctcttacttgaagcatgtctttcagagcccggcaccacccaagttgggtatctgataccccatcagcctgagtctcttaaaggcctttatacacatatgtctacacatagggatttggatgatctcgggatcccacatcctcgctgtcccctgtccccccacaacatcccacaccaatacctttctgaagttttctagtccctcctttttgtttgtggtccttaaagcccagccccatgcct

SEQ ID NO: 185 - DNA, 559 bp, Homo sapiens
atttctgctctcaaacagtttaaaagatccctgtgcagaaaaagacgtatttagaacattttggttggtgatatgtaacaaacttgagatcttataggataggagaacactaggacactaattaggaactggtcccaggaacaaagaccttctggactcatctgacaagataagaatcatcaagcattcttccagcagaaagtgacaaagccctccttgagctgctcatgagaattcacaaagatcccctgctatatgaccctacttgcccaatactccacttcatcaaggtgaagtgacccaccaagagagactttcagggtctgggcattaccagataaaagatgcctattttattctggctgaaagcatgaacagaataaacaatgagctctgtgaagaatgttctatgaacccgaatcaaactcaaactcctgtgtcactccggtacgcctgatcactggatataaccacgtattggtccagaacctccctctctgttactactccctttggatttatccagtagtcttagacgtcaccagggccaagccatgca

SEQ ID NO: 186 - DNA, 478 bp, Homo sapiens
aggtcttgaactcctgacctcgtgatccgcctgcctcggcctcccaaagtgctgggattacaggtgtgagccaccgcacctggccacaagagagtacttgtacttggctgtacaacgtgtgtgcttcaccctgaattatgaagagttccctaatcaatgagatgaagtcttgctatgttgcccaggctggtcgcaaactcttattgtgacagttctctatctctctgtgaacaaggccaaggaagatttaccaaacccatccaaagctgccccgcccccacttccagctcttggaggtctcccatctggagctgggggctccagcctgctttgaagtcttccgggatcacctttcagaggagaagaattttaaagaatcctgtctgttcgacagggatttaagagagcagttaactactatagataaagaaacacttcaaggagcagctaaaccagatgctcactttaggactatgcc

SEQ ID NO: 187 - DNA, 799 bp, Homo sapiens
gcagctttcccgaaaataaaatgagaatccccaggaaacagggaaaatggaaggcgggcggctctgcaagtccgacctgggtgccccagagagctgctccgggaaagacgtttacctgctgcccagagctgggactgcagaccctgattggcgagggcttggagagtagctgagaaccttcccttcagctactgaagaccagacagggctttctgtatcacgctgcctgacgatgatgagggtgcagtgactaagagtgcagatgaaaggcccagctctccaaccaggtggatggatttgcaaggagcttctatctgggcgtggtggctcatgcctgtaatcccagcactttgggaggctggtcttgaactcctgacctcaggtgatcccccccaccttggcctcccaaagtgctgggattacagaggtggctcttttaattgactcctctccaggcatctctccttccagccacagagcctggcctgatggtcccagggccccagggccccaggtgaaggcctctctcctcccccactcaggtctgaccagctctgtttccatcctggtgtgggcacaaggtctcttgctgcagctgggccagtttgctgaccttctcagctccttctcttagactggagaggcctggaagggtgcccgagggagggtctgggctgctctcctgggctcctcccctccactccaggactctggctggagcctggtcagggtccttactgagttctcagccaagcgccagccctgtgatggcctgaggggtctggtggggaagccccaa

SEQ ID NO: 188 - DNA, 5352 bp, Homo sapiens
ccatatcttggctattgtgaaaaatgatgctataaatgtgggagtgcagatatctctacaagatcctgattttaattgttttggatatgtatctagaaataagagtgctggatcgcctggtaattctattatttttagcttttggaggaacctccatactgttttcatagttgctgtatcattgtacattctcaatgtacagtgtatagaggttccaaattccctacatcctcaccatttatcttttggttttttgaaaatcaacatcctaacaagagtgaggtaatatcattttgatattactatttgcaatcactttttgaatatgacatcaaaagcacaggaaacagaagcaaaaaataggcaagttggactatatcaaactaaaaacaaacaagaaaaacaaaaaccaagcaaacttctacacagctaaggatacaatcaacagaatgaaaaggcaatctataaaatgagagaaaatatttgcaatccatatatgtgataatggattaattttcaaaatatataagaaattcctacaatttaatagcaaaacatgcataatctgatttaaaaatgggcaaaggatttgaacagacatttcttcaaagaagatatgcagatggccaacaggtacattaaaaaatatgctcaacatctttaattatcaggggcatgcagattagtagaactttcaagtaaataaataaataactctacttcacagactaacctataaaatgctgaattttgttatgtaaaatgttacagaaataatttcctcacaattgtgttaattcgtttgtgctactattacaaaatatttactacctggtcatttataaagagcagaaattgatttttcacagttctgcaggctggaaatccaagatgaagtcacctgtagttcagtgtctgcgtctaagagagcactttgttgctgcacccgccagagggaagaaatactgtatcttctcatgaaggaaggaaccgaaggtgggaatagggaccaacctccctctttcaagcctttttgtagtgacattaattcatttatgaggattccaccatcatgacataatcatttcccaaaggatttcacctcctcccactgttgcattggggattaattttccaacacatgaattttgagggacacattcaaaccatagcaactggtatatagtaactaggtggcctgatggtcttcataataaagttatattttactttagtataaaataaaaggtcaaggcttgtaactgtcatgagactgcttcatgtatatctcccctagtgactatcacagttgactgacagctcctggggttcatctttgtatccatcactacctatagtccaaaatccccatctcacagctgttgtcagccaatgacaaagcatagtgaggtgctgttcctgctcaatatggaggaaaactttggcttgataactctccattggcctgccaaaatatgttaagtattgtgctactatctgaaactcattttacctaaccttttttattttctttcctccttcataaggtttacaagtattgtggctgaaggctgtgtctattcctgcttcctccacctcaccttgcaaaagtgtttatccaaataaatccctcacacatctaatcccattttggcaaattcagtttcagaactttgccttcactactagtctcaaggaaaatatattaatacacacacacacacacacatgcatgcacacacacacacatatgtatatatttcccaatctattataggtaaaatatactcttatcacgaataaatccaaattgtgaatgcttaaaatatactttacagaatattaaaatttaaaagcatcacaggaaaaatattaatactgttttcagaatttcagtatgtgaataatatttacattacagtttcatatgaaccttttacttctctatttagtatgccttcatgtcactgcagaggtatgaaaaggagagctctcctagttgtgaaaaaagaaacatgttttattgggagctaagtggaaggttgaacatgtgggaatatctgggcatgcactgaagacaccttttgcatctcccccatccacatagcaaagtgaatgtggtttgtgtccatttatgcaggatactctggaaaaccaaactgaagcaaggttaacatacatttttaaaagaaaactaaaggaaaacaacacatactttattacctatcaaagtaaccacttcattatattttagtggaagctattatttattatcgaattatttgcttgggcaggaggatacagggtttttccatttgggttgtatatgttcctcatgagaaaagctgaagacaaaatcttacccttctgcccaaagtcaattgaatcaacatgtttaccttgctccacggagctgctaacctactggctgggtgttgtgtggcttggcaatggagttctgcatgacaggaacaatggtttttaagtggactaatcagagctattaatgcatatgcagtgaaggcaggaactttgctacatgcagggcttatcattttgctaataacaatgcctggcacagattagcgatgtgttgaaataaaacatattctgggagatataagatagagaaagagagcagcatgtagtagaaatagatgtcgaaagatgaattaagatgatgcattaagcttgaaacgtgaggcagagaaagctgtacataagttgaaggctttgagttaaaagactataggaattagatgagtgggggctatggagaacagagagaatttagagtgtggacaagtgttctatgagcagagactgggactagccaaaacgtgatgatgggcagctagcttggaaagaatgcttacaacgtgaaaattatatatttataaaaggccattacttctgttaaagaacaatagaccccagtgaaaagaaaggaaattgaaaaatagagaaaatgtggagaaaactagaatctctatagacagcgtcaatgcagcatcaattatatgaaccacttttgagcacaaagaactattgttttgaccttggaggcaatttggtcttcattaggtttagctgtaggatagttgatgttcattattccctataacacttgtgatggcaaaaccttcacaaatttatatgatctaggtatgttttcaatccttacaacccaaataaccgatcataactctcactatgtcatttgaaaaaaaaaatgatcatcagaagtgtaattcaattagcaagtatcagtagtggagtataaattattattggttaatactaagtatgattgaaaaatcgtagtagatggaaatatgggaatctttattttggatgaataaactttatgcctaaaacatatgtttataaaaaatactttgtgaataaacccattgtctaatatttaaaagagttgaagtatgctattataagatcttccttaattgatgaaatgatgcaaagccaataatattgctccacttactgaagtatagagatgaagagaaaactttttctttattccatgttctatataagtcaagaactagagctcaagattaagatttttgttttttgttttttttccatttccctgggaacagagcaacagtctttctgggtctaaaacatccttttttcagtacaccccacagcatcctatagaaatatgttgcaatcagttgccaagtcacatcctagcttaatgtcagcaattttctttctgaaccaattttgcactcagcattaagaggaaatattgaagggagacataccttttatgtttgtaaaatttatacttcttgagataaaaaagcaactatatccattgtcgtgggatcttgagaagaaataagaaaatgaaatattatagaaaatattatattatttaattgtcctgttctaaaacactttctaagcctgcctgtttttttgccaaattaaattaatatttggatgtagacagcttttcagagtggcagtatcatagtcaatgaagatgacctgaggcacagttattgctaattggacatagaaaccaccttcactcatatataaaaattattatgtgctacactagatatttcaggagaattgataaaagaaagactgttgtattcatatgcttgtcttcctggctagaggatctgttttaattaatcagctcatggagtttggaaaatatttatagtatacatagctgagtgttcatgtaaattttgaatacattcatacatcttttttttaaaaaaagattgaacttcaaaaccattttcttacatactcagtagaagttgttatgagccaacattttttgtgagctatactattttaaacatctaaagtaaattatttgacatataaaaagacttcttcatttaaaaatatatcttttaaaaataattttacaagtgatggcatctcattttagaagaagaggcatcaatgacagcagttacagtaactcgatgctgaatatgtttttaaatacaagatgctgtgttcagcattgtacatacattatcaaattttattctgataatatgctgcatgatgtattaggctgggttctctcagacagaacctacacgtatacttatatatatatacacatgcatatacatacacatacagagagagagaaagagagagagagagagatctctacatttattagaggaattggatcatgcgattatgggggctgagaagttccaggataggttgtctgcaagctggagaaccagggaagagagtagagtagctttctccaagtcctgaagcttcagaactagggaaactgatggtataactctcagtcagaggccaatggactgagaactcagacagccactttgcaactcctggaatcccaaggccagagagcctggagtttggatgtccaaaagcaccagaaggagggtgtcttaggtccaggagagagtgagctttcctatgcatttttgttttatccatacccctgaccaattggatggtgcccacccgcattgagggtgggtgtccctctattaaatattttaactataattttaactgtgatataggcactgaattcttgttgctaataatctggtaagatccatctgaactatgaagtgagtacctggaggaactcctacattttaggctttcaaaggttacaggcttttcgtgtgtgtgtgtgtgtgtgtgtgtgtgtgtgtgcgttttgagaaaaatggaattcaaacactgtgattagaatgtatgtttacttatatagaattaatgaatgtatataataataattactgtatataattttaaaatataataaagtctctttatccatgt

SEQ ID NO: 189 - DNA, 573 bp, Homo sapiens
acagataaaataagaatcagtatggaacacacctaccactaccatcagaactgggacttctgaagccagagaagacccttccatgattcatgactgaaaggtctgtgaacggccaaaagaagattacagggagaagaaccaccatgcaccctccaccagtatcttgggcagatgggcaggagctctagggccgcttctcagtgttcctcagatggagaatcaacctcaggacaaatcaagtctggatccttctgggctgaatcctttctaggattggtacctatcatgacatggtcacattcctccactcctctatgagaggatggagtcattggacaccaacctaatgctggcaaatgacagacaggaagagccccagcagggcagatgccacagaaaccttaactgggacacagaaacatcactaacaaagacccagcagctgtcttggtgagggagacacagtctaacagtcacaaagaggcacaacggagaccctaacccccggccctctgcagacacctctgcctgccctcccagggaagctgccggccaagattatttcaggtcacc

SEQ ID NO: 190 - DNA, 3506 bp, Homo sapiens
actcacctggcggctgccacgcgcccccgcccaggatccgaggcctggggcatctgaatgaggaccctccacccacatttccacttgggagcgagctccagtcggggaaagggcctgcagcccgcctcgtccccaccctgggaccccgcgccccccagtcccccactcccgcgccgaaggcagggccgcgccctgagccgggaagtcgaggggatggaagggaaaggagccaccggtgagggtcccccgggttctgagcctcccgcgtcgggatccgtggggcgcacagagcgccacctccggccgaggcgcagctcagagcgcgatgcgggggaggaacgcgcgcggaggccgaggtctgagcgtggctagacggctcccacgccgagaaagggcgggtgcgcctgggctggatggatttcgcctccctagaccaggagggattggaccctgactacaggtccaggtgctcgtcagtgccctgccagggggtctacgcgtcctggtaccgggtccagcggggtggcgtgctgtgcagaccccgaggctagacggcctaggcccctggagcccaggagacgcttccttgggtgagcagcggagaatcccgcccggcccagccgtcacccccaaccctgtcgattaaacccctgcccccgtcgcggtcgccctccctccagacaaaggccgttaaggcgcagccccgcgggcggtctttcatccccagctaggccagctctagcatttcaaaggccgaatccggagagcgcttcgggggctctccccttcccccaaatatttggggagcgacgcctctccctccgctcccagtgggtcgcgtctacacgcgcccttccacacacctgcaggccccctccccacgtctctcccttccgttggccgcagccccacaccacgacccccgcggtcaagcatgccctctgggtggtcaggaccaagcgggaccgggacagaaccaggggagccttggaaacgtggaggagccccttaaagccaggccttgtccctccagggggaacttgcggcttgggaggggacacccactgcatggcttctggaaagagccggactcgcagggccaggacgcaggccggaccccggcctcattcttcggccagttatcccggagtggcgcgcatcctgtcttcctgggcctcggactgctcgcgcgcagagggggcccgaggacacctctgtggggttagaggactcggtaagacggtgtggaaggcaaggaggaaggtcgcgttgtattggggatggggtacccgtccctcccagcttgagggatcctgggggtcctcgccgcctctgagggcctagatggctgcttccctcggctcccctgcccggcctggagctacgggtgcgcccagctagagtttagggccacctggggacgtgcaaggggcgctggagcgaggcgggggctggggcggggcgtgggtgcttcacccgcgggggacgcagagcttaggcgaaagcggtgcaggcatctctctaatcgccggccgctattaaaaataaaaccgcgacccgtcgccatggcgaccacaacaacagcggccgcgcgagggaggcgaaaacttgtgcagccgcgcgacagccgccttctggggagactcggggcacgacgcacccggcgtgggactgggacccccctgcccggccccgccacattctccgccggatccccggaagacacaaggagacgtggacccccacaggcttttttggggggattgggcgttgaaaccgcagggctgacttaaccaagaggtcaccgacttggataaaaaacccacgcccgcgcggacccccctccccggccttcgtttccattcaaactcccagcgtcctcattgcagcccctggggagggggacggagggacgaggtgggtttcaggtgctcggcccaggaggggacggtgcgacccgggccccgccggcgggttttgcgcgcggaggctgcggcacctgccccgcccgccctgccgcgatccttgcagacgggggcggtcacatgcttctttctggccaggaatcgagtttcacttccagccgctattagtcggttcacacagttcactgcaaacatttgataatgaggctaaatatactcccgcgtcggaggaggcgtgggcgtccccgcccaggcccgggagacagaggcgctgaccccgggacagagcctggctttgtgcgggaggcagacgcgccccgcgcgccgcccccgaaacattcgcaccccatgctgaggcgcgcgtctgggagtccgtgggcgccccgaggtgagcccggggcccctggcggaagcagcggggagctcccggcgggtgcggggaggtgctggtgggaagcaaggtgcacctggcggcctgggatgtccggtcgcccccggagccggtgcatccggcctctcccggcgcgccccgacgtgcccgcgggctcataattaccgtgagtcaggtgccccaaataggccgagcgaggggggccgtcgcgcagcaggggcgggtggccggacgtctgcccgggactggttgcctcccgcccctccccaagaccctggcacccagggagggcgggaaaggccttggccattcctctgggtaggggactggagaggggaagaaactttcgccgagtccagcgctgccccctcatacccatccccacccaggctgcgtgtccggggcccctccggggcttggcaccagcaggcacgcagcgatcgccgtcgttgttatttagtagtagtagtaacggctgacatttacagcgacgtcgatggcgccaggtgccaagctctttccttgtataatttcatggacactcacgcatcaactctaagcgaagacttggagcggggctcagcaccccaggggtacctctgcaacctcgaaatgaagttgaaaatagcacaggagcccactatcactgtgtgaacattttgtgaatgaagacatgtatgaaaggatgtttggaggcttcaagaaacgaaagccgagagtctagctagaccagagccatccagcccaggagcgatggccacgtgtggccgctggacacgagagacgtggccagtccaaactgtgcagtgcggggcagtggaagccgttggagggcctcaggcaggaacacaaggtgtcgtggcagaaaggaagaaggggccgggcacggtggcccacacccgtcatcccagcactttgggagggaggccaaggcaggaggatcgcttcaatccaggagttcaagatcagcctgggcaacacagcaagaccccgtctctactaaaaccctaaaacttagccaggcttggtggcatgtgcctaaggtcccaggtcctcgggagactaaggcaggaggattgcttaagcccaagagtttgaggctgcagtgaactattatcacaccactgcactcagcctgggtgacagagtgactctgtctcaaaactaaataaataaacaataattgtgtt

SEQ ID NO: 191 - DNA, 598 bp, Homo sapiens
agcccagctacacccgggtgcaacgtggatgtatcagaaaacgacaaccccagaaaagcgggaaagcctctgagaaatgggactgaaatggaactgaacatatttttcagaacacaccatttcctagtcctgtctgagtcatcccagacctctgggagctggccagacttgaagggtagtcctcaccatccctccagtcaagacagacctgtgaaggcaacatgccttttacaaaaggaactttctctacagaataggttggtaactgacactagctatgaaaaagctgtggaatctaacaggacctgctagaacaaatactccagacttcaagtctaacatttagtaaacagatttcttccctttctttaaatgtaatgatgcaacaatgtggaaccaagtgaaactggctttgtgagtcaccttcagaagcggcgaaaggtggcttctcatttccaaagttcacagttcaacatggcctgcataagtaatacaaactgactgccactaatctcaccagaaatcacctctgtcaagaactgtgtgaggagagaggggacagagaaggaaagaaatacgtaccgacttgctctagtcg

SEQ ID NO: 192 - DNA, 514 bp, Homo sapiens
gaaggctgaggtgtgcgccttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgaataactgggagatgaaacaggaagctctatgacacacttgatcgaatatgacagacactgaaaatcacgactcatccccctccagcacctctacctgttgcccgccgatcacagccggaatgcagctgaaagattccctggggcctggttccaactgcccactgtggactctgaggcctctgcatttgcgggtggtctgcctgtgatattttggtcatgggctggtctggtcggtttcccatttgtctggccagtctctgtgtgtcttaatcccttgtccttcattaaaagcaaaactaaagaaaacagaa

SEQ ID NO: 193 - DNA, 8230 bp, Homo sapiens
agatcacaccactgcactccagcctggtgagagagggagactgcattctcaaaaaaaaaaaaaaaaaaaaaaaaaaaaaaaaaaaagaatatatatgaattcttactgatagtattaaatgattatctctttacattcacagtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgtggtttccagcattcctcacccagtccagggacactgtgggtgtgcccagcttaagtccagtaactggaaatacaagcccaagttctggagagtttgagctgcagagatatatatgggaacactttgaatcttgactcattggccataaccagcagagtggaaaatacaagaagagaaaaaaacattgaactgcgattttataacatcctttactaggcagagagaagaggaaacaccaggaaagaaaactgtattacgatgtgaaaacttaatgttgagaaattcaggcatcttggggttagtgaggagaagttttaggggcttagattcttctaaacacatgtacagaaatgcatatttcatctgatatcaaatggcatttatagtgctaatctttacctcaagacttcacatcttttggtgattgcatcttttaggtttatagcagctaagtttgcatgaaaacaccagggctgtttcatttcagtcaagaattaatgttcattgattgtgcttctgcatttcatgtaactattgtagaatttgttttagttttatgagggaataattgttccaacttctatataactcaggaatttactctcaaacaacactgtcaattagttacttatctctctggaaatgatctgggaacatggagaggaaagggaggaaggggcaaaatctgaccacttaaatctaagcatattagatcattttatgctagaaagtcctgaatgatgtgactttcgttcttgtaaaacacctctttccatagattcatggcccaaacagtatataaagagtggggaaggaactgcatttgcaaatagttcaaatcattgctccatcttaactacgcagttcacaaagtgtgaagaaatgtgatcatctcaaaaaagataatggggaaaaaatatgttttgttctgtgactttaaagtcttgcaatattttacataaatgataatgggtgctttaataagaactcttgatacttttgttattgtattcaatatatgcatataatacaacaggatgatattgttttggatttggaaatgtattctttcttatgcaatcttatgcagtcatactgcttgaatatcattacctgaatttatctttcttttttttgttgttgttttacactctacttatttggtgcctgtcagtcttttgtcgtcagtttatattctactaaactcaaaaagacaatctcataccttttgtaattgtaggcattctttactagatttttaaatacacttcaaaaattcaagtactttgatttcatgccatcaagtagctgaatctatccccccgtctctttttaaatttaagtgagtagttcaatttctgtcactttctactttgtgaattctaaatcttttaaaaccatcttgccatttttcgtgcacttacccttacagaaaactctgtgaaacactacttatctctacttttatgtttttaactccttttttatattactattccctctgctttctaaatgcacatattaatttgttctttttattctctgtagctcttctcagtgtatgaattcagtttcccatcagtctccatacaattaaaaaaaagttgagtattctgttattttaataagatatctagtgcccatattctaattctgccccttatttttaatataattttattgttgatttaaaatgacaacagtttcaattcccagaaagtgaaaggaaacaaaggaataatattataggcttaatttttatcagtgaacttgtaggtgaagaaaagatttggggaaggaaatgaacatattatattgcaaaatagtaaggaacaatcagatgtgttttctagtctctggaaaagcatgtttcaagaaattcaatgaaaagttcatcatgcttgcttagattgttgagaagcaaaaacactgatgaacatttggaagcaatgagaatgtaattctaatcatactcttttaataatgttgcaaaactctccaaacactactctgtgtggatgtctttcagaatatgatgaatactagtagtcttattctgcccttttctctctatcacaatatatacattctatattgcatacacatattttccaaatattacatataatttcatgtaatttatagacctattaaggcccaaccattttcttggataggggattctttagaagtccagcttaaataaagcccgtatagaaagtttttttaaaatttatacataatcacctaaagtaaccttatctactgaactcttagtacatgctactggaaccttttatcatgtttcttcctggcttgcattacaacactgttgacatatctcagccttacttctaggcttctttgagagcatgactcatgtttgtattcctcactgaggttgaatgaataagagaaactacagtagtaggaaaaaacagtacatgtacatatcaatgaatatgaaagggtcaaatggatctattatagtaagcacaaaatcaactgacaccagcaaagtaaacccaaaatttttaatggtattttaatagatcaagaggagcaagcagatttttgagacagttgtctcctactttctctatcacagggagtaattttaaaagaaaaatggagggtaagtttctttaagagaaaattgtagtttaaaacaggtcatgggataattagaaataatttaatttctttagaggattttaatctttcaactgcttgcaattagatcctaaggcaataaaagaataaggagatttggaaaaccattgtctgtaatctctgaagaaaagtggacattaggggagtcagttgaaaagcaaagctatcaccattttctaaagaggaaaaaggtgaacctcacaaactatagaccaaaaaaataggacatcgagagaaagaatatgaagctagcataggttcacaaagaatgagtcaaatcaaacaacatgcattttttatttataaagcatgacttgttcattgtcaattcatgttagcttaatcattaggcattaatgccatcactgcaatgcatatgtcagcaataaataatcaaagaccaggcttccatcattctgtttaatatcttcaagtaatgcttaagtttgcaaatgctcttttaacacattctccatatgcagcctgcccagcactgcacacaatagacctgttacttccccctcacgagcactcctaatatttcatgtgctcatccaattgacttctcccactggtgcctcatattgaatttgtagaatcacacctgctcctttttcaaaactcttctgagttttttcttaaataattcactgaccccaaagttgtcagatatttgaagactactcgcacaattttaatattataaatgtataatgtaaatgtaattaagatttgtataatgtacgatgtactttggtaaataaaagtatgctgtgaataaatacgtatgatacaattcaaaattttacataaatatgtgataaaatttagctcatattctttttttttttctttgagacggagtctcactctgttgcacccaggctagagtgcagcagcatgatctcagctcactgcaacctctacctcctgggttcaaacaattctcctgcctcagcctcctgagtagctgggattacaggtgcccgccaccatgcccagctaatttttttctatttttgttgttgttgttgtttttagtagagacggggtttcaccatgttggtcaggctggtcttgaactcctgacctcagataatccacctgcctcggcctcccaaagttctgggattacagacgtgaaccacggtgcccggcctagttcatgttctttaaggacaattatgaatatttttatgcactgttaattttcattaagatattgatcaattaatagctatatatgttctataaattaatcctatctagtttcaatcttaaattgtttgcatataccaatctagtttattgtttgcatatattttatagtgtagagattaggcattttaataaaattttaaaatttccaggacatactgttaatgactatgcttcctactataggccataattaatttttttctattgtcaacaatattttggtagggatgatcaggaaataaggaaatgtttccttcatttgttaacaataggtgtttggggattttaaaatgaaaattgaagaagtaaaagacaccatatatttagtttgtttgatttcgtggcttcaagagttcaataatttattgaaatattttacagaccaaagaacaacagatatattacgtttataagcccccacatattttaaaggataatggtttatatatgaaaattccctgaacctacacttcatcaggaaaagctaaataaaagaagtttacatttcctaggactaatggagatttatttcccagtcctcttctctggagacaaatgtaggtctctcttgaaaagcagaaagttttgcatatgaggtatgatttagtgggctagaaacatcttttccaccctccccaaaatgtttcactatgttttatcatactatctgataattttgcactaaagttttctttctgtgttaagaaaatgcaaatatctctgaatgggtctctttgctttagtcatactcatatggctactactgaacaaaatatgttcattacaggatgaagggaatgttgccagccagcaaatccctagagtttgcactacaccaaacgttgcttagcaatttccacgattttctcagtctaatttgcaagaatcaaggagatgtttgtgtatgctacatgaagttgtaaaattggtatttattgtatgtttctatatcgaaagctttacaaacaaaggaaatggaaagttaacaggtggatatgatagtgtggcactactttagctggatggtaagggagagcttctcttaggaagtgttttaggccaggacttgaataatgaacagtatctagttgtacaaaaatctggaggaaagacttttcaggcccaggagaaatgaaaattcttttcatgcatacaagaatgaaagtgaaaattacctactctatgtcctgaagtgggaagttggcttgccagagagtaggtaattttcactttgattctttcatgccttcagttatactacttcttaggttagttcataagggtttccacaatttggttcccacttaaaatttaaaacttccctaacccattcccaccatatattgtgctaatccatgcatatgtgactttgcgtatgctgttttcattgtttaatattcttctcatgcattcgttctttcctgataacgaactcatctttgaaactccccttcaagcatcctctactttaggaggccgcttctcactgtctcctgcctaccacccattgaattgttcaatttttaagctgccattgtcttgtgcagttgacacatttctttgcaattactgatttacatgtctgcttttatcactggtgaggttctttaggacagagacattattaattcatctctgggcacatatgttccaacatattagaagtactacagagtgctattactatgtagtatgtagtattagtagtagttactcacaaatcatttttaaataagtgattataatatctttttgttattatgatttaacacaagatggaatttattttcagaagtttccatgatatatttgttctatttaaaatccaatagccattagaatattaccattatttaatgtaaaacaataaaatattaaatatgatcgttcatatttaatgcaaaccgaactcatggaaatattgtgtaaagatcaagtaatttttgacatacaattttaaactcaacttttcatatagcataccttatgatatattttcagcctacttttaaatatgttggcattgaaagccagttactaattcgctgaattcatgatttctttttaagttatagaagtggaattatgtttgagatattcattgcattacatttaccagaacttgagttcttaacatggaacctgagagtttctccaattcttaagtccctgggagaaatagattagctggatgaggaactgagaggaaaaatggtcagagatgtagcaagagttgggaagaaggaacaatgatttgctttcaaggagattttttcattggtctgttttcagtgacaaacccactgcgataatacatgtaaagtgaaaacattcaggaagttcccttagaaacctcttttctggcagttcctaattctacaacattgtataagtgaaataccatagttactgtcatagtaaattgagccaagagaaacaagggagcaggagaagaaaagaattaaagagagttttgtctttcagtcttcactctgtttcttcttgcttttaccagtcattcaggtttatataatttctttagagaggcttctactatgcaggtcttccttaaagtcattggtattacctggcatgatatgtgagcctttaatatcagtccctttatctctttatttttaaagtttatatcagtacagagtcctggattcttaattaatttaataggttagactttatgctaatattcttcattttgatgctcaaattttccaaaatttggccagcagggttccttaaagctgggtaccttgccctttcaacatgtccctctgattctttatttttatttacttatttatttatttatttatttatttatttatttatttatttagagactgagtcttgctctgtctcccagcctggagtgcaatggcacaatcttggctcactgcaacctctatctcccaggttcaagcaattctcctccctcagcctcccgagcaactgggactacaggcatgtgcaaccatgcctggctaattttttttgtatttttagtagagacaggctttcaccatgttggtcaggctggcctcgatctcctgacctcaaatgatccatcgcctcggcctcccaaagtgctgggattacaggcgtgagctgccacacccagccgtccctctcattctttaagtacttccatgttttctaaggtacaagatgttccatattattttgttatttgtcttccccagctctgaaatctgcctttccttcaaggagccttggttctttctagtgacaaattatatttagaaagaagatctgggtatttgacttgtatattgctattaattggccattgtttctagtctctttcagtagacagagctaagaaatgtaaaaggaaatatttgaatgtatgtatatgtgatatattaagtacatttaaacatattaaattcatgagttcatactaatactttcaataagccacaattcccttttcatgttttcgaaggaaaaatatccattgtctatatacagtggacatagatagtaataatactgatcttgaaaagagcagtcttaaatagatcccattaatagttaaagataacatatcttagaattctagatattagagagattatctagagctgtaatctagatattttatagatctttgctgtgctgttttgaatttgtgttggagtagaacaatcagatgacaaaagctcatcccacatggaaaaatcaaagcattcattacagagagaattttgaaataaatgcatatataaaaaatatatatgcatatataatgcatatgtatatgcatataaaatatatatatataaaatgagggttataaacaatgaaggaaatagtgatactatctatgtgggaacaatactagtatcctccctttggatgaatacagtagctacagatgcaattctggggactctgtttagcaatagcttaactattgcttggctacaagcatggataacttgttcaaagataatgaggagttgtaaatatttaaataaacaggatttgcaacataaaaa

SEQ ID NO: 194 - DNA, 2935 bp, Homo sapiens
gcggccgggagggaccgagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccgggttagtgtgcctgacaacactgaagaaaaattgtgacattttccttccccagaattacttcgttttatacatttcacttctcttctgaaatcacagcaatgccagtttgcgccttttggtctgaggaacgcaggccctggccactaccaggaaaaagtacacaaggcttgcttgtagagatggagttacatggagggacagaaggtcactggtcagtgattttaggtttttatacttctgaaaacaggtaattacagattctgatcagtttatcattttctttagtcttttattttctgctgaatgctctcaagggaacggatccatacctgtttatcaggctcacctggaagagccaagtcatccactcaggtcttcctctggacctgcataatttcctcatttactagattgggtttcttttatgtgtgggcttttaatgcttggtatctctggtcttcctaatatgtaatgcttagcataataattttagccattattcatttttgtagtaggcttcactagcttcctgcttctcaaatcccttgaaaagatgagatttttttttcgtggagttcacgtctagtaagttggtcttgattttttttttctttcagaaccttctggatttcagctttggcaagcttcctctgtttctgagacacctccatcacctgggttacaatcccatccatgattttccccatctccaggcatttttcatggaaagctcctcatgctttttaattccagtttatccatttgtgtggctttaacctccacatccaggtctttctggctaaactgcagtatatccacaatggggccaatggacacataagggaggccctatcacaggaacacgaacacccggagtcgctagaaatcagattccaccggctttgcttcaggccgacttcctaaggaaggcatggtagcatcacagatgctgtttgtctcagtttcctgagaagccagtttcttagagctgtcattcaagagtgggtcaaatttgagatataaaaacctttctcaaggtagactctttggcccctatgcctagtatgtcagctgggcctctgaagctctcctctttgaggtcctggcaggctctggcccctgttgagaaggggaagcagtcatgtgaactcatgtgctggaagaatccactctaccccttccctggcttctctgctgcaatttttgtctttaaacgtattttcaggtgattccagtttgcatacataattgagaaatataagatttggtccccagtagagagccaggtgaacttaagaaggagtccatctaagaaaattgcacaattatctagtttcacttgggtttagcttttatggcttacttgatttagtaatcaaatgattttcaaatgattttgatcaggtgactcttcgtaaactagagaatgaacttgagagccgaattagcacagtttaaaaataatcatttagtttttgttctctattgtgtaaattattgaggtttgactgtcttggctaaactaaggctcatctaatatctttatttttgatatcctaatttcttgccaattaattgaaggtaacatactagcagaccagataactacttatgcaaacctcagataaccactaatttaaacaaaattaaatcctttgccttccccagatcctttgcacatggcctgctatcaacaatcctctacaatgattctcagcatcacctagggagcttatgtaaaatctcaaattcctgggccctatccccagagtttcttatcaatttccttgatggagaactatcaaagcagtcaaagctatcaaaataaaaaagaattctgattgggtgcagtggctcacacctgtcattccagcactttgagaggccaaggtgggcagatcacatgaggccaggagttcaagaccagcctggccaacatggcagaaaccccatctctactaaaaataccaaaattagccgggcatggtggaacacacctgcaatcccagctactcgggaggctgaggcaagagaatcgcttgaacctgggaggcagaagttgcagtgaaacaagttggtgccaatgcattccagcctggatgatggagcgagactctgtctcaag

SEQ ID NO: 195 - DNA, 73 bp, Homo sapiens
ctctgcctcccgtgcctactgagctgaaacacagttggtttgtgtacactggctcagttcagcaggaacaggg

SEQ ID NO: 196 - DNA, 717 bp, Homo sapiens
aacccaaagggctaagtcttctttcttaatttttaaaacaagcatgtgttttgttctttacatgaatcgtcggttctcccagtgtgatcacgacactgtcccatgctgattccatgcacggtgcaactctttcccaagagagattctaactcaggacacctgggagaggacccgagctgcatttctcacagctaccagatgctgcacgctggcaaggttttgggatgcactgaatccagttcagcatgtttactgagcatataccacatagagagcccagatgataaaaaaatgagaagatgggttgtacctgcccttgaggagctaacaagcttgtaaactgaggcccagaaaggttcagccatctgcctgaggtcacacagccacagtttggacctgagccatcaatcatccaccaaaagcctgcattgaccctagaagattccattgcatgttgtcaaggcgcttagtttctctcttgtgtctccccaaaacataaacctggaatggaagagagccacttactctatagatgcttttagctcagaacgcttcaagcttttggagtatgagaaataataacaatcattccattctttcctggagtttgatctcagctgttggtgatattgttgggactgatttgctatctataaagccaaatttgagaaaagacaggttaaaaataaacagggaggatgatggtagtaaaaataa

SEQ ID NO: 197 - DNA, 1365 bp, Homo sapiens
aagagacagcgccgccggccgtggggagcggacgcagtgatttgctccccctcgtgcagcaacccccacacccagcaccaggcccccagaactctccttccagctgaactccctgggaacaagtcagttgggctgatcactgaactcacatttctggacctgaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataatataatttaa

SEQ ID NO: 198 - DNA, 136 bp, Homo sapiens
cctgtattcgaaagtgatcgtgggctgcctttgccctggtcattgatagtgcagggagaggaatcaatgaaagcgcttccccgtgtttgaagggtccactcctatcccttccaaactctggagctttcgtacatgc

SEQ ID NO: 199 - DNA, 583 bp, Homo sapiens
ggaagccatctcggtctctttctggtcttcagtgcacagtggccaggacagcctcccccacttcaccgaatcacatttcttcagcagtttccaacagtgaaatcatttctaggacaatggctgctaacacgtgtcagctgaagcactgcagatcgagtcatccaactcaagcttcttcctcttattggaagggataaaccaggtggaagggctcaaatgcgctgcttctggaagcatcctgggtccccctctgctctgctacctttggcttgcacctgagcccagggcagggacaggagcagatcaggagaccccgagagagtgtgagccaggagccaagaccctgcggcacttacctggagccaggaggaaagcccagggacccaaacttctgcaggcggcacttacctggagccaggaggaaagcccagggacccaaacttctgcagactgcgcaggacgccactgacctcgggagcccaggaggacgcgcttcccagaagccacagctgctgagatcgacactggcccagagggttaagagcttggaccttggcttcaggggcacctttgcccagagaaa

SEQ ID NO: 200 - DNA, 2517 bp, Homo sapiens
ttaccttgggcagtatggccattttcatgatattgattcttcctacccatgagcatggaatgttcttccatttgtttgtatactcttttatttcgttgagcagtggtttgtagttctccttgaagaggcccttcacgtcccttgtaagttggaatcctaggtattttattctctttgaagcaattgtgaatgggagttcactcatgatttggctctcagtttgtgttattggtgtataagaatgcttgtgatttttgtgcattgattttgtatcctgagactttgctaaagttgctgaaggagattttgggctgagacaatggggttttctagatatacaatcatgtcatctgcaaacagggacaatttgatttccttttatcctaattgaataccctaagtatttaggaatcttctccatttctttttatcaggtcaaagtacataagtacatattttagggtcttctgttcttgagggttttttttttgtgttttttgttttttcttttcctattggaggtttgacacctatatttttctctgacattttggaaatttgcttcccaaagtcaaaaacataatgcctaacttttcccgatttggccaacatcaactttaagattctgtggttatctttttaccaagagatttgtcagttttactgccccagtcatttcctttttactgattagaattaggcctttgtgtagctgttcacctaattacttcctctaccttgtgaaaaagagcagggacgctaacatttgctgggtacctactacatgccaaaagtacttaatcgtatgcagtaatgtcatttaattttcaaaacaactctccaaaggaagtgtcactctccttgtttgatttcttgcttcccaaatggaaggtcctttgtattaatagtatctgtcaaatttcatacaatacttaaatatgttcttgatacgtacttcaatataaccaacagaatgaggcagtattcgataaagtaaaaaataagatgaatatttctagtgatttataagttacttgaggaaatcatgctgtttattcttttcctttttaggtattctttgtgaatttgctatttgtgtgtgaatatatctgttgcgataatgaataaccatatgaaatggataattgtatgaaaattcatttgtaattcaatagattgccagggattttaggttggttatgaaggtttgttttttttttttttttcttttggagagtggggagattggcatacagtttcaaattgtttatgtggaagttggaagtgtgactaagctcgaagaaaggaagagagggacaaagaaagggaggaggtacccctaagtgggaacctaccaggacattcaaagcaagagcagtaagttctgaatgttctgggacaacctgggtgatatgcatggatatgggctgtggaggctgagcattttaatgataacttagggaaacgaggcatggccatggtgtaaaactctcaaatcccaagccctaatccaaccttaaaatccgagtcttctaaagggctgttttaaccatgaaaggaccataagaaaggcaattcacagaaaatgaagccatgtggccaagaaatataagaaaaacagtaaaagcccttaatctcaatagcaatagagtggatgcaaatgaatataatgagttgccatgtcgttcttactggattggaaaagaaattagaatgtctaaataacatgtatcatccaggatgtggggaaatgggagctcttgtaccctgcaggcaggcatttaaattggtgcaaccgctttggattgctgctttgtagtatctggtgcaactgaagatgaacatgccctgtgacacagcaaccgcacttctaggtcaataccctaattatattcttactgtggttcacaagaaggtatgtaagaggtcattgcctgagcactgtttagaataggggcaaactggaaatcctctaaatgtctgtcaatgaaggaatagataaattgtaatatgttcatataaaatgctgcataaataagtgaaatttataaatatactaacgaatgaatcttgaaaacagagttgggagataaaagcaagctgttgaagaacatggtcagtatcctctcacttatgtaagttaaaaactccaaagaacattatctatattggtaatggcatagacatgtgtggtaaaatataaaaatattaactaaaagttctatacgcttcaggatattgttagtataataaggcaggaagtggatagcattggggtgagacagtggtttggtggttatgtttggttactttagttatgttagtaacattttttttttaaagaaggatctggaataattatggtaaaataatagtatttgctaagactagatgattggtgtactggatttcatccgctattttctaagtttgttatgaacgcttaaaatatatatgtatgtagtaaaattaatgtaaatttgtacaaataaaaataaatggcatgtgatatatggc

SEQ ID NO: 201 - DNA, 546 bp, Homo sapiens
gtctgcctggagggaacccagagtggcagggaaagacctgaactaggggctggccccagatcttgattcgacttttgtaaaatgcagagatgccactgctttctggggctaaggtcttctttttcagggtcggctgaatgctaggaagtaaacctggtgggtagggggagctgtgcagtgggagtagccagccaggttgttgggggcctgggcccagaggggcaactctctaaggagatgcagttgggagctctgagctggaacctgcagaagtcattggctccagccagagccagtcagagtcatctcaagccgagcccagtccaggcatctacagacaaatttggaatctctatatctgtatattccacaaggagggatactatagagaggaaagagctcctccattaaggtcctgactttgcccgaactcactgtgtgactttgggcaacttacttcagctttctgcaccgcgttttcgcttctggaaggtgaggagagggctttctgtctgcctggctgacaccattgttgtgagaatcaaa

SEQ ID NO: 202 - DNA, 2302 bp, Homo sapiens
gcagaagtgccgagtcccggccgggggcagcctcgccgccgctcagctcgggaatccctgccccccaccagcacctcagtgggggatactgcaagttcaagcaccagcctcacagtaacagccggcacacagcacttaggctgcctggtgttccagaagcttctgcaggggctctatgctgcactcaaggcatccctaagaggagagcattttgctgtccccactttacggagaaggaacgtgggctcagggtggtttaaggcgtgaatgaatgaaggagcaagcagtaagccccgacagcaaggccaccacagccctcgccccacagggacgcctgagcaaggacccaagcaggggacaagcaggctcaccccgcccttgcggggctgaccacgaggccccgtccggtggaacacgccatgacgcttcaggaggctcatgtagctggcgccgtatgggacagcgggggagagagaaaatgcacagcccagggaatgtggagacaggcccagcgccaggcatgggggccggaaggagcagccggggagcagggggcagggcctggagtcccgccttgcagatctgaacctgccccagccccaggactctgagtgcagcaagaggggagccgggctggagagtggggagcacggagactgtggcctggatggtgccagagcaaacaggagagaggctgcccaacgcagaggctgcagcacagaccagagggtcccggggctgactgggtgggggcagctcccagcgagaggcccctgggatttgggtaagtagaggcacatgcagactctggccacagggcacctcgcgcacgaggggagttcaccacacaagctgagcggagggcggacgcaggagagcagcggtttctcggaagccaagggcggtcatggagccccacgccacagcgcttcccacggggccacaccatccggtctgcggagggggctgcattgccgggaaggaccatctgattctggattccagcctcaccctgggccaccgctgagtgtcccaagtggccccttagcccccagggccaggcggcatcccaatcccctagggatgtctgtgctcagaatgtggcacacacgccccggcagggccatcctcctcctcctgcacccgccacagccgtggattcggggtctctatcgtgggcagaaattcacacagtcaaggtgagggtcccaggagcagctgtgaccaggccccggctgccagggagagggggtcttcagccgacggggcagacaccctgagatggacccttgtccaggggagggccctgccacccacaattccttggcattcctgcaccagcaggacgggctgagggaggcgcctcaccagtgccagcgcccagcatcactgtgccccggtggagggggaggcccttccgagcctgggcctgggtgtggatgagggcaggtctctcacctctctgacctcagcttcctcaactgggaaggggggccacagcacccccttaggggtgatgaggaagtgggagctcagggaggaccccgggcagggctgcctcctcacctctcttcggcctttggacactggagctcagaggaccaagtgaatgaatgaatgactcgatcaatcaactgatccatgaatccatggacccctgaacagctggacagctgggctgtgggcaggacaggggactctggctgaagccgcgttcatatgtgttcagctttaggcctccactgtgcccggaccagcggcccactcagtgagtcgagtgtgcacctggcacccctctttctggaaatccacgaacaatgggctcccagcagaggactgaggctgagcaggccacttccctggagctgaccccacagctgtcctgctcctccttcgccttctgccatgactgtaagctttctgagggctgaccagaagcccagcagatgccagcaccatgcttcctatacagcctgcagaaccgtgagccagctaaacctctcctcataaatcaccgagccccaggtttatctttacagcaatgcaagacctgactaatacagcaccagctccccaaaataaaaagaaatattcaaacaaataagcgcacagaagtgttcccagcagcactattcacagcagccaaaaggcggaggagccacaggcttgtcagctgatgacagataaagaaagcatggcctgtcatcccagcactttgggaggccgaggtgggtggatcacctgaggttgggagttcaagaccagcctggccaacatggtgaaacccagtctctactaaaaa

SEQ ID NO: 203 - DNA, 424 bp, Homo sapiens
tcctgggtcaagctgagtatctccacgtttaggtgcacaaatactattttgtgaagatcttaaatttgtggtataagaacttgaaggaaatagaactgatttgttacttctaaaagatttgtaagactccagggcctcccagccgtgaataatctgatggttcctgaaatgactggggaagcagacgcttcgtatggcagttgaagagtgtgtgtctatgtgcatttaaaaccttctttctgtacttacacattcacacgggaagacaggctcattcttgtgcacacttgagagttttacaactgatgaaaattaatttaagaatcagatggagcaacttgacaccagtgggctcaggagcccggggagaaaaatacatcactaatggccagttttccatatggtctgcacgggtaaagaaagt

SEQ ID NO: 204 - DNA, 3691 bp, Homo sapiens
ggaattgggggttactatcttggaatctaggggcactccaggctctgggctcagacggctggcttctgcctacccgagccttaacctttcaaggaccagaaggattccagagctcttgccctaggtcctggggcagcgatgactcactgcagcaccccctcccacttcgccaagctgccgtctccgcccacccccaaacaatctcgacagcgcatttcgggagccacggctccgggcgctttgctgggggctaaaggggtttatccctttccttgaatcccagcaggctagaactaccccctcccagtcttcaggcttgccacgctctccacccgatccttccattgaaaggcagagaaggaaggatgtgcttgggaactttaagacccacgaacgacagcgcactgatggagcagcccagtgtctggggcaaagtcctcgaggttcattcattcaggaagcctctgaccagcctttaccatgcgctgagtgagaagctgaggataaggaaagagcaagacccccaagaaaccctgatgtctggctgaaagccgaagcatgacgcaactttgctatatttctctccaacaaggatttgtatattttcgctttctcctcaagtaacacctggacctgctcctttcccttcaaacgctgagggctcagtctccaagttcctttatgaaacagggtgtaccatcagagacgcaggtaagaaacctgaactgcgtggcctcacataaaccccaccacacctctgtcctgggctccttccccgcaacaggtgtaaagacaaaaggctcattgtcctttggagcctataggataaacagaaagaacatgtccttgccggttaatctgccggtgataaagagtattgttttatctcctgccatctccacgttccaagagatgaattctattgtgacacaaagtctgctttgtccttccaacccactgagatgtttaaattggcctctcatatattccttggttgtcacaataagagcaatgagttgttataatgtgttgagaggatctttcccccatgacaaggagaccatcatctacagagatgctatgatgctgagaaataatgtgcttctcttctgctctaattttttttaattaagacttttattttttgagcagttataggtttagagaaaaattgaagggaaagtacagagagttcccatcttctctcacccctttcatctctgtttccatacgtttgctacaaatgatgagccaacagccatacgttattaactaaagttcacagtttacattagggttcactctttgcttgtacattctatgggttttgtcaaatatatgataacctgtatcctccattatagtacaatacagaagaatctcactgccctaaaaatctcctgtgttcctcctgtgcatccctccctcccatcccctggggaaccactgatctttttgctggctccagttttacctttttcagaatgtgaggtagttgggagtcatacagtatatgtgtatatatatatgtgtatatatatgtgtatatacatatatatatacacatatatatacatatatatatacacatatatatacatatatatatatataaaaaatagcctttttagatggatgtctttcccatagcaatatgcattgaactttcctccatgactttgtgtggctcaatagttcatttatttttgttgctgaatagcttctgcttaattttcaaagtgtttaatgtaagaaagcggtatagtccaggcgcagtggctcaacacctgtagtcccagcactctgggaggcggaggcggtggatcacttgagcccaggagtttgagaccagcctgggtaacatgataaaaccttgtctccataaaaaatacaaaaattagctggaaatggtagtgtgcgcttgtagtcccagctactcaggaggctgtggtgggaggattgcttaagcccaggagctagagcctatagtgagccatgattgtgccaccgcactccagcatgggtgacagagtgagatcctgtctcagaaaaaaaaaaaaaacaaaaaaaaaaaaacccagaaacaacaacaacaaaacggcagtatatttgtccccaccctcatctcttcctttatgggtatttccctaattgtgagagattacctgtgttttaaaaggtggcttactgtatgcattgagaaaattaaatgacatttcagaccagttccaagtaccttttgcaaagctagagaaataaaagtgaattctagtatctcaatcacagagtaaaactagagaaggtctgttgggcttcaggcaacattggtgttcttggcaattttacccagaagaatttatattcctataattagtatttcctccaaaattaatgatcgcctgattgatttatttctttcctagcagcactggaggtcccacttacctagttagtaataacatttgctcttaatacatgagtcagttttcttttttccttttttctttttctttttttttttacatttccaaaacagaataccctgcaggaagaatgggatggcagtggaggagctctcactcacatatcatgtaatgtgggaggcagggctatgcgatagtcataaagggtgcaggcttcagaatcaaaggagtgaggttggtgtccctgcttacgccctactagctgagtgtccttcaggtcatttctcctctctcagactcagtggactgtttcctaaagcacagctcataacaggctgtacgtggtaagaccgtcgggaagatggaaggagatcagtcatccctagagagcattaagcacagtctcagccacaaaacacttcctcaaacatgatgcaagccacacagggcatttggcctgcgtataaaggacatactgaggacagtgtagatgctcaagaaattagtcctgaatgatcaaggggggaaagagagggttaatcttatcatatgtgggctctcagagaacacagagctatagaaggaagctgacttaataagggtcaagcatgataggggagattaggaaccgtgtgcaatctaatggaaccacagataacaccttctagtactttttccctttggccctgcccctgctgagacagggccactgctaataactcacattcttctcttctctcctctcaaaaagcccatttcctgagcaagtatatgctttggtaaggtcattagcggtcaacatggttcccaagtttagtgaatactttcagataaaactgaagggtacaaaatcactctttcctctctccctctccttgtcctacctctcacaataaaacgacttatctactaattacaaagacctcaatagtggaagaaatccatatcctacataacatggagagctagctatatacccttggcatcagtttttatcctacttttactttttactgactttcatttactgaacaaagcctcctttgccaaaggcagggtaaataaactcagtcacatcctgtcttccttacatctttgtttatccataaactgtcgaagatacagatgaaaatccactaaagcatgcttgaagcggttacacgaaggccaaataagatgggaatggaaatgcctgatgttaagggaagatactacctaaaatgatactgagctggccagtgtaatgacatgaaaacaaaacaaaaaaa

SEQ ID NO: 205 - DNA, 560 bp, Homo sapiens
gaattttgctcttaactgccatagaatgagtatgtgcatgcatatgcgtgtggaagacagacttttatcattgattttttttaaataggaaaactaaacaacaactaaaaactttctttctttttttttttgagacggagtctggctctgtctcccaggctggagtgcagtggcgcgatctcggctcactgcaagctccgcctcccagattcacgccattctcctgcctcagcctcccgagcagctgggactacaggcacccgccaccacacccggctacttttttgtatttttagtagaaatggggtttcaccgggttagccaggatggtctcgatccctgacctggtgatccacccgcctcggcctcccaaggtactgggattacaggcgtgagccaccgcgcccggtcctaaaaactttcttagtgagaaagagataaatggaggaggaaagcaagataaagaggtttgggatcttttctgggattttgctgaacagggcgtggtgacactggaggagtcagcagattcggtagcagaagaaaggcaagaagaaaga

SEQ ID NO: 206 - DNA, 419 bp, Homo sapiens
tcagggcccgagggatgcatcactgagggagccacgactggtctctgggcctgacggtaaaccagggctgttaagtgttgcccaggtggccagcaagacaaataagtgcctcaagctaaggtaaatgaggaccagagagatgaagctcctggctcaagtggctcctatcccatgattccagctctccagcaattctcccccactcccacctctattcgattctggggccgaaagccagcaaggcagagccactgggaccttccctgcctgagaagcgcatagaagtaagaccctcgaacaggtccaagctgggcccatcacagaaaacagatgtccactgagggtccagcatcgggatttagggctattttttacaatgttactgaatgaataaattcccccaagacttacattttaaa

SEQ ID NO: 207 - DNA, 780 bp, Homo sapiens
agaggcctctcttctgatatccttcttaacttaatctacactggctgtgggttccctttatttttttttctggaatcctagaggatgcacggatacaattcacccaatgtgtccatctctcctctcctaagtgtcagtctataggtttctgacctctagaggaatccctgaagctgtacagctatactttaccggttacgtctagactataaaggaccacagtgttccacctcaggcaggttcagcgacctgcaagtagtgatacagctgggaaagttacagagcctgcgggaagctccggctgcaacttcagttctgaccagaggttctgtgaaccttcaggatttagcaggtttccaggaccggtgggtgaatctacccggggaagttttggtggacaagagctgctcgccagctgtcggagtgggagaggccagcgtgctggctccatccacttcacctaacacctctgaagtgtctgccctgcagtgtggcaagcgtggtgctgagcgcttctaaatccgtcgctttaaagatcattagtacaatgttgtgagagggttagctccatttgaaaattattttcccgtgattacaaaagaagcgatgctgactgcagaagttagaactgggagaagactcatcacccccatgatcatgtcaacaactgccctccttcagttttggtttgttttgtgtgtacactctgtcatctttccattgaggaaactcaggctagaagaaggataaaaacaaaacagaaaacaaaacaaaacaaaa

SEQ ID NO: 208 - DNA, 497 bp, Homo sapiens
gttttcactctcctaggatgacccaggtatagaatctgcccctatggttcggctccaccctctcacctgtctcttgagagcattgtgaaattctgagacacagcaaggacagaaacagagggcatggaagatgctttcagagatcagatccagagcctgacaagtttatttacttggagaagcagattctaggttctagaaaagaaggctgaaaatacaactttaagggaaaggataatctgatgactaattctcatttatcaaaaagccactttgccttagatctatctgtataaactccatgcttcacagtaaaatccttctaactttattgaaaaaagggggccacctagcaaataacaccaagagtattatttctggggttcagttaacccaaagacaattatttatcttactaaaatccatttctaggtctataaacctattgtgtagtacataaatacataggctttagtcctagatagttggagcagatc

SEQ ID NO: 209 - DNA, 925 bp, Homo sapiens
gcctcctttgaatagagtagttccttgcgctgaatattatgggataatctgaaattttaattcttgaatcaaatgaaatctctttgccccgtaggtgcagaagccagggcctttccacctcacagtactgatttcattcctagacagctgggtgaagtagccttctgtggcatcaactgaattctcccagcttcctgtttggtcttccaggggtgaggttgtggtttgatgctgaaaacttaatgtgggcatttctacaaaggtgtagcaccttgattctaatagtggacttctaaaacctacatcctgtttaggtggaaagtatctgagacttgagcacagccatagtctcatccaggtatgacatgtgccactgtgtctgaaattcctgagcaccgagggccgcttcaggcaccaggcactttgccaacctgagagctgtatggggctggactgtctagtctaactaggcagtgaaccctgtcctgaacagagcttgtttgttcataaagcactctaaagcagtgacttttaaatcttgatctgtgcataatctcactcctcccaaagagtcatcaagggagagcaaacacccaagggtaacgttggctcacgttcattttgttgttgttgttgaatttttgcttcctcctatgactaagcagaaagagagaaaagcagtgtttgggggcctcttctcaggctgtgtttaaacccaggtcacttccctcaacaggaaaatggattttgacaggccatcttgcttagagatttccctaatcacaccataattaatgccaaatggtttctttgctaaccttagtagcacttgaataattaacttttactcttttctttttttaaaagatacctgcgaatccactgaaaagtacattaaacaaaacagtatagttttggttcccca

SEQ ID NO: 210 - DNA, 708 bp, Homo sapiens
acatcgcggctccgcgccgcggaggagacttaaatatcccagcgtgcaccgcgccgcgcgtcgcgtcatcgcgcgccctctacgtcatgcgcgcgcgactccgggagacgctaccgcccggcagcgcccgagacccaactggtttggaaaatgccgcctgcctttaacgcctgtttctgactcttgaggttttccgcgtggctcccagcgccacatccatccggaggcgatcccgtggaaggatcgcgtccaagataaaagggcccgagacctatgcttacgtaattcctaatccgtgatcttttatgggggctgaattcccctccagcacagcctgttaccaggtacttttcacaaacgctactagcggttgtgagtccctcccccctccatttctatgttacaaattgaaaacgtgggacgattacctaccaaatttcacatcatggcccagatatcgggtggattttgtggctctgtgatcgacttatacctatgctaaagttaacggtctgagaaggtagattagtggttgcctagggctagggagtgggtttgggggtggggaatagaaagtgactggtcatggttataggcttttttgtagcaccataaagatagtttaaaattagattgtggtggtgattgcaccaccctatgatttgcatggtatgtgaattatatcttaataaagctgtttaaaaagtc

SEQ ID NO: 211 - DNA, 601 bp, Homo sapiens
gatgtactaatgcgccttgtgaagactcactcccgtggcctctggggttcggcattgaaagagagggtgggagaggaaaggaaagagaaggggaaaggactcatttggaagcagtgcatttttatcagagggactgaaaagcctttcgagaatcagtcaagaaaaaggaatgcgcatgagagtcatggtcacatcatgtgattgtagggaaagcctaggctatcatggagggaagagattggataaattatttgaaaagcaagcctgtgaattgctgtggaggaacaatagcctgtctcttatctggagcctttccaaggaaaagcaaaggggaccctagaaggcttcctgggagacagtttaattctgaaaacaaagcagtacttcacctcttgtgtgttgggtagagctgtaaaacagaacacagtcaaaatagtcattagggccacatcaatgtctgcccaaagtcaggcgagcattcccaggaaggtggggggctgtggcagttgcacacatcaacctcctttctccattgtcacacagcagaagagcgtgttccattctactaaagttggggcggggggagttgaataatttattg

SEQ ID NO: 212 - DNA, 3088 bp, Homo sapiens
atctcatttgtggatcaagtcgcccccagtggagacaaatgtctgatggagtctggccaaggccctcctgagccttcactgggccctgcatgagaagcctgccaaggctgaggggccagggaaacggagacgaagccctcagagcaggccaagagggtgggaggtggggggcatttagagggttagatacagagcacccctttacaaataccagctactggcttttcgtattacatgttcattttagatacaacatactgcacacgctcccttaacgtgtgtttacgcgtgggtggtgtatccttccagacgtcttcctcacatctatacataatatgcatagataaaacatttaccaccaaaacccatagtgttatgtacatatttgtctggctgtgtaactttaaataacatacaaatgtatagaacagaagcttgccctctttctgaaatatctaacgtgggatttcaggctttctgatgagacctctgtagaggtcagtgttttgccaccagaggtccttcagcctccatctgttctcccacctacccacattctggcccctggcaattcacagggagtttaggaagtagacaccagggccctatttcctggagaccagcctggtggccgatgtcatagagtgcggtgggcctgggccggccctgctctgggcccgtgacctgcgtgtctgactcgggtccagctgttcttcctgccagagcctcttcctgtgaggcgggggtaacacaaccttctgtggtggctgtgggattaatccgtatggctgcattgtgagtaaagcctggtggaaatctctgtctccactgctttccttttcctgctgttcaccttggctccctcgacacttaatccccctccacatgtgtctggagcgggcagagcgggggcagttgatagaaagggggccgggtagtgccaaggctgttactttcccccactgcctcccttggctaacttgaagtctgaccctttataccagaactgtaagacagtgtgtcagaatggattcagttgcagagcaggaagcctggatcccagcgccggacggaaatgagaggtcgatggtgcaggctggtgtgggggttcctccaccgtcagggcccaggctccttctcaggtctcagtctcactcttcttagcacgaggtcaggtctcattccttggctgcgggagctccagccagcacacgttttaggaagaaggaggaaggaagaaggtaaagggtggatggcagctgcctcctcctctcttggaagctcacagagcgctgggtcacaattccctgggtagaactggatcacacaggcacccctgtcagcaaaagaggctggaaaaagtatttctgaagctgaatcaaattaagattcctgttactaagaagggagtgattgtatgggcgactacagggaccacggccatacacggtgcctggaagaccaagcttgtgacagtgacgaggatttggagagggcagggtgatggggagctttggggggagtgcattaggaaccctgacctggagaggggcagaatgaaacctgcgggcccctaaccctagtgggttgtttgagaaacctgtcctactgtggcagggggctgagtcttctcagggtcatgcatgaaaactgaaattcctgaaggccacacacagccccggaagtgctgactgacaagggcacatgccagtgatgcagttttcttttttgtcttcacttttgttgttccgccgtcttcaacacatggctcccagctcacagcaaatgctgccctggttcagctaccaggaagcaggagaggggaagggagggcaagcctcattctttatggaacaaaagcagtgggcagacagccttccctcacgttccactcactggaatgtggtctggctgccttccctgcaggaggtgggatgcaccctcagtgcagcagccctgccccagccaaaaacgtctcagcacagctgtaagaagaggaagatggctagagacaggcagccttccctgcaagggcaatgaggcaagcctgccaaaagcctcctttggaaatactgtttgattacttttcagagtttctatttaggaaaagggcaaaacctttcaggatcaggagtaggtgagcggcgatcaggcctcactcttcaccgagggccttccctgaggaggggcctgcaggacgctggcagcggaatggggctgtgtggctgctagattaggtcatggcagggagacagcctcttcctggttcttgctagaacaggcacacttggggccttgagctccagggagttcatggaagacatctgactaccctgagccccttgctggagggttctggggagtggcccacggccaccgtcacccatggccaccgtcacccacaggggccgtgaggacatccctggccagcatctaacacaaccacatgggatgccctaagcaactactgcccagccgagggctgcctgaatttctgactcacaaatggtgggcaatgtgaaacgggtattttaagctgctgagttctgcgggagtttgctgagcaacagtagaaaccagaactctcggatactgtgttctgtccttgaaacggtggaagattttatgtgaccagaatggaatgtttgaacaaatattttgagaatagaattttaaaacatttactcatcagcatccaagggtggggagcagtgtcatctaggagactggttctattatttacgtagatgttcttgaattaaaggatgggaatattttttccttccaaaactttttttcaattttatattctgtttttcaagtttttattatgaaaatattcaaactcacagggaagttgaaagactaatacaaagaagaaccatactctttccactgacatgatccaacgaggaatattttgccacacggcaaatatataccgtataattttctgtaccacttgatagaaaggtaaagaatgaatattgttttttaaataacttttttcgtatataagtaatatgtgcttatcgtgtaactacctaaaaacattgaaaaataaaaggaaaataaaattcatacataa

SEQ ID NO: 213 - DNA, 1771 bp, Homo sapiens
gaattatgcttgaagaaggttaatcttataatggcatgcagagcggagctgggcaaggccagaggctaaatatggagccagaaagatactgcagaaagtgagcaaaaaggatgagtggatggcctggggtggaatccgtgaaaaagggcagattgtcagtctcaggaaatcaacaggactgagttctaacttcagctgggctactatgccctggggaatcagaagattctccctaacattggagtccaaagaagaggagccaccatctccttaactacaaaacaactgagagaagaaatgtctccctttagtgccagtgaagagttttgcttctctagaacaactgtttatttttgatcttatgaaacgcgtgacacttgtaactgatttgccttctttttgcttgctgctagaaatctcagaaccaaattcgaggtcatttctgaatgtgctggactacacagcatgaattctgtgtcctctcacctcattcatagatacatttttttattcctacccatcttttcctttccccagattttcctattgctcttttatcatcttgagtaaagaaggttaaactatgaataaaaagtacaatctcaatgacgagtcagggaaaagtaagttttggacttccatttagagccatttataggtcagcaatcttttgtctctgtgtcttctttctgccctgaacaaccaaggcatcctagtcagtctctcttcatctgcataccactttaaagagcccaggggtcttccaagtacagtcactactaagaaaatgtcttcagtaaattttttttttttttttttgagatggagtctcgctctgtcgcccaggctggaatgtagtggcacgatctcagctcactgcaagctctgcctcccgggttcacgccatcctcctgcctcagcctcccaagtagctgagactacaggcacctgccaccatgcccggctaattttttttgtatttttagtagagacggggtttcactgtattagccaggatggtcttaatctcctgacctcatgatccgcccgcctcggcctcccaaagtgctgggattacaggcgtgagcccccgcgcccagccttcagtaaaattttaatgcatgttgcttatcattctttgtattgtaagcaccaatccttaatctgtgctgtggtttttgttcagaaacatttctttaaaaaaatttccccagacgctcagccttcatattctaatctttattattctgaactacctacaaagctaaatataccttgtctacatgcagtgcttatgtaacaatggtgcttattttgttttacattgcttcaacctctgaccagaaacttagaggacagaatgccctgcttttacaaaaaatgtggtgaccacaacggtaaccttatctaattgagaccattttaggaaggaggggaggagatatttttactgcaaagactgagtcataagccttcattttttaccctgggttgtgcagaaactttaaactttctatattatttcatttcttccataccaggacatttatttcctattcagtgacaatcttgatgtcttcatccttcaaactgctctctaacatagtttcaaaatccaagcattaaacattattaatgctcaggggatgaatatgttcattacctttactgtagtgatgatttcctatggcaaaatgttaaatgatgtaaagataaaaataattatcatagttattaatcatagcaataaaactggactacctaaagcaca

SEQ ID NO: 214 - DNA, 1771 bp, Homo sapiens
atgggcccgttccaggcagaaagagcaagagggcagggagggagcacaggggtggccagcgtagggtccagcacgtggggtggtaccccaggcctgggtcagacagggacatggcaggggacacaggacagaggggtccccagctgccacctcacccaccgcaattcatttagtagcaggcacaggggcagctccggcacggctttctcaggcctatgccggagcctcgagggctggagagcgggaagacaggcagtgctcggggagttgcagcaggacgtcaccaggagggcgaagcggccacgggaggggggccccgggacattgcgcagcaaggaggctgcaggggctcggcctgcgggcgccggtcccacgaggcactgcggcccagggtctggtgcggagagggcccacagtggacttggtgacgctgtatgccctcaccgctcagcccctggggctggcttggcagacagtacagcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcgggcggcgacggagccgggatcggtgcctcagcgttcgggctggagacgaggccaggtctccagctggggtggacgtgcccaccagctgccgaaggccaagacgccaggtccggtggacgtgacaagcaggacatgacatggtccggtgtgacggcgaggacagaggaggcgcgtccggccttcctgaacaccttaggctggtggggctgcggcaagaagcgggtctgtttctttacttcctccacggagtcggcacactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctggaaggtgagcaccagcgctccttccggaagcctccaggcccccgagcaccctgcccccatcccacccacgtgtcgctatctctaggtgaagctagaggaaccagacctcatcagcccaacatcaaagacaccatcggaacagcagcgcccgcagcacccaccccgcaccggcgactccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagcaa

SEQ ID NO: 215 - DNA, 883 bp, Homo sapiens
gcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaagatgccactcggtgattggccgcgtctgaagccgcgccccggcgtcgcgttgcagccttaggtccagccgagcgccgactcacgccccagccccaattgggcggccggtttccaattggaagggcttctgagcctcagtcttcgggcggcgctgaccattggcgggcaggatggaggcggagccttgggttgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcagtgaggctgtcttccttgctcctgttagcagacgaccccccacctcctgctggccctgcccatagcccacttccgccaacattgcctccacacctctcct

SEQ ID NO: 216 - DNA, 386 bp, Homo sapiens
tggtcactcgctcaggctgctctagaggccccatagccagggcccggctctgagggccccacgggccagcttctcagggggctgtgttcttcctgggccaaggctgcgtgctcagcagcggtggatgcagcatgtgctgaaccgttctcttcacaacacccctgccctgctgggcgccggcccccatgccaagcatgaaggggcaccggggagagagaagcgagtggaggctgggacagatggtgccctgaagtgtgggtcaagtccgaatcaggcagggtccctgaaccctggcgctgggggaagtcgccgacctgtggccagggcggggctgataaagctccatcaatcacttgactgtctctccttcctcgggcctccatcca

SEQ ID NO: 217 - DNA, 625 bp, Homo sapiens
ctcgaagctggggcgtctgacacctgaggcccgaagtaggtggccagcttcttagagggccaacccagggcattaacacaccaggatagtggccgcagttgtattatcttgtgcatttgtcaagagaggtcatccgaacgctgagataaaggcttgggattccattgtctcatctctttctgggagtgattttcctctcatctggaagtgcagagacagagtcttcatagggaactgagattacctccaaaaaacatttgtgaagtgagcaattcctagaaggctgttaatgttgattaatgaaattatacaaaaagaatcataagatagctggagaagaaaattatctgtgatgcctggaaaagatacgtcccagtgggaggtaagtacagaatcctgagttctgagatgtgaggaattcagttgaggtaatggttctactataattgtggctaccattaaatttttgtttcttcaaattatgatttatttctcttcctgataacattgaacaatcataaatgtggagggaaaggaatcattgagggttgatttagagagagtaaacaggtgtaaagccatggttcctgtgtgttttaacaaatactaactgagcacccgccct

SEQ ID NO: 218 - DNA, 573 bp, Homo sapiens
actgcactccaatcctctctttggaacctgcaactgaatattgctcctaaatgggaagactgtcttgcaaggggacaactgccacaatattgccaaaataatccagaggaggtaacacggtgccatctccaagcctgtggctcgagaggtcggaaaagaagctctttctaattggaaaacagccagcaaagttgttaattccaaaaaacaagtatgtctctggagttaaaaaattttctgtaaagagccacagtggctttgccatctctaacacactccaagaactagtatccttgccacacattcccgaagagattaatgttatattggagtccttagaaacaagaacataccaatcatatccttcaatcagtctcaacaatgaaaagcctgagagcccctttgcagtttgtctgggctatctgaagatttctggccaatagtttgtaaggggaattggaacacttcaattctcatctgatacatttaaggaaagatacaagttctccacactttgcttccaacttcacagacaagagatctaagaacttggagatggagagtgacaggaag

SEQ ID NO: 219 - DNA, 2479 bp, Homo sapiens
tccagggaccccagacagcatttggtccctggctctgtgtccccacacagccaccctaccccatgctgccttttactgaggcacacagcattttagacaggagaaccctgatggcagaggctgggtctcacgggaccctgtctccttaagggcttagtctggggctggagcctctacagatgtttgagcaaaggcgggaggcaagggagggaggccggaagccaccccagggactctgatgtccaccctgcggcagcctgtctgtggacagatgatgcaggaagctcacggaactcccaagcagaaatcagcagagatggagcctggttatttttcagcacacaaaagccgagggccccttcctgagatgcctgcctcagcccggtagtgaaactgaacccacctcagacgggaaaggcttggcgggctctgcttggtgggaagtccacagtggtgcctcgtccctgagatgagaatcatcacctccgctttacaaatgagatgaccaagggtcagagaggagaaaggacctccccccagccctgagtcacctgcctggagactgagggagccataatgcgaatcttccccttgccaaacccactgactccattacgctgcctccagagaacccgagccccgcggcgagaaagtggtagagctgggcctcgaacctgggtcctggactcttggtcctgtgctccttgtggaagatggaactgcttcttcagagacaaggtctcattgtattgcccgggctgttctaactcctgggctcaagcgatcctccggcctcagcctcctaaagtgatgggattacagtcatgagtcaccatgcttggcctgggcaggactttctcaagtggaactgcctcacacacagactccctggagctggcaggatgaagcccatgaaccttggcctggcttgctaaaccctccctcccgactccctcaggagttcgagtctgccttctttctccggctggctcctcagcttaacgcgctttcctccaggcagctctctcgggcttcgcagtgacccttcctcggtgctccgcggcagcatgcttctggcatctcatcccaacacagtgaagagcagccaagtgcggctgtgtggccctgaccaagtcatttcacttcaattttatgctttggctttcacatctttccacggacgtgaatggagatgatcatggtgccgaccccaaaggatccttacacgtcttaaaaaagtgagccacggaaaggcctcagcccagtgcctagcagagaagcagcacatgggagggaaggaacgaccagagaagacccgtggtgtgccaggcactagacctggggctcggtggcacatgtcagctccttgcaagtgtgaaacaactggagtgcagcgagcatcagtaactcaccctaagtcacacatctggtaaacagcaaagcctggatttgaacccaggttttcccatgacatcagataagacggcaatcaccacctccttctaacccaccctgcctcacctgctccatccttacgacttcaggtgtcacctcccagctgggtttaaggggctgagttgtccactctgatcttctccaagcacaaactgcaaagcagaccagaaagcagctggtcctgactccagggctacccacagatgcccctgcacctcctcatgctcctgtgctcctgtgtgatgtcctggactgtgtgatgaccaggctggggaagtcccaatctgaagagaccaagcgctctctgacaatgtgctgatctaatcacgtacaacttaagacaaagttaacccgtctcattgaatgatatggtataatggtgatgactgagctgcccagtaattgtgctcaaccaggaagcagctcatggagtcagttgtaattagtatttgtgttacacaggtgagtgggtgggtgagggctgggcagagggaggaggaagtgggtggggcaggaagctctggggactccttggatccatgaaccccatgccagccaactcatgtggttgatcctgtctaaccttcatgatgacctcatgatgtactgttatctctcttctaaggtgagaaaacaggctcagagaagtccattcacttgtccaagatcagacagctagaaaatgacagagccagggttccctcttcagcccaggcgatgtcttggacagcagaaggaacaggaatagggctgggaggctggagatccacatctcggtcccagttctaacactgccttaccctgggcctcagcaagtagcatccctcttcaggatacaaagagatagtatgtctgtcaggttgcagacggctgagggtgtggacttgggagctaggctccttggattctaatccttgggcaagctacttcaccatctgagcctcagtgtcctcatctgtaaaatggagatgacaacagtgtctccctcataggcttgtgaagataaaacgagtaacaagactta

SEQ ID NO: 220 - DNA, 506 bp, Homo sapiens
gagccatggactcccacaatatggtggggggaaaggaatcaagctcatttatctggaaattaaaggtaaagatgacatttcagaggtaaagtgatttagaatattcaagacatctgatgtgccctacttatatatgtgaaagactggaccaataaacagcagaatgtttacagtggtttgctctggataatgaaagtatgagttcaactacggagctttaagcttgaatttactacagtggaagtagaagtttcaggggtaaagtggaagaaaatatgcaagtcaacatggtgtattattacagctccaattttgcatttccagttccctgctgggaataaattaaattggcagaagctcagtctaagtgcctgcaacagaatttgtcccatatccatacaacttgctcctccacaacaaatgggagaatcatcctcttacctccagcacctgcctcaaacaaagtttctgatccatctaccacgtaactttgacgctgaccaaga

SEQ ID NO: 221 - DNA, 6116 bp, Homo sapiens
aaaaaaactcagtttcctcatccataaaataggaattagatttcaatgttctcttaggtcccttctagctttaattcatatgtgattatgcagtaaccacaaggtattttttaaacctcctaatgtatggatattaagcagaagagtatttatatgaatacatgtttcacattcctttggtatgaaaatggtgtgttaagtttttcctttaaccactgagttgtgaatgtgaagaaggtggtggagaggaacaaaaaacagaaaggtattttgatcttgccacaaagcatacacacaaattggcacatgcagctgtttgccaaagccttctttttttttttactttttaagaaattatgttagggaaaataaattctgcttccagggacaacttcatggagcctatttacaaattaagagtcagcttaatttgtaacatttctaccagagccaagaatcccaaattcctggtagattagtgttttatttctaaggggcttatgcattcggctccaactcaactcgtctatgtgctgccagtaattaaaatgttccacctcagactgcacaaatggcttatccttctttgtggcatggcgtctgtctcaggaaaaaaggttttatgaaattccatggcaacagtcccaacatgtttgagacttcagctaaaggaatggatgtattttggtgtgtagtcttcagtatatcactgtatttccgtaatactagactccaagctatgccagattgcttattccctttgtgaaagaggagttgctcattacgttcttgaaatatcgcacatcctgttggttcttcaagggacaagagaaagagaatttggaagcagggattagtagaagagaaaacgagggaaaggaagcctttccaccagattagtgttcaagtctttgcagaggagaccaactttttttgttttcttttgttttgagacagtctctcgctctgttgcccaggctggagtgcagtggcgcgatctcggctcacggcaacctccgcctcccgggttcaagcaattctcctgcctcagcctcccaagtagctgggattacaggtgctcaccaccaagcccggctaatttttgtatttttagtagagacaaggtttcaccatgttggccaggccagtctcaaactcctgacctcaggtgatctgcccgccttggcctcccacagtgctgggattacaggcatgagctaccgcacccagcctgagaccaccttttgcatctcaagattgtgaaaccaaggcccattccaccagcctggggactctttttatagatatgatcctcctttttcctgtgactaatgaatttgctgcatgatttctattcttctgaggttagttttctgagtaaggtgaccactcacaaaggcactttctttgtggcattctgagcctagattggggcccatcaattccagaaaaaatttatgtgtggaaactctgcatccttaagtcttgaagttgaaccagatatgcagtggttaccatcacacagataaacgctgccttctgtacataccccttatgctgtactaattaacaaaccccttgccagggctggggaggtgagggtgaaggagaatcttagcagaagggcagagtcaggacttgcatctgccactgctgggcactgaagccctggagcagcttcagatagtacctgtactttctcatgcagactccctctgaacaagagccttgtaggcccctctccttcatttcccaccagcctcttatcaggcgggctttccaccatacacccaggaggccacggtctgaggaacaaccaaacccatgcaaagggccgggcgcgatagctcacgcctgtaatgccagcactttgggaggctggggcaggcagatcacctgaggttgggagttcgagacctgcctgaccaacatggagaaacccccatctctactaaaaatacaaaattagccgggcgtgatggcacatgcctgtaatcccagctactcaggaggctgaggcaggagaatcgcttgaacccgggaggcggaggttgcggtgagccgagatggcaccactgcactccagcctcggcaacaagagcgaaactctgtctaaaacaaaaacaaacaaacaaacaaaaaaacccaggcaaagtttccttgcagccaaggtgacagaactgggctgagggtggaaaagaaacagaaccagtgctccaggtgttttttaattttttaatttatttttattttttttgtatatgtatatatatgtatgtatattttagaggaccagggtctcactatgttgcctaggccagactcaaactcctgtgctcaagcaatcctgcctcagcctcccaagtagctgggattacaggcatgcacaaacaatgcccagctctccaaatgttttctgtcactacctgaagtgttgcatcggtacttcctacggaaagaaaactaaatagaagtgtctctcccgtgagcccccaccactaccaccagaaaaaaaaaagagagaaaatgaactcatcagtctttagtttcctcaagttattctcccaaaaagacattcgccttggcacagataagccagctaatcttatgctttatgacccactgtgagctgttcctgacacagcttctgactttgtcagtgacaaaatttctcaccttttaaatgcagtgcttaacattttgttaggcccatactcaaaatcggccagatataaaatgacctcagattttgatctcctaggctcaaacaatcctcctacctcagcctcccaagtagctgggactataggcacaccaccatgcacagctaattttttttgtatttttctgcagagatggcgtttcgccatactgcccaggctagtctcaaaatcctgggctcaagcaatctgcccacctcagcctcccaaagtgctggaactacaggcaagagccactgcgcccagccacaacctcagatttctttggcaaacagaaatgtttaaaaacacaaaattttgctcaggtgaaacactgtgttactatcaaatctcacatccacataaagtttttcttttcggctttgtttcgtgaggaacagacagaacaaagtttttccaggtagcatctgtatcactattattctcctatttcctgtaccacccccacctccccaagccctactgaatgtgaggtttagaatgttttaaggagggtcaggtgcggtggctcacgcctgtaatcccagcactttgggaggccaaggcgggcggatcacctgagtttgggagttcgagaccagcctgaccaacatggagaaaccctgtctctactaaaaatacaaaattagccaggcgtggtggcacatgcctgtaatcccagctacttaggaggctgaggcaggagaatcgcttgaacccaggaggaggaggttgtggtgagccgagatcgtgccattgcactccagcctgggtgacagagtgagactccatctcgaaaaaaaaaatacaaaaattagctgggtgtggtggtgcacacctgtaatcccagctactcgggaggctgacgcaggagaattgcttgaacctgggaggtggaggttgcagtgagccgagatcgcgccattgcaatccagcctggacaacagagtgagactccatctcaaaaaaaaaaaaaaaaagaatgttttaaggaaaaaaatagtactgttacatataatcccaggtgataagaccacaatggaaatgtttaagtcctcactttaaagagtaccccactgagaagaggtatgttggactctagcagagatttggaaactctgggacactcaagatgtgaaagagcctggctatctgaggactcaaagagtcagcatcgggacttgtgagctcaagaagagaaaagggagtggtgaaactttgtcctaaaagttagcaccaggaacagaagaaaaaaacccgatatatagtgatacctcatcttttagagaatgggaagctatttttgtgttcacacagaaagtatagttcaaaaaacctctatatccagagttcagacaaggagaatgatttgagatataagtgccgatgaaggaggtcaattttgatctgaaaccagcagctggacctgggccacctcaggaaaaggactctgttctccaaggcagcacgactgaatggttctgagaataagccagggttcaggactcctgaccctttaggaccatggactcagaagagcctgaaggacaattgtgggctttaaacttctgagagcttgtaaagtaacacaagactgtgcctctcccttgccccagctgtagatagtctttgccccaccattgttatgaagatacacagggttttgcagtttgaataaattggatacaagtttcctctttttttttttctttttgagacaaagtctcgctctgtttccccaggctgagtgcagtggcacaatcaaggcttacttgccgcctcaacctcctgggctcaagcaacgagccatcctcccgtcttagcctcccaactagctgagactacaggcgtgggtcaccacacccagctaatttttgtactttttgtagagacagggtctcaccatgttgcccaggctggtcctgaactcctgggctcaagtaatctgcccacctcagcctcccaaagtgttggggttacaggcgtgaggcaccgcggctggcctgagtttcttcttaatactgtatcacaattgtgggctgtcttatgtgttgatatcgattgagctatttgaaataggaatgttaatgggtgtattaaatttttgtaaggatataacaatatctaccttccaaggatgttgtgaggttttccatgattttgtatatgagctaatgttacctttgaggggtggtgtgcattatgttggatgattgtaaattttcagtggaaaatgtaccgtgtcctaaatttaaagacatgaaaaatatcccaagatcatactagatcataatagcaattcctttacaaatgaattatggaggtaactgatctctaacagtttccttcatgttgttttaatgcacaagggcagaggatctgctgacccttggaaccagcgtgagctaaccacgtgctatagacacttcatggtgtcgcacccagggaagtcaaagcgctttgctccctcactgtctgtgagtcctcagccattagtaccccaccccccgctgctccaaaacttgagttatttcaaatgtttctcactgttcatctctccactgaccccactccagaaagcctggagagagtcccaagatgccacccaccttccccaatccctcgccacagatctgtgtctatctcacactctgtaagtgccgctttgcttcttcctctcttgaaaagactgagaacacacattttaacatgttaggaaaatggggcagcctaaaaaatgactgatcccaccgccagtgactcatgtatactccaggctagcagacaaggccctttttggtgggcctgcttctgtgggttcacagaaaccaaattactgtgggttgcaaagaattagcaggtcatttacaaagcagacatcccttcacccagactgtggttttgcatgctcaggttctcagtctatgagctttggtgcaggatcattttggctactggaaaaaccatagcttattttaaatttctggttgccaaagccaccacacgtgtggtctgtggatgaccattgtctgcagaatgacgaggaaggaacagaatgtggtttggggctcagggtggccttcccactgggagggaaggcgggagggagcccttgccctgggttttgacacagcctgtgctcacagcctctcctctcatctgcatttctcagaaatgccctccctgcccagtggtgactttccctcgtcactcctatggagttctacctggagcccagccatgtgtggaactgtgaagtttactcctctgtaaagatggtttaaagaaagtcagcttctgaaatgtaacaatgctaacccttgctggaaccctgtaagaaatagccctgctgatagttttctaggtttatcatgtttgatttttacactgaaaaataaaaaaatcctggtatgtttg

SEQ ID NO: 222 - DNA, 780 bp, Homo sapiens
agactaatgaccgaagcttcaagactttgacatgtgtgaaaacatgaaatggtaagtcaatacaaagacagcatcttcctggaatttggttttgagcttgttttcatttcacctttctcagtaatctgggtgtagcttattttgactcttcctttgattaaacaattcagacccttggctcttattgttcttgctggtgtggtatgttcacggctgaaaagatggtcagaaggggaaaggaggaagtgagaagaaagaaacagggaaatgacagagtgttgctcagttacccaggctggagtgcaatggcatgatcttggctcactgcagcctccacctcctgggttcaagcggttctcgtgcctcagtctcccaagtagctgggattacaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacagcaggctgaggaattaccaaggaggcaggaggtggagcaaaacacaccaagcctggtgccaatcattgacaatattatggttagtacttactgagggctgactatggttgaaactgcctttgcaaaattatgactgagacggtgaaagagatctaacttaaccaacgctagctatcttgcctctaacctccaagctgtccttgttcattcc

SEQ ID NO: 223 - DNA, 571 bp, Homo sapiens
agaaagtgctaggcacgtaggcgttcaggagacagtcacggtactcgtttccagacagaagtcatgaggaacaagagggaaggtgctttcccgtgtgcagcgcttggggagactcacacagacagaggatctggcatgacagggaaaggaggaaatggcttctgttaatctctccttcagcttctcccgcccttcccatgcactcttcctgtttccctttccagttctcacggtgactcaaggaacaacgtgtgaaatgaaagacctcaggtgctgtattggctcttgacagctcttcagaagaaaatacctcctgcctgttctgttcagtcctggtgcagcttccaggaagccaaatgacccaccggcttacccacatcgcaggaagctttggagcagagtcagtgactatgtgaacctgcctcaacctctgctccctggttcagcatttggcttgggaaaaatgacactatttcctgtctcttaaacattatttcaaggcacaggtcttccaccattctgagaggcagggggatctttgagttctgccaggagctgggggttaggggta

SEQ ID NO: 224 - DNA, 337 bp, Homo sapiens
cagtgtgtccccaagaaagtgtcagagcctttacgtggaccttctcatgaaaaaggaaacagaatagtcaatggaaaaggaaaagggcctcctgcaaaacatccttccttgaagcctagcactgaagtggaagatcctgctgtgaaaggagcagtacaaagaaagtatgtacagacattgagagcagaacaaaccttaccagtggctttagaggaagagcaagaaaggtgtgaaagaagtgaaaagaagcaatcacagctaattttaaaacatgcactctgacagaaaagacatctgagaaacaaaacaagcaaatttgttttccattttgcacctg

SEQ ID NO: 225 - DNA, 1998 bp, Homo sapiens
tacactcatccctgccattagcattcaggaccaatcttctatagcctatacgccacactggtctaggacagcacctaaataatactcatgctataaaaaattcatcaagttatatatttttaaaaacatccctaaaattatctttttcctttactgaaaagaatttcaggatcccctctctctcactgcctctcttcacacacacctaccttagttggtcacctattttgtaaacatatcttctttaaaaaaagaaagaaatggcagtacatgaaaaactgcttcgtaaacagaaactatattatttatatttgtagcatttttttccccttgaggttaatttcctttgcttcccataactggaagccaatgattcagtgccattatataagcttattttccctcttggaaatagtaaattataagaggtttgacccaaaaatatacatcaaaattaggcagtattcggtgtttagcctccatctgccttgtcttcttgtctttagttgtgcaagtagatgctgatgatttctggcagagctaaagtaagtaaatcatgtgaatttattttttttcctcataaaacagatggcatggtctagctctgggcttgtatgtttcatgaagtacatgggtctgagtgcgtatttattttgtgagccaaggtttatgccttcttctataattttctttcaccgaaaattacctggagagctagaaactccatttgtgtcagtgtaagaagctttagaatctatatccagaccaaggccatggaacaatgtagattcactcagtaaaaactcactagcggccttctttgtactagtctgtcacctttgcttggctttgggaagcttcaaactagggcagtttatgtttgggagtgaccagtcaaatagcaagacagacataggcaaggatgtaatttttaaaaatttaagtggggaatggtgaagcatgaatcaaaacagaaggtagtcttaccttcttggaactgtaaaataaatacatttgaaaaaggcaccctctcaaccttctgcgagtcagaatttttgctgccacccctcattttgaatctctattctgcattttttattcttttttttaggaaggaggaagaaaaatttctcctgaagaattcattggaaattaaaattaacttgcgtattttgtattctttggaatgtgatgaagactgatttgaaagggcagtgctggatttggtcaggcataggaaaggaagacatgcagtcgtcctgcctagctcatccccgccacgatggagaagtggggttgctttcgttgtactttttttcatttgtttcttgccaagcccagtggcttctgttataacatgtggcagcttctcccttggagactgattcagtccaagttaccataatatttaggaccagctacagagacgtttcttcccctaaacccatgccaaatctaaatcaaactatcttcttctccttagccgttcaaatagctccagctcttatataaaaatacgagaaatacacaggcctcttttcgttttattcctgttcaaacagataaacaaacaaggcacatcatgcctaggttgctttgagcttgatcacttcctcctaaagcagtcttacgctgtgttgattttaagaattgcaacttaggtgttctagaacatattctgagagcatagtcatagtctgtgatctcagaatatgtttgcttccttctagaacatctgagttctagaaattgcgtacaataaactgctgtcagtgctgctggaggaaggaagagtaactctgacatcactggccttcaacaggtgtggcgctgagcttctgggcctcagaagccctgacttctagaggctgggggccagcggggcagggaggtgatctcatcatggatggccacagatcatccacctgccaaacagttaaccctgaacaagtcatgtcaatttattttgcttttaaaaaagaaagtctgcaaaataga

SEQ ID NO: 226 - DNA, 4166 bp, Homo sapiens
ataagacactattctaagcactggggtcccataagaataagacaaagcccctatcctcaagaggctatcatcaaactatagacagagatgggatctccctctgtcatccaggctggtctccaactcctggcctccagtgatcctcctgcttcagcctcctgagtagctgtgattacaggtacaagccatggcacctggcgagatgacattttgctggaggaaagggagatcttctaagagcaaagagctttccaggagctgggaccaggactatcacagattgccctatgtcgtccatgctggtctggaactcctgggctcaagagatcctctcaccttggcctcccaaagtgctgagattacagagctagagtctcatgatgtcgtccaggctggtatcgaactcggcttcaagcagtcctctcacctcagcctctcgagtagctggaattacagttgagagccactgcatccagctttgctctttctttgaaaggaggcaaaagaatggacgggcacggagatcctagaggcgaagcaagttgtcagcgcccctgcccaggccccgccctgcccggcccagtcccgaccccgccctgccccgccccagcagctccaccctcaccggctctcctcgccctccagcagcttgcggtaggtggcgatctcgatgtccagggccatcttgacgttgaggagctcctggtactccctcaggtgccgcgccatctcctcttttagctgtcgcagctcctcctcgagccgcgcagcgcccgcctggtagccccccgcctccagggcgaactgctcctccagctctctcaactgcctgagcagcgcctcgttctggggtaggagagtggaaggggccagttgcagaacatttcatcgtccgctccccgggcccgagcgcgcagcttcgtactcaccgtgccgcgcagcccgtccacctcgcacgttagactctggatctggcgtcgggactcgttcatctcctgcttggcctggcgcagggcctcgtggttccggttggcagcgtcggacaggtccgcgtactgagaagtgggggtaacccaggctttagtcggctgggacgcgcgacaccaccccagcgtcccgcctcgcaggccctcccggctcttgcaccttggacttgtaccactcctccgcctcctgcaggttcttcgcggcgatgctctcgtactgcgcgcggatgtccctcagcgctgccgtcagctcgggcttcaccgtggcttccacctccacctgctgcacctgctggctctccacactcacctgcaggtctcgcagctcctacggccgggagcaggcagaggatggacagcggcgcaaattccacgcgggccacgcagttcgtgcacagaaaagagaagaaacgcttgaacgaacagaagtgggcgccagggagggcagggcgtacagccctgcgcccccgcgggcgcgagaccagaggccaggtttcggagctccagcgagaccaccccacaacctcagaaaccgcccctgataccgggcccacttacctcctcgtgcagcttcttgaggaactcaatctcatccatcagagactcaatcttgcgctctagttccaggcgggacagagtggcatcgtccacgtccttcgaggggtggcagtggaggttcaagataagttaggggctgcgcagaccaaggaaggaccaggccttccctgtctgcctcaggaggcatctgggttacccccttctccccgcgcccaccgatgccacctctggatactgagatcgggggtagcggtggggaggctgaactcggagaggggctcggactcaccttgcggaagagcacgaggttgtgctccgcgtcctcccgcttgcgcgtctcctcctccaacctgacgggaagagcgtgcagaggctgaactgcggggtcgccgcccagctcgcaccccagaccgcacgccccccaggatccggttagaggctgttctgctgcccaggactctaaatggagggctgaggctgtctaatggaattgccccgcattgtctctaacggactgggagctgaaaagggggtttcctcattactcaggggaggcacagatacccacttctcccacctccccaaacactcagagcaaaggggtagcggggggcacttggagcccgtgggcagggatgctgcccgcacacacctgggttggtaaggggagccacacccttgggctgctgatggagaggggaagcgaggggaggcaagagcagccgcctcgacggccgcttcgacctcgcctcgacggcagcggcccagccctgccccctgacctctgcttgagcgccgccaggtcctccgccagcccgtcgcgctccacctgcacccggtcacgctcgcggcccaacagctccagctctcgccgcagctcgcgcagctcctgctggcacagctggtcggcgcgcgccggctcctggccccgggcttggctcagctccccgcgcagggccgcgttctgctgctccagaaagcgtaccttctcgatgaagttggcgaagcggtcgttgagctcctgcagctcctgcttctcgttgctgcgcgtggccaggaactcctggttgagggcctcggccatggagaagtcgaggcgctccgagggcaggcgcaggagggcgcccgctcccgctcgggggctacggaagctgcccaggcgcaccgaggagctcggggacgcggagcccagcaggcggctgctggagaagcgggagctggacgagtaggagaaggccccgggggatagtgagggcggtggaccgaagacggcccagcagaggttgtctgctgatgtttcagccttaaagacacagcccccaaacctagacctaccccgcaacaagccccaatgagcttccagaatgcaagcacaacctgcccaggagtggacagaggcagctcggatggtctgcaggagccgggttgctgaggtctgctgggtttgccaggaaccatagggctggggctgctgctgctgctggggactccagcgctgtcctgtgagacaggtctgcctcagatgggacctgaggacaagagagtgcatctggggaagcaggtttcaggttcctgcctggatatctggctgggggtaaggagggcggctccctggctggccagctcctcagtattgcagggcagcagccccctcccccctttgtgcgtcctgtgagatgggccagggccaacgccctgctcacgtccctaccgccttcgtctcctttccaggcccctccttccttccgggccattagtctctccctgcacagctgccagttccttctccttgatgggtctggtttggttgccaggggagtgggaagcgggaggaagggagagatgggacaggacgaataaatgacagcttggcctcccctaactcctgggaattgggaggggtagggtcccacccgggatagggccgggaggcttggtgggtgtgaggaggggctagggaagccttggtgcttcctgccgcagtcctgggcactgagccccagctgctgttggcctggagccccatctatcccggatttggccccaccctccaggagcagggagccagctctgcatcaggagaggcgggcaaggcctggggaggaccagctcaggccctgtctacagggcactagtgggggacccaagcctctgagagtagaggctgctggggctgcagctgggcctggggagttccagatggagttcccgtcctcaccctgcttaagggctccgctggccacctacatgcctcggaggagaagggacagagggctgccacagcagggctctggagctgtggatcaggcctgggtggggaactgccaggcagaagaggctcctcccctaaagcagaaggagcaggccagcaactccaggcggagcaaaggtaggcaaagagtctgggttaagagccgggctctggcatccagctgccacacttcccatctgatccaccactctgttgtagaatttaggctcgtcactacgtcccttcatgtccctcaagaaaagggagataactaactgtagcttctacctcatagtgttgttgggaggactaaaggaataaataaatacatgtgaagtgcttaggacacacatcttaaagcctgaaaatgg

SEQ ID NO: 227 - DNA, 569 bp, Homo sapiens
acctctttctctgctttcatttcgtcggactggctgcgcccctacctttctctctgaatccatcacacccctccctgactcctgccaggccatggcagaattgctgttcccaggaaggcaggcctggcctgggctgaaaagcagatctgggttctaatctcccttctgcatggacctgcgggtgacacaagcttggtgccttctcctctctgaacttcaagtccttacttggacaagatggcctggctcctcccagccctggatttggggatgctccgatgctgcctgggagcccagtctgatcatggtggcctggaaatcaaggctaagcgaaaggaaagcctgaaagagctgcactctaagcaccacagcaggacttgcccctgaatggagatggggctggggcaggaaggtggcagggaggggctgggccctgtgactgtcacctccaggttggaggagtggggagggaaaggcagggcagggtgcgttatcacacacacactcacccacatacactcaagcacacaccacagagtccaaggaaaacctgtttctgtcctagcact

SEQ ID NO: 228 - DNA, 1579 bp, Homo sapiens
atgcaagtgtttaacagatgcttcactattaaaatattttccccccaagtctcaaatattgaagaatctctaaccagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaagatggggaaattgaggcagagaagccaagacatgtgctaaaggtcatgcaggctatgaatggagctggaatgtgaacgcaggccatatgaccccagagcccatgttcttgaacccttagaaagacagcagcaacacacctggtgcagcagctgcttagttggagtggctgacaaggagagaatgatttccaggaagagcggaacacatatggaaggccttagcttatctttagcgcctcatacacccgttctggacttcagaaaggccagtgagtgggattaggcctcagagataggatgtcagtcccagtgagggatggcctagagcattctttaattctttcctttgggtcacacataagaaacaattttccagcactgatgagtgttattaacaatgagatgggatagaatttagttttccctatggctgtgcttcaaaaatagaaaagctgtcttttctctggaatgattgaatgaagctctggggaggaaaaggtggattggcagatctcttaaaggaagcttctccttctaggcactattctaaggcttaatattttaactccctatattaacctagttcaactaaacagtgatctgagtaattttatttttattaaagctcagatcaaaatgccattaacattgattgagaaaatcaaaggaatctttgatgtgagtggttaaattgctgaattatttcagtcccataccctcacagcatgagtacctgatctgatagacttctttggaattccttttttgtttgagacagagtcttgctctgtcgcccaggctggagtgcagcggtgtgatctcaaccattgcaacctccacctcccaggttcaagtgattctcatgcctcagcctcctgagtagctgggattacagatgtgcaccaccatgcccggctaattattttgtatctttagtagagatgaagttttgccatgtgggccaggctgttctcaaactactggcctcaagtgatctgcccgcctcggcctcccagactgctgggattacaggcgtgaggcaccgtgcctggctgggattccataataaatccctctgtgtctatttcttttttcaaatataattttcttcatttccaaacatcatctttaagactccaaggatttttccaggcacagtggctcatacctgtaatcccattgcttggagaggccaaggtggaagttcatttgaggccaggagttcgagaccaggtgggcaacatagtgaaaccttgtctctacaacat

SEQ ID NO: 229 - DNA, 617 bp, Homo sapiens
cggtggccacggtttccaggaaagaagagagaggcggaaaagttaactttccgccacccacacaaatatttttggccggcgttgtcttcacgctgccaagccaggagggaggagttggcaggagcactccaattcaaggttccctcccaaggaggaaggaggactcccaacccagtcggggagcttgggcaggccctatgcaagcctgagccccacagcacccacctctgtgcaggagctgtgggggtcgggacccgaaacaataatagcagctgccactaactgagcacctgctaggtgctgaacccagccctttacctgacactcctgctgtgtcagtgcagtctatacaggaggaaactgaggcacggagagattcatgaccctcatctggacacaagctctaaaatacttgagccttggcagaaatggctgatagagtccacagaacacgctgtcctcatctcagagaggagaactctgaacccagaggggaaggatttacctgcagttgtatggcaagccagagcctaaccagcctaaagaaaccatgggaggagaggctcttaccctctcctttgcagatgtgggcccggctgcctcacactccagagcag

SEQ ID NO: 230 - DNA, 470 bp, Homo sapiens
gtttggttgttattgttgtagaacgagcaacagaaaaacaacacttgtctgcctgagaaggctccggaaaaaaaaaaaaaaaaaaggaagaaaagcgacctcaaagagatgagctctcggctcagttgtcagcaaacaacaacactcccccgctcctccgctgggccatcctcccagccccagcccgccggagaggacagaccgacgcaccgacaggcccctctccccctcgcccgtctttgttacatctttagcagctttgtgcgtagctggcggcctcgagcagaatctgcacgttctgcagaaaagtgttgatgtgcttctccatcgagttctcgctggtgttgaaaatgtctgagaaggggcacctgggcttggccccagcggggtcctcgggcagggccgggggctggggcgcggccacggcggggggcacagccgggggcgcggcgggggccagccccgcgccc

SEQ ID NO: 231 - DNA, 609 bp, Homo sapiens
tatttattctatactgggctttggaatatgaaaaatggacctgtgtggccgggcgtggtggatcacacctgtaatcccagcactttgggaggtcaaggtgggcggatcacttgaggtcaggagttcgagaccagcctggccaacatggtgaaactccatctctactaaaaatacaaaaattagccaggcatggtggcgcacacctgtaatcccagctacatgggaggctgaggcaggagaattgcttgaacccgggaggcagaggttgcagtgagctgagattgcaccactgcactgcagcctgggcaacagagcaagtctctgtcttgcagcagggggaaggacctgtggtactcctacaaacttaacaactttagcttttcggggaacagtggtggtctccacagatagctagaatcttctaagatgaaaataaactgtttcatccagctgctttctgcctgttaacctttgccacttccattccttcaagtgtgtaatccccagggttgtcttgtattacacacatccttgttaagtaaatataccactgttgatttcttcttccagtgcaacatttggattaaataaaaatctttagtttccaga

SEQ ID NO: 232 - DNA, 447 bp, Homo sapiens
gagactgggctctcaccagaccaagtgagatgaaagcagagactgggctctcaccagaccaagtgagagcaccttgatcttggactttccagcctccagaaccgaggttctgagagctggaacatgtgcaatgtatacatgatgaagtaaagtaaaaccccagattctgaaggatgttcacgtacttgagatactcatccatggagtcatgaattcagaaactagtccagaatataagaaggctgcctattataaggctttacacaaggacttcattatgttatcaagttaagatgagttcatactagattatggtgggccctaggccaatgactgatgttcttaaaagagaaatttggacatcgattcaggcagagggacgatggctatgtaaagatgaaggcagagattggggggatgctgccacaagccaacaataccaaccac

SEQ ID NO: 233 - DNA, 1625 bp, Homo sapiens
atgaactatatcttaagaattcataaagccctaaaaagtaaatatttacaaccagaaatctttctgacaaagaaacaagattactcaaagtaagtagtagtttgggctccctggaaagaacccagaacttaagtgtcaggaaatgtggatagttctgaatgtgcccctggctggttgatgactctgggcaacttatgcagtacctctaactcatggtttatttacctgaaaaataagtgggttggctatgtctgtggtttgaaaggtgctctatgatgtcccagatgtcttagcagtgtatcattggctgttttggaggctgtcaggggtccagatggctgctcccactgagcctgcttttaacagagcttttcagtttgtatttcttgtatacacaaagtaatattaaataaaaaaaatataatccagctaagaaagtttgagaatactggcttgagattcaaaataaaataaaccaaaaattttagaaattatattagtctagaaagatagtattgtgtctctttgtctttttagtacctagcacatatcaggtacttgatacatatttatcatatgaatgcaatggttgtaatgaacaactgggaaggaaatgcaaaagcagaaggcaccatatttgtgttgctattcctgggtgtcatttctatgtaacttgtgataaccagtagtaaagaacaacatggactatgtttaatagacaacaactaattttattggatttgtgtacataatctgaaatttagtctaaggacaagccatattactataaattccaggaaatctagagagaaaaaatgggcaatttagaacagactagaagagtaactctttcagtttgtctggaaaaccgaatctaaggaataaggtcagtttgcagtttctttcaagtagaattggtgactcttggatgcagtttataaacacgtaacacattttccttgcatggaaatatatctattctatgacctcttctacatgaagaaaagatttgaaattttcttctccattaaataatgttttgtgtgcatgttgcaaaaataagagagaagcaagaataactctagcagatgcttaaaggtttaagattaaagacacatgtaaatgtgattcatagtgggtgttctgtgcacttgagtgaatattcccaaatcacagctagaaaaatttaggagtaaattgacttaacttatggtaaatcaataggggtccctgaattggagggaaacagatgagcaagaaaaaaattatttgacaggactccactaaggaaaacaacattcaagtaacagatgaggtattctactgcccagaggaattacccagcctttagcaaggcgaagtcagcctcaactggcaggaggtttgttttaaaactgaaatgagaaaaaggatctgggcttacaaatgatgggaagatatattatcaacagggaaaaaaacccccagaaaatagcaactaacttgtttccccagcacaactgaaaggatgaagaaggaaaacaatttaatgtaccctggtcatgcagttactttcctttatccttactaacagtgcttgtcaagatggttctggaaactgaataaatgtaagtaatgaatcatga

SEQ ID NO: 234 - DNA, 1824 bp, Homo sapiens
aggaaggaaccacatgtgaaaccacttacctgtttaaccctatgaacttgaagagaacatgtaatgccacttaaaatacctaagctcgggttctgccttcagcgactcctggtagtagtgcccttatgagccatttatcaagaagtgataggatcgcattctgtcacccagtctggagtgcaatggcatgaccttggctcactgcagcctcgatctcccagcctcaatcaatcctttcacctcagcctcctgagtagcttgaactacagctgaggatgctatgaaaaccccttgaggaaacaaaggcaccttgggggccattgagaactcctgacgaagagggctcagctgccagacctgctcaagaaagacctcagaaatctctatggggctgtcagaagaaaaggtttgaaaagggtctggagagactgaaatttgtctgccttggacttttcttttgacaattcacatccaacttaagcagaatcattgtttattcttattatgccaggtttccttttctggtctgcaggttctctagggtttcataggctagtagttggaattttcatatttccaaagcattggggattttgcaaaaacaaaatctaaaggatattcagcagcacagtttacttaggaggttttaatcataataatctgcataatgtatgagaatttctacctcagctgcctcctttctttctctttcgtgtctgggaaaaagccagggatttttcccttcctctgatttaaataccttataaaattttggtggaagcattttgtcctattctgtcttcctgattcattttctgctgtaatgagcaaaattaatttgcaagagctgctactgacatagtgtaataaactgggtcataggtagaatcagtgccgccttatgacccttagctgtcattgctttaaggaatttggcatggtcctcgaaggccagaaggcaatgtgggttgcatcctacagcttttgagatctcagagacttactgcacccatggctgggaatgaactgtaaatgctgacactggtaactaggtgccaaactgaagtgatcacaacctaatctgagccaaaaggcatttctttgcatcaggcataaagcaacatcaaactcccataacccacacacaacacagaaatcattactgaagagattcaacatcatcatgccagacactaagtgagttatttctctccttccctgtctcaccacagtttcctcccacttggtcacacatggtaagcattcatgtgtgcgaaggcattttatgccttcgacctaaccccgaccacagtcccctagtcttatcagagatctgcactccccaccatttgagcacgatggagtgcatatttccagtgcaaaaagactgatatcattatgattttcattaactagttgccagcttgcattcttttttctccctttttttctctctcaacagcacttctgtcctcagcccaaccccagccagaaaaggtgttgctacattcagtgaaaaattattattagtatagacatgaaatttgatgataatgtagattgttttgtgtcatctgcaggctgtcacaatacactctgcatcactgaaatgtgttgaccagaaggatgatggtgttgtcatgatactgaggtcttttaattaattactttgtgactttcatagcatttagaaaacggagaacagggtattttcttgaacagcctagccaaatgaaaaactggttactaatgtatgttatcttcatgaatgaaggcataaaataataaaaacaaacaaattaaaaattgttaataaattaataa

SEQ ID NO: 235 - DNA, 3360 bp, Homo sapiens
agtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggcccctttgtgtgactaaatttggcaagaatatggatctgagccagtctttccacgtgtgctcccagctcccagctgagaaggccaagggttctcttccgggtaaggagacagggagaaagatcaaagagtttggggagctggatctgaaatgtgaattgaaaataaaaatcaagcctggacacattccagtttctaaagcaaaaccaaccctcagcagaggccggctctctatatagctctctttctttctctctctgctccctttgactcttttctgtgaccattcttgagcacatggtataaaataaagagaacatagggaaacagtttctctatatttcgttttggagtaattttattagggaaaatatcttgttcataattaccggtatgtgaagccgaatttccttagccgtaaatactgtcttatttcagcatgcttcgcactttcttctgcggccacatttgggaagagaacgttgacacaacacgtgtggatatgttcgttgtgtatagtggtcctttttttctacacatgatatggtgcaccgtatagttttctttcacagaagttagattctggaaaaccaatgttagtatttttatcaaagtacttactgtcacagttgatctctgtgatttgaaaccctctcgtcgatagactgcagagatcttttcctagaggccactcaccagtcagaaacctttgtgtttttatggttaaaaaactgtaggtcccttcacttctgttgttaatggaagtaactaaaagaaagagacagctttgaaatactgtgatacgaagagtcagaaatcctgggttggagatgggccctgccactccctctcatgccattggtaaccttaggcaagccattttaacctctcccagagtctgtttcctctctgaaaaaatggatataataataccgtactattaagtgagataatgcatatgaaagtatgtacaaatgtgaggtattattagtccatgaagcaaagacgatccttttaaggggacctgttaagttgcaaaaccaaaaacttctgaagctctagaaacccttaccacaggagcaaatggggacagtgttacgctctcgcgtccatgctatgaccatctccacgcctccatcagttgtgttacaaaggccaccaaaatcactgaagcagttgttacccccaagtgagtgtgatgagagaacattttcagaacagggtgaatgtgccttaactcgtgtttatgttgggctcttaatgaattcataaatgaatgaagaaaataacactgaaaacaatatcttcttgtgagacatttaacacacattacagcagctctgaaaacagtcttagtataatggcttgagaaagcagtaatgtttatgtggataaaatacccccaacaacagttgtaaggactcacaggtggggagagtgactagaaaggtatataagagttgtttcttgggactgtgtgagtgccacaaaaatctatgttttagaatagactgtgattatgtatcccagacagaggtatctcaagtttacaatgcagtaaagattattgctagggctggctgggaagtgacaggagtaccacaggtgtagtgcatagggcatttagctgaatgtacctcagtgtgatcctttctaacctaaggtaaccccaccaagggagccatttcctgggctcattgggagccattttccaatataagcttttcagtgtgacctgtatacaaagttatgaaagcagcagggctgggagatgggtggggttccagggttcctaggtccctttggcatggcccaaggctgcccagggtgcagactcctcctgagatgctccatctccttcagctgcctcctgccagaagcaaccctcagcctttgccaattgtatggaagggactctatagcaattttaattggcacttagaaagcaccttctattttcttttttcttttttttttttttttgagaaggagtctcactttgtcgcccaggcgggagtgcagtggcatgatctgggctcactgcaaccaccaccttccaggttcaagcgattctcctgcctcagcctcccaagtagctgggattataggcacttgccaccatgcccggctaatttttgtaattttagtagagacggggtttcgccgtattggccaggctggtctcaaatttcaaacctcaggtgatccgcccacctcggcctcccaaagtgctgggattacaggtgtgagccaccgcgcccggccaagcaccttctattttcaatgtaccttttcccaaatgtcctaaattaaaagtggatgctgatcaagttcactggtcaacttcaattcttcctttctcttttctttacagatgcagcctttttgaaatttattcttggccaaaagaggaagatagttcaaggattctatcttgcttttggggggcaatggagaaaccctgaaaacacttaaggaaaacctgaggccttctataagaaaataaactccctgaaaggggaggcagggccaaggaatttacttatttttataaatctctttcctgggtggatatggtaatggatgtgtttcttgaattgtggtaaatgtacctcataaaatggatggactggggctatattctcaggcttcctgggctctgttggcattgggcaagcacgtaatgcctggtttgaggctagaagccaaagccacaaccttcttgcagtaccaactgagccatagggagattaatgcagaacaaggtcgttagtctcattgtttatccagttactagccgcatagattttgtgtaaatttcagctacagtggttgcagcctgcctttgatgtgtgtaatctgtacattttagtgctccaggaaagtacctgattgacaagatctacatccaatgcccagaaaacacatcctacacaggcacagtgaagcgtggagttgaagaattttccagtgagttccatcaaagtaaataaaccaacctagagcatcag

SEQ ID NO: 236 - DNA, 464 bp, Homo sapiens
ctgatgtatgagctgcacagaaagttcaccaaaccacccaaagccattgccataggcatctgaactgcaagccagcacaagaagtcgatgctttcatacactttccaagatgtcagaacaaggttccaaatcataataagaattcactccttacctagaagtaaaaaaagaggacacacttttgaaccgctcacatgaccacaccattctgcggggacgtccttgtgttgaggggaggtctgaagtccatggaagaagacgcagtggctgctggagctcgtgcagaggaagggaccctcagaaggacaggtgaactgtcggtggcaggaaaaatggtgggcacatttccagaatgacaaatgggagaagcaatcgtgacatctccaggtgggggaagcataggaggaagaggttgttctctcaggaagttgcctcctagcctccaacgaggcctttcctatcac

SEQ ID NO: 237 - DNA, 305 bp, Homo sapiens
ttttggaagtggcccaccaccatcttgggagctctgtgagcaaggaccccccggtaacattttggcgaccacgaagggacctccaaagcgcctccatcagagagctccatccagacctagacttggacaataggcagttgtttgcttgcctctggctctgctcactctccatgggggtctatagctggtgatcatcttgtatacctaattctggcttcatcttcagactcggacaggaggcaaactgagctcctgaatcattaggatggacgcgccatcaacagaatctgcttttagtggaatgg

SEQ ID NO: 238 - DNA, 550 bp, Homo sapiens
ttacttcccccagtggaaaggaaaagggcccataggagctgaatctgactttgggaccctcagtgggtgaggtggtgagcccgcagtgacgtatgcaatgcctgtcacagtgcaggctaaaaccacaggctataaccaatagcagtaactgaaaaacaaaataaagctaaaagcagtgctgtacaatcagctccaggagattttccacattcatccttttcgcttacactctacacttacttgaatgcattcacggccactactactggaattccaaacattctggcattttcaatttgtttcttcaagttactgaagcctttttcaaccagctccaggttctgtaaaaacaacagtgaaaggcctatgagatcagagagttgaaaaccactgcaggttcttcttcaaaggcaaacaacctccttgagccagcagccactcactatcaggacaaggaggccaagaaagaagagagaaggtcccttggtgcattttttccagtgcggtaagagacacatatctttgactacatgactaaacgcagcactgg

SEQ ID NO: 239 - DNA, 1978 bp, Homo sapiens
caaaagagcaagtcagggaactagctttggttgggttcggtggtacacaaagcacaaggcctgggttggggttaggaggaaatgagacttgcggcgggtcggggctgaagatgtggcagcgccctgaacctggagaaaggctgaatccctttggtcaaggagagggagagagaggtaagggtctggtcttactttttaagcaggaagaagactacaaaccaccatctaccatctgccaggccctggaatttgaaccaccatcttctggagtgactcaaatgcagaggaagccaggcctgctgctaacgtttctgagaggcggcaagagtataaatggagatccacatatgtataaataaagagtgtgaatcaagctaacaaactgtttaataaaatatgatctaccctcttagcttgacaaatcaacttttcaaacacctggaagaacaagtttgcactcaggattctcagactcctcagagttctgcactgggatgtggaagggctgtgcaagccagcccttgggtccctgatccctgtctcctggcctgtgcccgtctcttctcagcctggctccaactcccattgagaggaagttcttgtacacatatgatactgcagcccttatgtctaatatttatccataccttctgcaaacagccactgtgtgaccacccttgggcttcccaggggtctgcaaactgacaatacagacaaagggaaccaaggcagaggctcacagactgtagaaatgggcttggggccatctgggcagagacttgtggaatcccagcacgatcactctgggtgctgtgtgaaatggatgaatagcaaggagctgcagccaagagcaaatcaacagaagcaccactcaaaatgcctcagtacccattacataaggattcttgtgattaattcttccccaaaatttagagccaagaaaaatccagctctcctactgagagttgtagattagagcttctgtttctaatctacaaacaaacaaatgtgtgcaatgtcttttcatgacaattccaactttatcataaggttgtctactaagaaactagtaggcaggtttctcttgttgtctagaccacctgaaagctcatagctgagtttgcacttatttgcagagtaaactgctcatttatcaatctggcatccaatcacaactttttagctaactgtatgttttcataaacacttttctcacacagtataaattttaaataaataacaatagcaattaagtagtaacaactcgagactggtatctgactagtggttctttcaccagtgtgtacactggaagttttgttttgttttttgatgtttgtacattgtaattgcaggacaggtagtaagaagatttcaaattcacattagctttgctaccactaaattatggtgactgttcctaatttgcaaacaaatgtatgcaatctctttttatgattatcccaactttatcataaggttgttatattttaagacatatgaaaagatataaagtataatacagtgaatacatatatatctaactcccagtttaagaaataaaacattagcaaatacagctgaagctccatgaattcccctcccaaatcatactcccttcccacccgcagagggaacctctattctgagcctggtgtttatcaccaccaagaattaaaaaaatacttttactatatatacacaagtatgtaccccttagaaatgagtagtagtactgttttgtatgtctttacactttaagtaaatggtataagttatttcttgtttttgctcaaaattgttgaaatttatgccctttgattctatagctgactttcactgtgagtcattccatcattatttctgtattcattctcctgctgaagtacatttcaggttgttgctattcctctgctgatccccctcccccaacacacatgcttttattaataaatctgctggaacattcttgcataca

SEQ ID NO: 240 - DNA, 570 bp, Homo sapiens
atcgccgccattttgggctgggaggaggcagcggagggactcgctgcgcacatcaagaaagaaaaccaaggcactagaaagcaagcacacttaagtattgaagataattacatcttaaattttgcctgaactgtatattgtagcatacttaaacccattcaaggaaaaaattggcaaattgaaaattctcccattaaagattgatatttttgcaaactgacaaatttaacgatttcggtacccctccccaaaaatgcagtcacataaaatatatcaatactattttgaattagctctagaaatcacactgaaactatgttacatttacaaatattaaatttattataactaaaatgaatttaattgttctcagatttggccaccttatagctccgtttaaggaggggatttgttaaaaacaaaaatgcattataacttggtcaaattactttcacattaaggaaaaaaacttctaaaaaggaaaacaagaaaagcaactcttcagtttcacataattaaaagaacaggagaaagcacgcaagctacatatagctaaatttacgaaaccaa

SEQ ID NO: 241 - DNA, 438 bp, Homo sapiens
cggccgcgccgcagaaggtgaaggaacagcgcgaggcacgcagccgccgcaccgtggcgcgcacgagctcagccggccggcgaccccagcgcgcccacaggacagtggcagccggaaagtgggttcctgcatggtaacaagaccttaaaattgtgtcactggagaaggacgtgcagttcccgctgaggagagacttggccactccaggacaacacaggactacaagtcaggaatttgaagatgaaaagtgctcaacagtgataaatcctaaatgtttcactgaacaacctttcagatagccttcttgaagtttgctgaattatggctataaggaccactccccacccctgctagatgaagtctcacttgcccaggttgcagtgagccgagattgcaccactgcactcaagcctgggtgacagaaaaagactccatctc

SEQ ID NO: 242 - DNA, 541 bp, Homo sapiens
gggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtcttatgatgtaatcagcgcgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaat

SEQ ID NO: 243 - DNA, 606 bp, Homo sapiens
gtgcctgagtaagccccatgggaacacagccgtggtgggaagcagcttcccagcagccctccccgccatcgggagaatcccctgaggccatgagagggtctcagggaggtggacggcccatcaagtgagaaccgagggcactgtgcactcctgaatcctaggactcctcttagctgtgtcttgtctctacttggggtacaattaatagcagagccagtcatgtcctaccagcattccttttatacaggctggatatatgtgtcattgactaacaacatcaacaatgaaatgaatctgagaaaacaggaaattgagagcaagagaaaaaaaagttaattatactgattttgtataagacccctttgaacacatttttaaaaaatcaaatagaaggtgcccaggtccactgtgccttgtgaatatttgtcttgtatatcctagagatctacgcattcatgtgggaattgaaaaggacccacattttactagaagcatcgttcatttttgcctcaaaacaatgcccacatgtcagaagaactttcacaattcacaggaacagtgacctaattaaccaaccataaaattgccaaatccctacttctcatt

SEQ ID NO: 244 - DNA, 5008 bp, Homo sapiens
ggttaaaaacactgaagattgcataaagatcaaagagggaaatttaagggaattaatgggttatgattgcatttgttcagaatggttttggtggctcatgacaacattttgagagagagagattttaatggcaccaatggcagctaggataactagtttaaagtttagggcctgtgttaatagattttgctttctagtttcagaaagattctcttatagtactgttttaatctgtttttctaagccctctgatttatgtatatttaataggccacaaaataatgtcaaatatatggcataataaccaacaaatatttgaataagtgaaaggtactctacaaaatgctatgggaaagacaaaaataaataatatccctttctttgagggattaacagtgttaatatcccttgttttcatttgatttgaaatgccacttgcaagtggaatatgcagactaaatggtaaagagaaaaacaagcagcatcttttcatttcacttacagctcactgtatgaccaataatatgttacttgacctctcagcactccattctaaatccttaaatgatacttatttagcatttctaagcatcttgagatctcctcttaaaatatgctttgaactattcagtctaaatgctgctttctaaaaagctactagtttaaagaatgggaaatggtgttaatggagttaatcttgtgtaatttcagtgtgggttgtcaagaatacctctaagtaaagaaaatgactctaatcttcttaagcaattcattttctcagcaactttgaggcaggagttaatttactctgcctgtgtacataggccatctcttacaaaagaaaaattttactatggaaagaagtcagaatagccatgaaattatttaaatttagtctttagaacatattacaaaatataagatatattaaattgtcttttttgttagaaactcaactaccaatgtagaaataaaactcctgttgcaaggatggagtttagccatggagtcaaaacaagagctatttggttattttaaaagagaagagatcaaagagctggtcactccttaactaagggtgtttgggcagcaggatagggtgaagagtggagggggttgaactcaattctttatgcttttataccaagcctcccttttctaataagccttactggcatttccttagactagttaagtcaggattctgagtttttcagtacaatagggttttaatctgagctgatcattgtttccaatgcctcccctgtggcaggggaacataaaggactagtgttcttttctaaaaagggaagatggatattttttctataacctttataattccattataataaaatgaatgataggttataataaaatgaattttttgcatatgattttcaaaaggaaactaatttatttttctataaaatatcgcaaaggaatcgaatacatttttattctatgtaaataataatataattttcacatttaggaggcaatagcaaatctgggaagcagttattctaagttggaagagcattatcccaatgcattgaaaacatttgatgactattttttatgtcttctttattttgatgattataataatgttctaactgggtggccttcgtttttcactctagtcagtccatcttgtttactatgtcaattgttctccaaaaagtagaaatgtcattgttttggggccatagaacatttcagaagctttccagtatctatgcagtaacagtccaaacccctcaacataacacatttacacctgcaagtatggccccaaatcttcaagtggcttctgtcactactccatagtacataccctttgttacagctgtttcacaaatacaggttgaatatcccttatctaaaatgtttgggactaaaagtttcagatttcagatatgtttggattttggaatatttgtacatgtataatgagatactcttagagttgggacccaagtctaaacaaaattcatttatgtttcatatataccttatacacataacctgaaggtaatttatttttcccttgggaacactgaatagactatatgttgtgcacctacattttgactgtgacctatcacatgaagtcaggtgtggaattttccatttgtggcatcatgtcagtactcaaaaagttttggattttggattttgaattttcagattagagatgctcagcctaatagcaaatgttcccatgttatacacctcaacctcccattcccattggctggaacatctctgcttatattaaatgtcttttatgtgaaatctgtgttctcatagccttttgtatagttctctaccatctcatggctcacattgtattgtacttatttgattaaatatctggatcatctactgtgaattattcaagagcattgatctttatacctctggcacctatcagtgcctgacatataacagggttaaaaatgctgagtgaatactgcaaatataccttagcaaatttatttgctgaatacacatctcaagaaagttctgaaatagttatttcccctcatagaaagtttagagtattaaaattgggtatctttataatgctttttcttttgtaatactttcatctttgccttttattgaaatattaaatgcattgtagaatttgatttaaaatttagaacaagctgtcaggtatgataactagtctcatttaacaaatgaggattccagggcttgaagaagttaagtagcttcctctagattgtaaagagagtctaacctggccctttttggttttaagggcatgatgataaccacttgctctactgatttctaatggaaagtgcttcagttttccactttgcctagctagtgattatttaatatctgcttatctctgaatttatctgcatatttctaaaactttatgacattaaggaaagttggggaaaattcactttaagtgttgtaatgacaatagctatcaatcattgagtactgtgtactaagcattttatattttatcaacaagtacttacatgtgggataagtactgttattattttcattttatagatgaggacacatatagaatgcagttaggaaactagagaaagagaaaacatggagaattatctggaactaataagacagtaaagtacagatttaagaagttcagtgaatcccaagcagtgtaaattaaaaaactacattgagatacatcatagtgaatatgcaaaacatcaataataaaaagaaaaaccttaaaggcagctttaacagtatactgaatgaccaatatactcagcagccacagaacctctattcttttaaagcatccatgggacatttatagaaattgactatgcactggactataagcatatgcaataaaatttcaaatgactgaaaccatatgagtatattcttttgccacaacacaattaggctagaaatgaacaacaaaaagataacaggaaaatctctatatatcagaaattaagagatgcacttatttattttttgttttttgtgatggagtctcactctatcacccgtgcagtggcacgatcttggctcactgcaacctctgcctcttgggttcaagtgattctcctgtatcagcctcccaaggagctaggattacaggcgtgtgccaccatacccagctaatttttgtatttttattagagatgggatttcaccatgttggccatgctggtctcaaactcctgacctcaaatgatctgccagcctcagcctcccaaaatgctgggattacagatgaagagatacacttctaagtaatctatatgtcaagtaagacaaaatgaaattagaaaatatttttaagtcaatgatattaaaccatactacacatcaaaacttgtgggatgcacttaaagcagcatgtagagggagattatattcataaatgcttatggtagaaaagaaggaagtctgtacattatgtagctatgcacccatctaaagaagttaggaaaatgacatcaagtagaacatcaaaagaaagaaggaaaggataacttaaaacagaaatgaatgaaataaaaccagaatagaagagacgatctacaaatccaaaagttggtttgttgaaaatactagtagagctgacatacttgtggtgagactgatggaaataatgcagttacaactaaccaatatcataattggaaaggaaatcactataggtgctgtaaaaattaaaaagataatagaatattatgaacaattttctgccaatattattgaaagtttagataaaatggaaaattcatttaaaaatataatttgacagtattatgttatgtgaatactataatgataatcctgtaatcattaaatgaaccagtagtttaaaatttttccatatagggaaggtcagggccagatgtgttcaatggttggttctactagacattcaaaaaaataataattcaagtctacacaaactttcctgagattagaaaaaataaagaagagtccccccacctgtttcttactttatgagaccacacctaaaagatagaagactgctttgcaaccaagaaatccttcatgaacacctctttaatcacaagtcctcaactccaaggttagctttatttcaacttttataatacttttcttacttttcttgatagctttaccacccatgtattcattcctaaaaaatacacagttttgtctgattttgaattttatgtgaatggaattgtacatatctgtgtttgtgtcttccttgttttactcaatactgtttctgagatcaatcacattatttgttaatattttgtttaggatttttgcatctctatttcagtgtgtgtttggaatgtaaatttccattctcagactatcttttggcctgaatttggttacatgagtatatgttctaaaaatattacttacactttcaataaattttaaggacttttatattgttatgtatcaaattttttagaatgcaagaataaatattataaaacat

SEQ ID NO: 245 - DNA, 567 bp, Homo sapiens
agtcaagtatgactgccacagagaaatggtcccatccaggaaatcagatattgagtcctacctgagtttccagcaagaagctctggctttctggatctgtgcttctctggtagaggaaccctgaggactgatctactcttgcagttctaaaaccatggcccatgcctcgctattccctgggacacaacaatattgaacgtaggctagttaatagccctacaatctcctctaagtgttcgagtgaaaggaagagtcacatgtgtctcactttaaaccaaaagctagaaatgattaaacttagtgaggaaagcatgttgaaagtccagacaggctggaagcgaggtctcctgtgccaaacagcaggccaagttgcacatgcaaaggaaatgttctcgaagcaaattaaaagtattactccagtgaacacacaatgacaagaaagcgaaacagttttattgctgatgtggagaaagttttagtggtctggatagaagatcaaaccagccacaacgttctgttaagcctaaacctaatccagagcaaggccctaatgctcttcaattctat

SEQ ID NO: 246 - DNA, 2289 bp, Homo sapiens
agggtcgtaggggaccgcctggggatccccggacggctgcgaggaatgagcggttggctcgggctggtttcctccctccaccgcctgcttgtttcgccatgcccgggccggacggtggggctgcagcggcgaaagcgactgaagtccgggagcagtcgcatgagcttcccggtcaccaggaggccccgggaacagacacctcaccctgacattgtggcaggaacttctggattgctttccaaagtggctgcactgttttctatccccactgggcaggaaaacatctaagaaaggaggctccccccttcccttgcagggttaccagcaattaaaaagaagtactagagaggcaaatatcggcagtatacatctaagcgctggtcggaaaagaaggaactcagcccaagaacttgcccaatctgatactggaggtgccactcaagaaccactccctccaagatgttttcctggatttcctcagcctaaagtaatccctctttttcctggctataccatctggaacagatgacttccaaggacaccgtagcaaagaaaaagagaactggaagcccatgtgccttaatcgcttcatcctagaggaggaggataaccagtggagccttttctggatttctcactagaagtaaagaccaaatttccagaaggaacctgagagataaaaagtggttggctgctcctgacctgactcatagtgtttaactgaaccataccactagtgtatactagtgtgtgtgtatgtacatgcatacacacatgcacacacacattcacacacaatcctatggtatttggtgactttggatgcccagctcttgcaacaatttcctgctgtcattcttttccctttgaatctcaggggtgagcaaactaaagaaatactatcatcttactgcttttagtatattccatagaaaaggagtggctggagtcagtgtagatcaacccaagcagtacaaatctgccagaattgcagctcagcttccttacctccagcatgtgtacctttctgaagggtaggcccttaagccagacataagtaagttatccactctgtgcataactgtctgacttggcttagaagcatgaaaggggcagaaatgtaagatgggtaaagaagggcttcatctgaaatagggccatgatgattagctctctctttccttcctttggcttcattgctgtattccatgtgggtcttgatatcttgaaactggatgagatacccaaatagtcagtccctgaatataaatcatttccttgtacagaatcactgccaaactcagtatggttaaaagatttttaacacccagctgcagcattcactctggttagaattggccatttaaatttatttcacatatgtaagtatcatatcctttataatgcattcttaattgttgctcagttcttccagattgaattcctttaaaaaattccttatgtaatcttttaattctagttggaaaacatcacttgacagttgctgtttatacaggcatgcctcgttttattgtgcctggctttattgtactttgcagatactgtgtttttcacaaatggaaggtttgtggcaaccctgcgttaagcaagtctgttggcaccattttctcgacagcatgtgctaactttgtctctgtctcacattttggtaattctctcaatgtttcaaactttttcattatgattacatctgttatgtggagctgtgatcagtgatctttgatgttaacattgtaattgttttggggtgccacaactgtgcccagataagacagtgaacttaattggtaaatgttttatgtgttcagactgttccactgactagcccttcttcaaactctctcactctccttgggcctccctattccctgaaatacaacaatattgatattaagccaattaataaccctacaatgatttccaagtgtttaagtgaaaggaaagacatgtatgtttcaccttaaatcaaaagctagaaatggccaggcgtggaggctcacgcctgtaatcccagcactttgggaggccaaggcgggcggatcacaaggtcaggagatcgagaccatcctggctaacacggtgaaaccctgtctctactaaaaaatacaaaaaattagccgggcgtagtggcaggcgcctgtagtcccagctacatgggaggctgaggcaggagaatggcgtgaacctgggaggcggagcttgcagtgagccgagatcgcgccactgcattccagcctgggtgacagagcgagactccatctcaaaaaa

SEQ ID NO: 247 - DNA, 565 bp, Homo sapiens
actccactcccatgggaaatacccaacagaatcagacaggaaaccccaaagtgccactgaaaagcaattgagagccccactttggtacacctgatgggagcggagagttagagaggcaggaaataacctccactccagggtagaagtagacaggagatgggatggaaggtttctgcatgctgggactagctcaggtcaaagtccagaactccagaaaacaaggcctgcccccagctcagagcagctaccacagcacaaaatggtgtggaatccaggagccaggatgaagcgtaggggtagacggtggttggatagctaactggcctttccactgctctagcctggaactggttgggctggggcaggggacatgttggtctgagtatagattttgtcagaaaacccaggcaccactcccttgcctttgcggggtgattctaaaattggactgtggtaagggttgcacaactcctcaagtttattaaaatcattaaaatgtaaacttacaacctgtgggttttatggtatgtaaattatacctcaataaagctgtctaatatctgca

SEQ ID NO: 248 - DNA, 340 bp, Homo sapiens
ttatcttttcatctctctaatcattgagaaaaagagtacaaaaagccagattttgcagttccctattttgtattccaggttgaagagtgctctggctgtagagggtccccacgatctgtcatctagtaactcaccagatacataagatattttgcctgctatgaagccattggagaatcaggtccagctgtgtcctacagatttataccctcactttggatgcactgtgaatcttgaaacaagtatgtaaatagaatccagcccctctctgccacagcctcagagcaggattggtaactccaaaagacaccaggacacatcctaattttcttaaatttta

SEQ ID NO: 249 - DNA, 442 bp, Homo sapiens
tcctccctccctcggcgcagcccggcccaggggtctgtcctcccaggcccaggaaaggaggaaacccacttccgccgcgtccatgatctcccgcggcttctcctgactcttgcggctggcgctggcgctgggcatcgggacacggaactgggcagtggacaccaccctccctcgcaggcttccccctttcaactccgctcggctgtaaccgcagactcgtcactaaaacacccacctaagcgcgggccttggtttctcctctcttggactttcccgccttctctcttcccctgggcgacgtagctgcttggggacggaggaggcctcttcgcaatccattgccctgcttgttgggacagaggagtgcagttggcttgccaaggcagcatgggttaccagtccctgtgtaagtgaggtgtaaatacagtggcaacgacaacaa

SEQ ID NO: 250 - DNA, 710 bp, Homo sapiens
cagaaggcagagctgcgaatcaaatccagcaccagaattatggaacatttatcaacagcctaaaataaagacaacacgaggagaatttggttgcttatatagattcaaggtacaatcctgctggattctgggattacaggactgtagacaaaagagaaatcatcatggactgttcactggacaaaatttcatggagaggagaagacctttggcggttcatggatgttctataataagttaggtaactaacaggctaactttcttgagcacctacactgtgtagggcactgtactggtacttctcataccttctctcattcatataatcctctgaggtaggtgttatcctctctacagcagggaaaatcaatacccagagaaggggagagacgtccatggcacacaggagaggacagagccaagaatgaatataggacaccagtgccccaactcttaaccactaccatacacggttttataaagtaaattttaaaagtcgactttaaaacatgtatgcaacattgtgtccagtctcccaaaacaaaagaacaatgagcgttcccttttcccttgatgtgtgggcaggtctgtagagtagtacaagaagagattatgttctgcattctcacttcaacaagaaagtcctggtccaccaataatacctttaagcttcaggataattgtgaaaaggccaactagttaatcaaaca

SEQ ID NO: 251 - DNA, 505 bp, Homo sapiens
cactcaagtgggacagtaagattttctctgaggctggcactggtgcctgcctctgctccggggaatccagacgtggcacccggagttgggcctcatccatcctcagctttcatttgtgaccaagcctgactcagaatgggctggcagttttcctgagtacatgggagttagggcagagaacatgatgtggtgctggtagtcaacgcaagctggcacggcctcagccagaagactggagctaggagcaagcaaaggaacattgccctgagacagacatccatgaagaagcctgggatgaaagaccacatggagagaaaggcccaccatcattctgcaccaactaccaacggcgtaagggaggttgacttggatctcccaccccagttgactctccagctgaaagcaactgcctgagcccaaacaaaacctgctgaggaacctccctgctagcaaatggaatcaggagaaataataaatagttctgttgttttaagtcaccaactca

SEQ ID NO: 252 - DNA, 592 bp, Homo sapiens
attccctcggtggctaaatttaagccatttatactttatactttaaaacactgaaggtaggcctggccttctgtgggtttaggtgggggcagatcagcaatggccaagggagaatgtcttctctgtggttattcttcacagtgagacaatgaagaccccataagctaaaagagcaactgcatctgaggaggtacaatggcagcccagttctgaagcttcttcttagtggccagtagggactcattctgacccaacagaaacctcttaggttctgtagtgactaaagccaacagcctgaggcacgctgctgtgtagtggagaaagggcaggcagcgagcaagtgtgtacaaggtatatacgtgccgcacgctgctgtgtagtggagaaagggcaggcagtgagcaagcgtgtacaaggtatatacgtgccacatgctgctgtgtagtggagaaagggcaggcagcgagcaagcgtgtgcagggtacatacgtgctgcacgctgctgtgtagtggagaaagggcaggcagccagtaagtgtgtgcagggtacatacgtgctgaacgtgtccatctctccagtcagattgattcg

SEQ ID NO: 253 - DNA, 3105 bp, Homo sapiens
aaaataaggcatttgggatgccgatgttaaaaggagaaggtaatcagagaagaaaaaaggaagtcggtggagagttctgcgaagattttgaagatttctagcagagaagcagggggttctggagaagggaatagacttggccagatacccaggaagacttcctcaacagatgtcccatcatgctgagattcaacgcgacattttagagtcatgcaaccatgtgagaaaaaaagtcccagtaacctttgttggggctggagggcaggatcccgaggtcccggaggagctgctccacctcctccagccaggacagcgcgtgcctcaggacgtccagcaccaccttctggagccccgagacaggtgggctcacctggaggtgctgaagaaggtcgacctccttcttcaggtcatggctgcaacaggatattttcatgcaagcctgcaaagaggtgagatcatgaggagcccaggccctgtggccagaaatagcccctgacgtgaccttcgaggaacagcgttcttgactctgccacgaagcaggcagcgccacgtattggccgccttgggaggactcagtttttttcttttttaaaatttttatgttttgacaggtttttttttaatactctaatttggacttttgatggtcaaagcgaacccccttttaggtctatgaaaccccagagccaaagtaccatcaacagtttggctgcaatgagaagcaaatgtggctacttcttttttccattcgtcagaattcctgccaagatcaacacacaagctggtcggaaagcgtggtttcctgatttgaaagagtgctgacaagccagcatttgcacaaactccccaaacaggagctgctgatttccagagaaagcagaagccaccgcctgctctgataagccatgtcccagggtgggggccgcagggctgtggccaagtcctcccgtccctgctcctccagagtcaaaagcaacggtgtggaaaccgccttttgtggctgggccaaaacaagaaaatgcaaataaaaagcaggaatgtttctttggtttctctggaaataacataggggctatgaaaacaatttctttttggctggggatgcgggccgctcaaagtcagtaattgaagatgctcaggcatcttttttggacacgccaagttctcccgggaggcatttttttaggccctttgttttttcttctccaacaagtttctccaacaagaggaaaaagtggatagaaaagccaagcatttctgcccaacttgctccaaaaaagctgggcaatttcccaaataagccgcacaaaaattagacaaagagaccatttgtggaaagcgtaaggaggggccacctggcagctgtccagcgacgtcctcagcttctcgatgttctcggtggtctcctcctgcttggagttgctcagctgggtctctttctggagggtccactttttctgctgaaaattgatgttgtcctcagtgacctgggtaattttctctattaactggtgagaaaaagaaaaaggaaaaaaaaaaaaaagatgtaacatacaggggtggggggccctgagggaaggggaatgggagaggggagagatgcaacttaagtccctgtctaagcacgggaggacagaggtcctgatatgtcttggtgatggctgtcaagggggacgttggtcctgtcaccagggaatgagtcccagaatcagagattctcttttcttttttcttttcttttttttttttttgcgacggagtttcactcttgttgcccaggctggagtgcaatggtttgatctcggctcaccgcaacctccgcctcctgggttcaagcgattctcctgcctcagcctctgaagtagctgagattacaggcacgcgccaccatgcccggctaattttgtatttttaatagagatggggttttaccatgttggtcaggctggtttcgaactcccgacctgaggtgatccacccgcctcggcctctcaaagtgctggcattacaggcatgagccaccactccttgccgatcagagattatttttatgatccaaaggcctgtcttgtggccctgagtttgttccagattcttctgtgttgtatagggattcagaacactgagcctgatattatgggctcataagcagcaggtcaggttctcccacacccactgagagcagcccacggcacattttcccatctgtgctttgacacagggggctagaaagtgtagtggaagaacagcaaggcaatcattacagccagacatccaccctcactgccactgtcaacttttctcctctgaaggaacgcgccagaacgcactggctgtggggaggcggctccctttctcccagtgctaatggaggcgaaacatgcatgtctggagaccagaagtaagcccgaatggtttaatttgattttcacagacacatttcaagggagttttaactggcttttactttaaaagccaggaaatcccataaaatcaaaacaaatctttatggtgtagcaacagtgtgaaaaatatgccaccaacaaaaacagaaacatatgctcccagggtctggaatccagatccacgaagaagaagaagaggaaagtgaaggagccacgtggcagggacggcagactaacctgttggtcggtgacgggcttgtcccggaacggcttcgcccgtccataggtggccttgatgacttgacttctgaagtgctccagctgcagcagagagggggcaacagtgtcagggggtcagcaggggccggcaagtgggggcagcgtttccatggcagggtgcgggaaacaccacttagcagggtttgcacgcctgaatgaccattccgcgttatcagaatcttcaccgctcacggggagtggcgggacccacagaagaaaagagaacagcaggctttaattactttttaggcacgcctgcctaacccgaacgatgcctgtggtcagtgcacacacatgtctcaaaccctcagaagagcctcttgctgccaattatccaatgggaagtctggggccgggagcgctcttccgtaattgctaagttggcaccagactgtgaaataaatattgaggctgtcagtcc

SEQ ID NO: 254 - DNA, 1771 bp, Homo sapiens
ttagtattcagagaatgacctgaacttagctgtgttaagttgcctgctccacaggaaaccacctctgtaactgttgcttgctgctttctctttaggcaacacccaaagccactgtcagatgtcatggagatgagacctcacaagcctactcaacgtgaagatgatgagaatgaagacctttatgatgatctgcttccacttaaagaataaaccctgaggtatcatgaagaaatccatatgccctgaagttaccatcctagagacatcatttggagagactacagtgcacagaagtagagaggcccagctgtgcctgtccccaactgatggagtcttctcagtgtcagtcaccagacatttgactgcaggtaactgaaactgcggaaagtgaaactgcagataagagggaccactgtaaataagtgacatgaatgatactgcaaaggaccatagcctaaccagccaagcaaactggaagtacctttagactcacgctttgccaagctcagttccagaatcacatgatgaaaagaatgatggaaagaaaatgtttgtgatattaaaattaaggaaattactccaactcagagtttcatcctaaactgagagaccaacatcaaaagaatcttctcaagtttctgagtgacggcaagaaactagactactgttaccaaggaactttttaaagcaaactgcttttgctgatatgaggagaaagttaattaataagaaaataccttaaatgtgttttgaagctgttaaaggtgtgtaacaattactctgaatttattatagcaccagttagagacccaggaaaactataaaattgcacatcagggcagagctgagagacgacatctgctttgggattgaaaaaaaaaaaaaaaaaaaaaaaaacagaaagggaacaagagaaatagcaagtcatttaacatttggaattcaggactccagactcatctataggaccaaactgctcttgaaatatactagatttcctttagctccagaggttttgccttcatcaaatgcctgtaacactcttattgtcaaaaggaataagtgatggtgaacactgtgccagataggaggtaccacacacaggttcagcaaaaagcagaagcaagaggtatattttttgttagatcttagttcatccctatgtaacagacatttcagggaagggaggagaaaataacaaagctacctatgagcaaaggtaaatgggattccctatccttgtttcccagtttcggtcatggtattgcttatccattattagttatccactgctgggtaacaaattactcccaaacttagcagcttcaaacaacaataaacatgtattatgtcacatagtttgtttcagaactttgggagtggcttagctgaatggttgtagctccaggtgctttttgtggttgcagtcaagaagtcagcccattcacacagctgcagacaaaaggactcggttccttgcaggctgaggcctgattaggcagggggcctgagtgtctcgccacatggacctctccatagggctgcttttcgtggcatggcagctgactcccctcagaacagatgatcaaaagcagcaaaagagaagcctcacatgacttttgccctagccttgggaatcacactcttccatttctacaaaatcctattggttacatagcagccctatccagtgtgggagggaactgtatacaggcatgaataccaggagtggaaaaccactagagactggctaccatggtcacttacacac

SEQ ID NO: 255 - DNA, 450 bp, Homo sapiens
cagcaagatggctttgaaacgctttcacaacgaaggtgtgctccactgggcaccacaacatacggttcagacgtttaaagcctgtctcagcccaatttcctctccatttgctccctgggtaaggtatccccccttcagtgcaggcagaactggcgacttgcttctaatcaacaaaatatggcaaagtggtggagtctagaagtctgagatcagggcaccagcctggccgagttctgatggcgtctcgctttgtcacccaggctggagtgcagtggcgcgatctcggttcactgcaacatctacctcccaggttcaagtgattctcctgccttagcctcccgagtagctgggattacaggcacccaccaccacatccggcgaattttttgtatttttagtagagacagggtttcaccatgttggccaggatggtcttgatttcctgacctg

SEQ ID NO: 256 - DNA, 487 bp, Homo sapiens
ttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttatattttcctga

SEQ ID NO: 257 - DNA, 6719 bp, Homo sapiens
gttgtcgtaggggcccggtccgtgagggactgctaaggaagaggctgcatggcgcggtagtcccccgagtggaggtcggctgcccctgggaaaccagagagtcggagggagtccatctggagcggccaagtaggtcggggaagggccgcgcctgacgtctggccgcaggtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaagacaaagaagaaagaaaagttgatcaaaaacctaaatcagtagtaaaggaccaagatcactggagaagatctgaacgagcatcacttcctcattccaagaatgaaataacattttctcataattcaagtaaataccatctagaagagagaagaggatgggaagattgtaaaagagacaagagtgtaaacagtcatagttttcaagatggaagatgtccatcttctctttcaaacagtagaactcacaaaaacattgactctaaggaagttgatgccatgcatcagtgggaaaatacacctttaaaagcagaaagacatagaactgaagataagaggaaaagagaacaagaaagcaaagaagaaaataggcatattagaaatgaaaaaagagtacctacagaacatttgcagaagactaataaggaaactaagaaaaccactactgatttaaagaaacagaatgaaccaaagactgataagggagaagtccttgataatggtgtttctgaaggagcagataataaagagcttgcaatgaaagctgagagtggtccaaatgaaacaaaaaacaaggacctaaaattgagttttatgaaaaaattgaacttaactctttctcctgctaaaaagcaacctgtttcccaggataatcagcataaaataactgatattcccaagtccagtggtgtatgtgattcagagtcttcaatgcaagttaaaacagtggcatatgttccctccataagtgaacatatcttgggggaagcagctgtcagtgaacataccatgggggaaaccaagtcaacgttattggaaccaaaggttgctcttctagcagtgactgaacccaggatcggtatctcagaaaccaacaaggaagacgaaaatagtttgttagttaggtctgttgacaatactatgcattgtgaagagcccatttgtggtacagagacttccttcccatctcctatggaaatacaacagacagaatccttgtttccatcaacaggaatgaaacaaaccattaataatggaagggcagcagctcctgtggtaatggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcagataagttgctgaattcctgggactcttaactgatattgcatactacacagaagcttcaaattcctcatgttttaaatgagcactagagggaggtttatcacctttttggttaccagatgataatctatatttgttattactcagtgactctctaatttcacatcagcatgttcagcttgtgctagtcatcattctgatttgcttatctgtttttggtcaaaatatttatttttaaacatgttagaacttaccaaaatgaaagcaacagtgatgtattgaaatcttagttttgatattttaaagaaatgactttctagattaaaaaaatagttttgtagcattttaaacttagtgactatttagttcaattgttcatccattttttatttgcttttataattgcctccttgttttggtatattgtaaaataatttaaataatgtatttataaatatgtataattatgatgtaaaataccgtgtgtatatgtatgtatgtgtgtttctgtatatgcacacacataaacggctttgcctagccaaggattttttttatctgtataaaactttttgtataaagtttgctttcaataacagtaatgtataataaaaccatgtaaagttttgttgta

SEQ ID NO: 258 - DNA, 1561 bp, Homo sapiens
aaaactcagctttgcccctgcacggagtttcccttcgcggggcccgctggggaagcatccgcggcttgtggtggctgtggttttgtgcccaggactcacacgtaaaaggagctcattcggaggcaggggcacgcgcttgtccccagaactcaaaccccagagtccctccggcagatgagagtggaggttgtaaatcaccctccatgcaatggttcatcataaaggatatggagcaaaattagaggaggcacgagaaggaaagccggtgatgaacaaggatttgcctcaactacagagacagcatggaacacgccctcctaggctgcccacatcctcatctgcatgggggcacagaagcctggccattcatcccatgggagactcaggacatgctcccagcaacctgatgggctgcccaaggcttggctgatcctgcatccctgcatcacatctcagcttctccctctgcccaaatctacttcctccccattcctttcacaggcattgattccctgataaacaccttgcaccccatattccatctcagagtctccttgcagagaacccaacctgtggcagagctggtctcaggactcggagcgagggagcagggaaagaggacaggaaagcagggagagtcaatttaagggtatgttgtctgagacaaagattctgctaggacctctgagatgggtacaagatgcctggagccattcactgggcagtatctgtccatcagctcccaggccccacagaaccggagctgcctgtgagggctttcactgccctgcatttctgggcttcacatatgcactggctgagagggctccctgtcttcaaggacgatcctgagcagaaagtgggtgcacttgaggtggcatgctgttgcgagagtctgagctttatgagaagcagacccagggggcatggtgtggggcatcccaaaggacctgccatacattaggtgccttggtcttggggaggagccctcgggagttctgagggtgggagaagaggtaggtggggttaatcctttcccattccctccctgcctcagcaccatggctcaggcagtagcgctgccagctcctcctgggatcagagttatggccctgctccccttgtcccttcaggctgaggaacataagggcttcccatggttgctggtgtctgagtgcctcaacctcccttgctggttcctttcccctgcccacacctttgtcaatagttccccccactgaagtctctttggttgagcagttggtggggatgctgactgataaagtggtctaggccactgctcactgcttaaagccttgcttcagagagaccttccagggccctgcagctcccccttctccaacccctccaacccctccaacctttctctctcccagctggtctgggttccctacggcatctacttgcttttgaatctatttcttatagatacatgtgtgtcctcctctttcacagccttaccttttcatatggaggaagaaaaaacccatttctataaagctattaaatgttttcctttcacaaacaccagttttgtaca

SEQ ID NO: 259 - DNA, 5131 bp, Homo sapiens
accagaggctgggtctaattagttgagaagcagtgacacccccaaccactccccaaacaggctggctcccgtctccaggccccaaggagccacacctggaccagaccccaggaaaggtaagcaccaacggcagacctgggatccgtgggtgggggcctctgggaatttccctagggggatgctgcatctgggggtcttgctgtcttgctaactggctctgtccctttctggacacagattctctgggtctcagtttccccatctgtacaggggctggagtcaatgatctctaagcatccatccagctgatcggctctagttctatggtcctgttggcttctaggattccttgttgttgtagtcaattgggggaagaaggtgcagagggagtgcacagagttaacatcctatcagcccaagcttcacctcggcacccgagtctcaggcagtctccctggcttctacataggcagtgcttcttcctcattgtgtggggctttgattttgtaattccaagagcctggggctcctggcaaggaaaatggttttcaaataatggtttcgagaaacaaagctggggaagaggcaatgtaagctcaggctctggcaggcaggcagagatcctgggaaggctgggtgctgactgcacatggagcaatgggaagggatgctggtgagaggagacgggggcacttaagctccggccccagctctgctctcagtgcccggctctgtggtcttgggctggccccctcccttctctgggccatagttttcccatctgtatagcaaggccattggacaaaatggtccctctgcagatgtggcttctgagttgtttgtgcctgagggacagccagtgttgggaagttcccccaggaggtccctgagccgagtctgaactttgaccacaagcttggagtccaagcagatgaagtcctgtgggagcttttggaggttgagcctgagtgagggagagtagctgaaggttctgtgactgaaggcttggccagaggggtgccccgagccctccagatgaacttggctgcaaccagcctctggtggggaaaggactgatctctggattcaaccacacaggaatgtgggacatggaagtaggtaagggatggaaaagatggcagagggcttcgcgggatgaagcagtggggccaggggacttagaggaatgcaggaggcatgggccactgcactcagccaacacctatccttgaggaatagaaagatccaggctccacaccacacaccatcactgactcaagtggctgttctgattcccagctgagcctgaggggttcggggaggtaatctctgaggtcctcactgctgggccgtgcctgggcatggcctcttcctgcaattttccaactaaactctccgggggggctcagcgccatggggtggttcgaagaaccatgatgaaggctggttcgaattgtgatgaccatttttgtccacatctcctaggacccataagccagagtttctctggagcttatagctagaaggggttctgggtcctggagtgcaggcctgtcaactttacaggagagcactagattgctttctgaagtggctgaaccaggttatgcttccatcagctgtgtatgagcatccccatcttcttgaccacacttgaagccatcagtttccttgaagcatatgggttgcacacttcattttgcatgtatcaagtttatataataaaaaatgtaaggaagccatggaaataaaaacgtaggtgtgccttctgtaggctgctacgctcctgtgcacgagggcgtctagaactttgccctccatgcacaagttgcagagcaccctcatcaggacatttacgaaggccctggggtgggatgggcactgcctatgtggccctcccccagcccagcagtatgcagtggcccgggtccaatcaaaggtcgcctgggagggtgagttgcaagaatctggggaaaagagcccaaggtggctgccgcctgctaacagcttgtctagacaggccccatggggcttcaccgcacattgcgagagctctggccagccccctgcccacttgcaaaagaggctgttggcagcaacacttcaccactagaaacctttactccaattcgaaacatgccttaacgcacagtgtgaattacccactctcgtggcccacagaggttgactcattcaggcccccttttgttcagatgaggaaactgaggctgactccgaagcctgggggctttcagatgtggagtgggtccctgtgcccaggtgatgaggggaccaggcgggtctggagcagggctggagtggggctcagatgtagtaggctggcagttaaaggtgccagatgtgagccaggctgctgggtttgaatcctggagctgcctcatagcagcagtaggactttgggtaacttacataggtgctgtatgcctcagtgacctcatctgtaatatagagatgataagagtacctgtctcattggtctactgagttgtccggattaactcattaaatgagttaaaactcatgaagcccttggaactgtgactgacacatagtaagtactcaataaaaaataactgctaagaccagccacagtggctcacacctgtaatctgagcattctgggaggccaaggcggaagaatcccttgagcccagtatttcaagaccagcctaaaggtcaacataggcagactctgtctctactatacatttttagattaaatttttataataataataaccactaaaatgtgattactaaagacagcttcttcacagtacaaagagatgctcttctgagtaccaactctttggaggataaactgcccttataccttcaaaaataacacttgccatatatcaagtcctttcaagtacctggagatttacccagcactctgagataaataccattatccctctgggcacacagaggctcagagaggtttagtcatttgcccaaagtcacacagcctgtacgaggccaggctgggactcaaactcagttctgactgattctaaaatcatgtgtttaactgctgcactctaggaccacccgcaatggatctgtgaaccagaaccagctctggttctgacctgcctagtagggcctttggcatttgggggaggaggccattggaagtccgaagcccccttccagattaggcatgattgcagtaagagaagagacagaccctttggccccccacccctgctcaggctcaaaaatgcagaccctgccgaaacagtccttctcacccagaagcaccccatagggtgggctgagtaaccttgggggcctcgtcagtcttgggctgccccatgccctgcacagcccgcctgaggtttgaggaaggggcagttggctaggcccagactggagaaagccaccccaccatggctcttctgcaagaacccccggccagccacaagcctaagccccctccttaaaagctcctcctctgaccttagctgtgcatcaagggagaaaagaaagctccaggccgggtgcggtggctcacacctgcaatcccagcactttgggagaccaaggctggcagatcattaggtcaggagttcgagaccagcctggccagcaaggtgaaaccccatctctactaaaattacaaaaaattagtcaggcatggtgacacgtgcctgtagtcccagctactctggaggctgaggcaggagaattgcttgaacccaggaggcgaaggttgcagtaaaccaagatcacgccactacactccagcctgggcgacagagcaagactctgtctcaaaaagaaaaaaaaaaagaaagctccaaactgctctgctgccacatactctactcctcctgtccctccaaggaggcagggatgggggtggagtgtctagagggaggctgcctgctggcctggggagggatccacagaggctatgacaccacccctggctgggctactgggctcagaggcccccggtcagcctgcccagagcctgccagccaccaggcatgtgacccaacaaccccgatgagctgagcaaggcagggtgaaggagaaagaggctggctaggaccaggccctggctctgcagccagcacaactgggtaactgtcccactcctctggggcctcaggccataatgttccctggtttgggacagaggggacagttgaggtcattccatgtgtgatagtagacacctggattctcagagagggaaaatctaaggagctgggggcgcgccctggatagacagagaagaagacggcattccaggtggagagctctgtgtacaaaggtatggaggcaggattgcagaggcattttcagacaacagcagagaagcccagttggctggaaccgagagttggtctgaagctcagtgaggctggaggttggcgaagcagagaaggcctagagtgtgcggtggctttggcaacagaaaccaaagcctcagagcttgggaaaagttctccttggtatctgtctgtccctgggagggggtgcctttctttagcctatttgtccccctccccaaaataccatcagccaagaaccccagtgcagggcagagacctaggaatttggataatgggcaactctgagatgtcaggcaatggggaaaggagagctcaggtgggactaggaggggtaggaagcccgagggctgcagtcaccatcttcagaccactccagagcttcctggggagcaggaacagaggacaggccatgaagcccagaaaggcagatggcagcagaatactaggaagacacctccaatagtctgtccaaagagggtgaggggattaggaagtacagacatatcctgagttacaattttctattttaaaatgctatgaaagctatatgcatttggtaccctcctcaacttatgacgcagttgtgatggggttataaggttacttcggataaaccaactctatattgaaaatatcgcaagtcaaaaatacacgttcgggccaggcgcggtggctcacacctgtcatcccagcagtttgggaggccgaggcgagcagatcaggagttgaggagttcaggagttcaagaccagcctggccaacgtggcaaatacccatctctactaaaaaaaaaaaaaaaa

SEQ ID NO: 260 - DNA, 744 bp, Homo sapiens
cacaccttgtgcttccatagaattgtcggcctctgcaacaggaaagagcagctctggggaagtcgctggtgctgacaacctttgctcacacccctactgggtccccgtctgcatcctccaacaccctcatcctgcttcctttacatagagttcattctcaaggaatcttttggcctgatagtgaggcctcctgcaaggagaaggaaagtcagtgtctgaatctgtttgggcggctataacaaacaccacagaccagaaaggaacctgcagaactccaggaaccaaaattgctgctgtaaaattggaggttgactaggaaaatgccttttcctatcaagtcacgtgtgctggggcatgagccactgcacccagccttttaaaaaactttttggccaggttgttttataggctcatgcctataatccctgttctttaggaggctgatgcaggtagatcctttgagcccaggagtttgagaccagcctgtgcaacatagtgaaaccccgtctctacaaaaatatacaaaaattagtcaagcatggtggcatgcacctgtgatcccagctactgaggaggctgaagtgggaggagttcttgaacccgggaggtcgaagctgcagcatgctgagatcacgccactgcactccagcctgggcaacagagcaagactctatcttgaaaacaaaaacaaaaacaactttcaaatccagctcttttggcatggcaaggcacagactgagagat

SEQ ID NO: 261 - DNA, 421 bp, Homo sapiens
aggtgaaagaaaactaaagaaataccagtgcagaaaggaagttctttattttcaggttgctcaagctaaaacaataagcagcatttcatggatgactggcatgtcgccttttactcctcaaggcagactcaagagttttcccagaaacagaggacgagccccttggccatgcagccctaagccaggctgatccagccttgtctcgcccctctctgcaagagactcgtgggtacaggatgattgagggggccccagcctccccagcagctgctgacttgcgcttggaaattcaatcctctcaaggcaagaatttctgacatgacatgggaaaagctgaagaagtcagtctttggggtgtgttttcatctaggaggtggcttgagatggattcatggcaaatcacaataaattatttatcaga

SEQ ID NO: 262 - DNA, 215 bp, Homo sapiens
gcaacagagtgagactctgtctcaaaaaaaaaagaaaaaaaagaaaagatgttctgatggtgatactgataaatttttagttggtttaactttttgggttttgtaaattaataaattaggtaattgtgtttgtatattatttgtatgtatagaattccccctcataatctattgtactgtaataaatctgctaaaaggttaccttagaaacatta

SEQ ID NO: 263 - DNA, 445 bp, Homo sapiens
cacactcacaaaaatatacaaatgaatgaaaatggttatgacccacccatgactgcagtgggttcactgtcatctgatgtgatctataccacctgttcctatgtgactgagaggaccactggccatccatagcctgggaggttacatcatcactttgcacctcacactctagaaccagataaggaagaacagtgtcacatgagggaaaacttcctagcagttggagatgcccaacaatgagtgatcacattgttttaaaagtgagactcccattgctgatcaccctggagatttctgcatgggggcaccctgaacttgaaaatctctgaagtgcctcgcaagattcagggcactaaggtccaaaggagtgaagattggcaaactgataataactccccaaatctattacactgacatgtatcatcaaattaataaattccataaa

SEQ ID NO: 264 - DNA, 2226 bp, Homo sapiens
ttggaaaatcctggaaccttgggaaggacgaaatgaggcccgcaaactgtgtctggggacctgtggggtggtcttcatgaaacgcccgccatggaaggctttcagctccaagaaaggcaccggcactcacacttggggggctgatgattgccactgtccaggaggctaaaggaagaaaggcaaccaccatctcttatgaacaggacatacatttccaagacaatgggtccagaccagaagtgcaggctgtgcccccagaacacatggaagttgcatacaaacgcagaattagaccacatttaaaacgcggtggaacttggctgatttgctccctcttggccgtccatttgaagtgtgcagtgaggaccccaagtcctgatctcatcattcaagagatgttaaaatgcctgcggtgaatctgactttaatttaccacgactgctaaaacagaggctttggaaacgaaagcagtagcaagtctcccatgtgaggccagagctctcgaggggcatttagcagcagcagattttacgtgtatgaatccaaaaaaattaatgtgtcttaaatatttctagcaaccttccaggttcccagttcatggctcagcaggagaaaggcaaggggctcgttcattcattcattcactataaaaggattaaaatagacctcggtttttctggcttcaacccttgcctcctttttcctttttcttttttcacccctgccccaccccctacttttttttgttacctccccttccgtgaaccctgactaacagacaacccacatgcttataaaaacagctcttgaaagaacagttctgacagttactggaatgagattgctccagtgctcccaagcaggaggcataaaaaacccagagcaatctccagctgttccaaaggcagattgtacagcagttagagatacagaaaattgcaacctccaccagaccacaaggacaggcccccactcttctcaatctttgagacccccaatactgcttcatcttggggagtttctaggtcttcagatctagattcccatcagttgaatgaagcctttaacctgagtttggatcacttgaactattgatttttccctgacacaacgaatgtgtattgaccatctcctcttgccaactacttatccaggtgcttcgggtatgttggggctcagataacaatatgccaaagtgaaaaactcagaagcagcctcagaagcaaacatttatctctgaccttctcctgctctcttatccctcagttcctttctcccgcaaggcaggtcatagaaaccagaaccccctttccccaaagccagccataaaacctaaaaaagccttactctaactttccctctgcctttctatgtaaaaactggccataaagaaattatctgacttaccttgtttaggtcattaggctgccattccagagaaggaggaaatgcattctcagagaagccaagaagaatctaaacaggccttgctgggcttcccagctcagtctatagctagcattagatgttaccctttctgcccaatcatatttcgacacaattgtccagactttgttgaacctaagcataaaaatggacagttcctctgttatccttgagtcttcattctgaaggctcctgtgtatacacattaaagaaatttgcatgccttttctctagtctgccttttgtgagttgatttttccacaaactttcagagggccaaagggaaagctctctcttggcccccacagctctatcagtgagcagagtaaagaaaagacttcctgctctcatgcagtctacaacctggccatccacaaaaccacgggctgcctgcttttggttgggacagtggttttatgtaggggagccataaacgtaatgattgaagtagaattctaagtttctagacccactgcccattccccaaatattgtttatgaccataatcctctctctgacttcctattttcattctaaattggaataaatgacttggtctttgccaaacactgcgtgtttcagaaaggacttccaaaaggactttccagaaagtaccagactcttaggaatcgcatgaggtgggagattaaaaatacattcttaatttatttgataggagcaatgggaggtcaaatagcttactgatttctctatgtctaagtcaccaactcattgtgtttgctgagaattactaaaccaataaatgaagtactaccggaa

SEQ ID NO: 265 - DNA, 1952 bp, Homo sapiens
ggaaagcggagcgtccgggacgcggcgggactcgagtgtttcggaaaaggagcgtctccccaggcggtggttgtcttcactagcgatggggtaaaaggaggacgcaatacctggttcaacttgagcagacggagtctcgctatgttgcccaggctggggtgcagtggcgtgatctctgctcactgcaagctccgcctcccgggttcacgccattctcctgcctcagcctcccgagtagctgggaccacaggcgcccgccaccacgcccggctgattttttttatttttagtagagacggggtttcaccgtgttagccaggatgatctcaatctcctgacctcgtgatccgcccgcctgggcctcccaaagtgctgggattacaggtgtgagccaccgcgcctggccgagcatgttaatttaagcaaatgaatgtccctgggaatgatcttcaaggagaattaaagtgggatagagaagtcatctatctgcacctgtgtctgaaccagaatgacgaggcacttccatgtcagctagttactggagcaggcggagtaaggagtacccctgggcttctgccccgaaaccaccacggctacttcaaaacaatattacattaattttcctgcttgttcttgagaagcactggtttgaaaaattggatggggtgatacatgttttaatcagtatttacaaggctccttaatcacttcatcagacaattcattgagcacctactatgtgccaggcagtgtaattcattgagcacctgctgtgtgccaggcagtgtctgaggcacttctagctattatttcctaagggttccagcagcccatggataaacttcaaagagtgtaagctcctaaaaattgttcgtattttctgcacatttttgtagttttggagaagagagttaatggagttcttgccattctcagaattatttgatccctttaggaatgagcatctctagcctctgcctgttcatctgggacaatctgcacctgggcgtggacctgctgcttcagatcagtaggtatcagaatgaactcagttggatggggcagttcaggacccctggcctccttttagtctggaccccactctcattcctcatattctcaattcactctttctactgagttactatcctagtaatgacaatgcctcctatcatctagagacttggtttgatacaatgcattcacatacaactgctcgttttgatttctataactggggaatacagaaagcaaatatgcggtgcaatggaggatgtctccattaccccagataactccaaaattcttcacctagttaccagtgcaggaaattcgttcgaaggcagaaatggaaaatgaataagaaacaatttggatgtgttccaaaaatggagagttgtcaggcactatatcatacaacctgaaatatcaatggtgaagtagacagttcacctccacagggggcaggaggttggacccagggcaatggatgttttatatggatggttaaccggtctgtggccatgaggtggaaagctgtgtacacctgtgaagccatcatcacaatcaagttagggaacatatccatcacccaaaaaagtgttctcatgccctttggtaattcctccctcctaaatgtccccaccctaccccacatcccagtttctatgcaaaaaccgctgaccaactttctatcactatagatttgtttgtattttctagacttttatataaaaagaattatactgtatgtacacttttttgtctgtttttttcacttaacatatttattttcagaatcatctatcttgttgcaggtgtattcctttttattgctcagtagtattccactgtatggatataacacaatttgtttatcattcacctgttgagggacattatacttgcttctaaatttttactatcacaaataaagctgctgtaggcattca

SEQ ID NO: 266 - DNA, 566 bp, Homo sapiens
ctttcgcgtctgcggtgcccggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaa

SEQ ID NO: 267 - DNA, 2508 bp, Homo sapiens
ggtttggcttgaaatgtcatatttcagaatgtgcatagaggccaggggtggtggatcacacctgtgatccacctgcctcggcctcccaaagtgttgagattacaggcatgagccactgcacctggcctgctcagtgacttctaacattgctgctgtacctgggtaaatacttccagtcatatttaagcgggcttggagttggcaaaatctctgagagagacatcttcggaaagcctccatgctggacttagtggataaagtttccaatgtccagatattttcagctggtttctccttggtataggatttcttctgcattctaccctgcacatcttaatgataaccctcatattttggctaagcatttgactcccctttagaattgttctaacttgtttttaacagatgtctacaagagattcccaccaggatcctgcccatgcaatctttgagactttaaactcactccagctggaaataggaaccaacttaacccaagagactttggttcacatttaaccagtactttcctgaatgcctctcctaagtaaatggctctagtttctctattggccactgcactgccactaggattcctgcaagggatccgatgggcccagagcaggtagccaaccacttctctgttggatggaatgcaatgctgtttgccagcatgtttgagccagtccttcaagatggattctgagtgactaactggacctaaatttaaatagcacaaagcagccatttgctaactagatttcatacaaatgctctgagttcctggaaaacccacactccttaactttgggactttcaagactcacctaaatcaatcaattaaagctcacttgtgtcagctaatcagggatcagctgtattgactaatgaaaactaagcgagtttcaaattttaaccatttatttgtgtagaagacttgattgggagcctgggtatgaatacttgctataaaatctgagcattccctttgttctctggagcaaacaatgttaagttgttaactctctgtacctttctctagaactggatggaaacaactccatctgaaatgcagccctaataccagggaactcctacagtaaagcgctaaacaactttattactctaaccaacgtttatgtccctaatcagcaagaagtagttagaatggtcatcatccctttccctcaagattgaggaatggacataaaaaggaggggatttgtaactgctccagactgatctgttgtcagaaaggggctcttgaaccagaccatgaaagagggttcttggatctcctgcaggaaggaattcaaggagagtcacagagtgtagagagaatagacagtttattgaaagctactcagttacagagtagggcatcctccaaaagcaggaggaggaatgtgctgtctttgttttaaactcttcttttataggggtttaatctatgtaaaacctaagctatgtctacatgtgggtaggctgtcagtgtgacaaaatttagtattttgttgatataaagaaacttatccttgtcatcttagtgcataagtacatcaaagtatgactttagctaccttaaaagcatgtattgttatgtgatattgggacatctggacattctgctgtcgtaggagtttgtccttgcagcattactaaatcgcttccttagctgtaaacatcttataatcgtaggtcataactgtcaaggaagtgccttgctagtttttagatggagttgattttaaaatagtgtcactctggctttcctatgctcctgctttcctaacaaatctggttcaactttttttttttttattcaacataatcttttttttccatgctacctcatttacagagtgcttcctatagatatggttggtctgtatgtttcatttttcagctttgattcttatttttttgaatcacacatgctttatgggggcttccactaccatgagccatattttctgtattaccagcaagatgtttgggtttgttttttgttttctttatatttcaaattttattttagatttaggaagtacgtgtgcaggtttgttaacatgggtgtattgcatgacgctgatcttacaataccaatgatcccatcactcaggtagtgagcataatatccaataggtagtttttcagaacttgccttatcttccctctctccctgctctcttaattcgaagcctatttttcctatctttatgtccacatgtttccagcatttagctcccacttatacgtgagagtatgtggtatttgtttttctgtgtctgcattaatttacttaggatgatggcttccagctgcatcttttgttgcaaaggacatgactttgttcttttttatgactgtgtagtattccatggtgtatatgtaccacattttctttatccagaacactgttgataggcatctacattgattccatgtcttggctattgtgaatagtgcagcaataaacatgcatggttcaacttttatggtaacaaa

SEQ ID NO: 268 - DNA, 691 bp, Homo sapiens
tgcggggtataatctcgtggtgcgccgttttttaagcccgtcggaaaagcgcagtattcgggtgggagtgacccgattttccaggtgctgtccgtcacccctttctttgattaggaaaggaactccctgaccccttgcgcttcccgagtgaggcaatgcctcgccctgcttcggctcgcgcacggtgcgcgcacccactgacctgcgcccactgtctggcactccctagtgagatgaacccggtacctcagatggaaatgcagaaatcacccgtcttctgcgtcgctcaggctgggagctgtagactggagctgttccttttcggccatcttggcgcctccctcaggtctcacagtttggaggatagaatgggaaaatgctgattgcaagttatttccgacatccttgaacttacctcccacatgtgaatcacagcttctactgcatgcccactccttttgcctaaatatgcagttatcatcatacatccagaattgccctctgaaataatcacagactcccactggcacaaagaagaacacatcacctagtcttggaaagaggaggaagtaaggaaagtcttccaggagcccgtcagactttaagaaaatggcatcttctacttcctgttccttgggatgcttactcttggagcacagccaccaagctgtgagaagtgcaatccatacgg

SEQ ID NO: 269 - DNA, 1676 bp, Homo sapiens
gcctctgggaggctgtgtgcacctcagtcaccacagctcacggccgtccccagttgagtcccccttctgaggacaagtttgaaactgggaaggagacaccccctggttccgccagcacctatcccactgatagtgatcccctggcctccccgagcctccttaggcaatggccactggtttgtagacagagagtttcttgcagccttgaaaattttattccctaagtggggacagctctggtattactgcttctttaatttgttccacaaaaattatgctgaaatggacctgaatcagccctgggtgtgcttctgttggcgcctgctgctgaggcccggcctgcccatcggcctgtagtacgccatcgaggtcatcatggagccagccagcttctcttctcatcaaggaggcagagacccctggtggaagccaagagtgaccgaagagggcttgcatcacgtcactccagtggttccctccttgtccaagtcctcgttttaagggcatggcccgttggctccagccgttggcttctgttcagggtccttgctcccatcagaggtgtttgattttgctcctggggctgcgatggagaaccttttgtggcagatggtgctgcctacatctcattggttctctgtacctgtgcccgttgcgcatgttcacagacaggagagtcgccagcaataccttggcagcctttaaatgtgaaacgtctgttacttgcgctggaggcagaggctgtgcagggagcctgcttctaatcgtgggctcccttatctgttacggttccctcccctcctgttctagatgctgattcgttttctcactggctggttaattgctgtctacttaggcctccaaggccataactgtgcaacattttatctgagaaggaaggaaggtcagaaagtgatcactggcaccaccactgtggcattcctgtcacaccaacacagaaattcacagctcatactgttctcacctgggaaacttgggaagggctgatgagtttggggcagatcctgaattgcagccacacttggccttctagaagctgaagttgtgccctcaagtggtcctaagtagaagtccacttgaggtatttgctggcacacaccctcaagggtggttcagaaggtcctgaaacctaaggcaaaaggctgctggggcatgaacagaacagaccgtctcaggggcagccatgtaagtggcaagcagggctggtctccctcaaggtggttcttcattaagtaaagatggcttcgtgactagtgtttagctcccagatttatatttgggttaaaaactaacttttcaatgtggcagtttcaaaggattacttgatgcaaagtatgtttcctttcaaagggatcttgacgtggtaccaggactgagtcatgatttgggcagaggcagttaacactgggaagccctgcccctccctatgcccccttcactccggggaactgaaacctactctgagtctcacatctctaaacctcagtgctgagacctatgcagtgggactaatctcatcaagaattttcagttgaggccgggcgcagtggctcacgcctgtaatcccaacactttgggaggccgaggtgggcggatcacctgaggtcaggagttggagaccagcctggccaacatggtgaaaccccatctctact

SEQ ID NO: 270 - DNA, 464 bp, Homo sapiens
gcatgctttttgagaagtgtatcatctaggaagaaaatcaaatggagtattggtaattaaattgtaattccatgaaggaaggaagtggtgcaaaagatgaagctaactattcctgtttttctttttaagagtctgcaattcataatggagctactgtactggctattggaaggaggagattctgaagataaggaggtaaaacctgtttagaaattaaaaatgagttacgatttaaagaaaattcagatgactcattgtgagtgctagttctcttgtaggatgccactggaaatgttgaaatgaaaaatattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgc

SEQ ID NO: 271 - DNA, 314 bp, Homo sapiens
acagaactctttcttgatttctcttttgcctttacctttggtctcaacacttggactggtcctgtaattttgtttctctttttgcaatccctatccagaatcactggaggtcaaatgtctttgccaatttgagtttttccacttgaacaagaaaagactgtcaagggaaagccaatcaatttcacaatgtttagatgctgaagatacagggcacagcttccttcttgaattgcttgttgtttacctagttgacaatctactgggaaaaagaaattccttttccagaaaaggttttcaccaatttcaaggaatcc

SEQ ID NO: 272 - DNA, 549 bp, Homo sapiens
aatcaacactccactcagacaatgcccagacctccagaaaccatgtgtcaagctcggattgccttagacagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccaggaatccaacttgctgtttgctatcacatgtgctatacatgctgttgatgaaactgctaaaggggctgaatgtgactgacgtctttggaaggatgagacttagcgtgcctgtacagttgtgtccaaatgctgtcctcatctcccaatgaaaaggtattgtaaataaagagaaag

SEQ ID NO: 273 - DNA, 893 bp, Homo sapiens
gcaaagtgacttccaacaagacaggggtaaaagaacctgagctagagtccagacaaccaaatctgttaaaggtagaatatggtgatgggtgctgtgcaagaagaaggagggaagaaggaagctgagtgtgcagcaaagacacctgcagggacacatagaaccaggcatttgctgaaggacacctggattgcacaaccagcggctaacttgcatgaaaaaacattctaggtggttttgcttaatgttggtctctccaactgtgctacaagctccatgaggtgaaggaccaagttaattgtgtcttccatggtatgtcccagtcctgccactttaggcattttaaatatttgctgaatattgtttgaataaataatttgtggagaattggaagagatttgtgggataaatatttttatatggcatgtggttgaacctgcatatgcttttctattttaacaatattgtcattgggactgtagaatttgactcataaacatcactttgcttttcttggaattctaattcatatttacagtttcaaatgtcacctctcttttaagttccacgtcaacatatttgcctaatccttggatgtcctgccatttgaacttgaaatgtctaaaatctaatttgtcattttttaaaactgactcaaataataatctcacgtgtttcctatgttctaggtcagaaaattgtacacaacttaaatttttccttttgcttcctatgtctgttcataactatatcttattagccatgaagttgtgtttttctgttcctttttatattttttgcatattcatttcttttccatccctgtcctggaagccctgactacctgacaaccactacatcctggttcccttggctttcctttctcttctttccag

SEQ ID NO: 274 - DNA, 534 bp, Homo sapiens
cttcaatccagaatgattgctaaagctattccagcacctagagtcaaataaaaatatcccgaggtgggaaggaaaacatttgtttagggaaacattaaaaacaggagagtgtgtgccttggagccagagcccagagccctgctgatgtcccggggcagaaatagcccgtttcatcatcggctctggacgaccgccgcccgcattcctcgattacagcgggtatcctgatgcagaccatccccagccagaaacacagccgcagaactgagcccaagctccagaccaaaaactgagcccaagctcagggtctgcatggcccagagctggcatctgtccgggggactggcccaggcaaagtgaccactgtcatccagtccaggagctgtgagctgcatggaaagaatgtgaatgaagacacaactctaaatgtggaaccatggacgctatgtgagccagtgtgctccctagccgtccagaaaaacaaggcccacttgtacattctgcaagagcataaataaagctgtcctcaggcgg

SEQ ID NO: 275 - DNA, 421 bp, Homo sapiens
gctccatttcctgtggtctattcttgcacagttaggtctacaagccaggttcaaggccaccaactgaggcacctgtcccgagacaggaccattctaatctgccctgaaaaggacatcccattgatcatactaaatttgtggatggatacctatctgttgaccagaccctccctcttcaatgaaaactgcctctccttccactccatctgtgaggcacccttggatgctgacatgtgcttacataggacttcctgtccacagccagaattagccagaattcactgacccatggttggactcctaaaatactcaagatgagagacatgttacttttctttactatagtaactatcaaatgcatcccataaccttatgttgtaaatgtcaaatatgcacaataaaatttatttgaaaaaataaa

SEQ ID NO: 276 - DNA, 578 bp, Homo sapiens
tgctgagaggggtttaggaacaagttgaggtggccctgaatgaaaaaagtaaacaatgtttgggcagttttccagattccccaagaatgaactttcacagagctttgtgtgtgtgtgtgtgtgtgtgtgtgtgtgtgtgtgtgtgtgtgtgtgtgtgtgtagagagagaatattactaaaattaataggataccacttacatccataaacaaatatgtaaacaactcaaaaacaaatccagtgggttttttttcaaatgagctctgactttttaatgccattgaatgttttctcatctattagtgtgaattgttaagaactggctgttctcattaaagtacaaaatgctaattaactttaaaaagcttcagaagatataatgtgaaaaataaaagtattgagtaagaatgcaattctattaagcaatatatatgactggacagatgtgagctaaattaccagttacctctatgtgatacaattatgggtaattttaattttcttcattttgttttactctgttttcaaatatcctacaaatgtgtatttttaataataataaaaataaatattgttgc

SEQ ID NO: 277 - DNA, 1939 bp, Homo sapiens
gtttaaaggccatcttagatgctgaaaactctgagcacaaatgaaagcgacccaagaaggaaaaacttcagagcctaagaataaaaaatggtggtagggttgggggataaactcgcccagagctgacttaaagtgctgtcagggaaggaagtgcctttcctggggaggatgagatggtccatgccgggtctggagctgtgggcgttctgatgttggatagcccaccctagcaggctgcagtgtcttaagggtagtggcatgagatctttggaagtatcgatacatttcctaacagtgagtttgagtttgttctggtatgttctgaatggatatgtggctcaaagattaacttagctaaaaataagtatattagatattagggaaatattgttaataaaggtcttctgtccctgttggataactttagaaaataatgtagacaactgaacgtagtggagatgatggcatgaatacagtcagggtttgatgcttgcttcctagaaacttcctagaaatagaacacatctagacatagggaaataaggttccaaagaaaaccttacacttttattcagattttatgttggcctcagttgtactagaaaagcgtttcagtatgtgtctcttggggaatctgcaccttcttggtcactgcacttcatagcccggcatatcactgagaattcagaaatctgactctttacccagggacgaatacatcgttatgagttcaggtgcactaaatacataggaacacccagagaaaatgagcccgaaacaatggttctttttattttggaagtttcagacaaactctttggaaaattgaagaaatctatggatccttttcctgggaagactgtacagacatacgtattcgtgtggtttctgtgggtgtagggactggccctggtcatgtgtcaggaagccccaatccagaagatcgtcttcattttaccttggccggtgatctgactctgttctcgcgcccatctgtggttgattctctgtcgccttggaatggagcatcagatcttgaaggtcgctcattgcttttccacgcatagaactgagccacatggcaagagcttcctaatgaaatggacggaaactctctgcaaagggctgccccagaagcacgggtgatagaaatagagtccaaggcactaaggccgctgagccacagtcctcctaggcaatgcctcctgctggcttagtgggtttatttcataagttgagtactaatgtcctgttttttaaatgaacatatttcttctaacatttctaacaattatgaagattttctccctaagtgtgactttttcttatgtcttggggtatcagatttacagcgtaacatgtgtacttcaaattgtagtagtgactggaaatttaggattctgttgtttcataacacttaaatctgcagcagattttcaggaaaatggtcaagattcacagataattccttccttattccttacagattttacaattgtatggttatttctgaatttggttaatttgtttataagtgtagtggacatttaacagaacagatgcacccgattatctgattagaaatgtgtttcaacacacgggtccctttgcgtgtttccaatctctgttttcggatctgggattctccacctgttacatcgttcactggaactttcctacaaaatacagcctcgctgagaggcgcatcgtggaaaaatgaagcagcctgaagaaactctaatattgggaccgagtggagagatggaagagcatcatcagagtggtgccgccgcacatgcgggaggcgtcccaggcagcattgctctttgtacatgagacaggataccactgtcttttatgcattagactggtaaccagataaaataaccttgtaaaacagatcttttatgtaagaaaaatacaactctcacctcgcaaa

SEQ ID NO: 278 - DNA, 1633 bp, Homo sapiens
aaccttctggtggcttccccttgctcttggaatgaatcccaggggcctgcagagccacagggatggccctgcccacctgctcggcctctgccccagaagctcctcctcgctcctgcggggcagctacagacacctggagtgcttttctgcctctgcggcgttcttagccttgcttgtgtagatcttcctagatcagctactgtgctagactgtaagctccctgaggggcagctgcagacacctggagtgcttttctgcctctgcggcgttcttagccttgcttgtgtagatcttcctagatcagctactgtgctagactgtaagctccctgaggggtgcctgctgagctcccctctgccttttcccagggcagtgatggtgtgaagattggcaatgatttgttaactgtcctaggggagcccctagcctgcagtaggcctggagcaaagggaagattttgaaatcgtgtgtgttgaaatgagtggacccagagatgaatgagacaagctccctgcccttggaaacccaacaaaagagtgaggcgtggagaacagtttcaaggaacttctggaaaagggctgtgaaaatcatgctgcgggaacacctgcatcattgctggcctggaaactgaggacggcttccgggagggggttgcctgggagatgcgtccatagggcctcctggggagcggatgggcgcggatggtggccaagcttgtcaagggaaaatggccccagagaaacgcgcagtgggaggagataaagaagaattctactttttaaaggtttttcttagaaaagcaacacgtgctcatcgggaaaatggcagtacaagtttgaatatcgtaaagcgcgggtctcacttcttcctgccccactgtatccttgggcgagagcggcggtggcctcgaggataatcctgggacttgggtcggactgggctggtgaatcttcaggacacatcggaggagggcagctttccaaggttgagccgcctgggaccgctgtgaatggaattgtcgacactgccccctggcccggaatgcctccatgttagccccctgctcatctccagctggtctcccatggtgtagggtaaaaggtgatggagccggaagagcaagggccccatagtcagcacacgggggttcacggcccagcttcctgtgtcttggctgagcaaccttgggcaagccattctgcctctctgaacgagctccgtttgccagctgtgaagtgggggtgggaataagacccactcacctggtgattgcgatgaaatcagcagatatgaaagtgcttttagactgcaacgtgaaggtgttaaacgtgggtctgtcactagagatgagggttgacttgaaccacaggaaccacccccctgcccgggctctgacctgggcacttttgtcttgttgcttgtccccgctggggaggcgatctttccatgcgagagcgtcatgttgctttttgcccccgtaaaggttgacgaccactatgctgactacgccgcctgcatcagccactccaaagagtccgctttgataccttagagtcttaaaacacctgctgtcggaaccgtacaattgatttcaattaactttgaattttttcaatgaaatgactctgataat

SEQ ID NO: 279 - DNA, 1940 bp, Homo sapiens
gaagtcggcctgtggccggccatgttcatgagggcgcgtcccttggcacccctgtagccgctatgtttcccacgcccgtggcaggcctgagagattatgtttgcggggggtgctttttttgtagcttctgtgttcgccatatttgaaaggggcagacggccatgttcgtgaacggcgcttcccttggtgcacctgtggccgccatgtttgagcgaggaccccgtggcaggccaggaccgtttctccggtgctatcccagagcatggcgcatccactcattcactcaagggaaaggcctgaaagtaaaattgtatcaacattaggtttggctaatgttgccattaggcaaacctaattttaatgaagccaggaggttctcgttttgggccttgactggacaggtttgagctagaaaccacttgaagtattgatcatccatctgatcatcaagtttttttttttttttgagttggagtctcactctgttgctcacgctggagtgcagtggcacgatctcagctccctgcaacctccacctcccgggttctcctgcctcagccttccaagtagctgggattataagcgtgtgccaccatgcctggctacttttttatattttcggttgagatggggtttcaccgcgtggccaggctggtctcaaactcctgacctcaagtgatccgcctgcctcggcctcccaaagtgctgggattacaggcgtgagccgccactcccagcttgttcatccagtttttattgagcatctattatgtgccgatattgaggtagactctgggagtcacagcagtgaatgcagctgcctggatgcctcgtgagggccggagcctcactggggagatggacatgaacagcaaatgcacagcgaggaaagccaggggtctgtgcggggatgctgcaggacacgagaaccagccaagacctatggcccctgcagccaccgagggctcgagagcgcccctgtggacttggctgggcccttcatggtgacatccaggaatgcggctgagcgcgggtgttgacctcgctgtttgctggaatgtttgggttcttggaccatgtcagtgacggctgtgtcaccatggccttgctatccccaggaaaacctaacatgcaccccgcgcctgtcctctgggactcccatcctcctcctttgtctgacccctgagaggcttaccgtttccccagggcagccccggctgtggccctcggccctgctccaggcggccatgtcagtgtcctccctcggcgctcccaacaccctacctggctctgcgatggccaccctggactcctaaacaccccagaaagggaagagatttaagaggaaccttgattcctgccattctgcgcagtcgtgggtccctcctccacctggggccctcaaggggatttctgtccgcactcccagccagcgacccctcccagttcctgcagctggagcggccctctctcctgaacattcgggcacctgcgtctgtcactgcagccagagggctggagtgtcttcggtcaactcgccatccctgccacggctggaggccacatgtcccagaacctaccttgctgggatgggggttggggtggcagaggctgaacgcgtgtgaggtttgggggaggacaagcggagcggggatgtgtgggaggtcctggtgtccaccgtgaggatggtcacaccccatagctttgttgatgctgtggctgtagcaggcccagtggctccgctgagcctccctagcaccagtgcccagtgaagtgtggggggctggacataggtggcctcagttcctgggactcccccaaagctctggtttcccccctgctcccaggcttcaggtggacgagttagtgaccacccccactccagacctccctcccctagccacccccacagttataaaaaccttcattctcatatggaa

SEQ ID NO: 280 - DNA, 687 bp, Homo sapiens
ttaccgtggtgtgctctttccaccacgcggatagcataggctgacatgtatgataagcaaccttgagagcaaagggaatgcattgcaccatgaatatggagagtgagctttaaaatagtatgaaagacaaatgtttaaaggtatacatttctttcagagaactttttctctctctttctctctctgacagtgtgtgtgtatctcctgtgtctctctttccctctctcacatgcacacataagtgcacacacacacttctcttggaaactgaaggaggcaagaatatgatgccattaacaaatgctctttggtggacagcaataataacaactgctaactttcactgaggactacttatgtgccagataccatgtgaagcgctttgcttgtattagatcatcgaaacctcagaaaaactctataaagtgggtgctaatattttctagatttttcagatacaatactgaggatcagggagattgaataagttgtccagtgtcacccctggtagctgagagagctggtttggatgcctagggctgtttgtctccaaacctgtgccttgcacccttagctctggttcctcccctctcatgtcatgtaatcagcacaaatttcctgaagtaaggctgcatgcatataacaagaataaaggaataaaaatagaggatgccgtggaatgggaga

SEQ ID NO: 281 - DNA, 487 bp, Homo sapiens
tatcagggaaacttaacatgcctgtgtttcgtagtgaacaggatatctagggttgagaattactgcgaacactgttatgttgtcacgtgagctggggctccatggtgatgcaccctgggctcccagaacaatgtgaagcactgagatgccctgcacctgggcctgggtcagaatcctggtagaggggtctttggcaaggacaggagaggacctccttgggattggactcagctgagcagcaggatgcctggttggcttgggagacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagca

SEQ ID NO: 282 - DNA, 273 bp, Homo sapiens
cccttccttaaaattgctacaagccactgaagagcatcttccttgttctatgtgtccagcttcagtctcgtcgctggacatttggttccagatctaaagcagcagagggcagtggccgtatgtggagctgttattaactgcatcaccttgttgtgaggatcaaatttgatggtgtttgtgaagagctttgcccagtggctggcagcctgtgatcatggctctgtaaatggaggctgccatcatcataatatcattatgaagcccctgatctca

SEQ ID NO: 283 - DNA, 383 bp, Homo sapiens
tattattttctaagactgggatagtgacagagcctggattacaactactctggactcatagtcctatgctcagactattaggctgccatgatattgcagagctagaattattaccagttatctagaacaaagtcactactaattctatttttaactagtacctaattcactgttatctttcagggacacttaaaagctccttagctaaactcattctatagacgctttacaacaagtaaagcaagttttagggctaaaatcacagagtctgaaaaagaggcttgtgtcctgaccataccgccccagacaaaaaaacagaatgagtacttcataatgtaccaaaaaagtctatctgcttatcaaaataaataaataaaaataaa

SEQ ID NO: 284 - DNA, 701 bp, Homo sapiens
aatttaaatcatttaattatttaattatttttattaaaaatttttgacttttagcttcaggggtacatgtgcagtttgttacatgggtatattgcatgatgctgaggtttaattttgtactttccttgctgttcctcattttcttcaattctacatttattaagcatgcactctgtatttttttctcactataacattgccagtcctccttcctttcctctcttcctccttcccttctctcttttcttccttccattcctttcttcctaactccctcctcttctctttcataagagtgaagatattaaaaaaaaaatcaagcctaagtgtgttgaaaacctctgagaaaaggaggtttagaaacctgagaaaaggaggtttagaaaccttagaaagaccacagggttaattttgtgacctatttttatttacattagggcatattaaaaacaaattcttttttgttaacattcagaatcagaggtggggagagtggtggaagggcctgtggacttacggatgctgctgcgacactctatgacctcagactgcaagtaagagccaatcccgaagcggtttgttgcagccacacggaacacatactcatttccttcgagaatagacgccttgatggctcctctggcagttcttgatgaccatggatgagctaatggctgtggtctcaatggtggcttcttgag

SEQ ID NO: 285 - DNA, 779 bp, Homo sapiens
caatgattccattatcagataatctctcagatagtgatgcctataatattgtttataaagacatgtccttgtctgttttcctttcatcacaggataatggaagtaaaccaaggaggtatacgtgtgggattgtgtccggaattggtgggttcttggtctcactgacttcaagaatgaagccgcggaccctcgcgcatgtatttcctattctgtctggttggcttgctgcttaaaaatcagaatacagaagagaagacagtcttgtggagggtcaaaggagccactgtttgtagttatttgggatctttgaggaaacccctgctaaaataacttgattggagattttccttagtctggaccaaaccttcccattattggacacagatggtcagctagtaatcaatcatctataattatgctttggaaaaacctcatgagcaaagaccctcgacttgtagtcaaagctacaatttgacatttcccaggattggacgaggccagtaaggtgaaagagtagaggcctgaagattccagagagctagtaacaacttcactgaagtggctgagatccacagtgtgtcaggaggtgtttctagagaggtacagtagatgggaaatgagaggacatgaattcagtaagctccttaacctcctgcctcatttatcaaatgggtctgatgaaagtgatatatatgaaagcacctggcataatattggtcagattgtggtgcttgatgatggaatggtgcataaataaataaacacgggctctcaatcaa

SEQ ID NO: 286 - DNA, 187 bp, Homo sapiens
acggtctggggaaaggctcctgtgttgttgagcctgccaagttgtgggtgcagcatggtaccaggcagcccaaccctgacctaaagtaaattcccggaagaagtctttcctgggttttgaatttgcagtaacaggtgtgagcattctagcagcagtttgatgatcatgtatgatactgcaaacagga

SEQ ID NO: 287 - DNA, 510 bp, Homo sapiens
gctgctctgtgcagttacgatgctgcactgccacagtaaccttctccctctgtggtgatccaatattctaccatatgtcagcaaaactattccagcccggccctttcaactctcccgaatctaagccaacagtcaaggtactatgaagacgtcaggcgtatggaaataacagatgggaaaggcgagcagagatcattactctgaactgtcttggatgtccctgggcaatgctaagctaacattcagcagtgtctacaagatgacacacaacatgttgaaagaatggagcggtgattcccttggaaggatgtgaaaagctttccaatctcgaggtgatatcagagctctttcccattgaaacacttggatgctctttctccagctatcatgctctcttttttccactcaagaaaagaagagaatgcaggttcccacagatactgcaagccccctcaagcttaggcagtggccctaacttagatctctcttccttctagatcaacacagctg

SEQ ID NO: 288 - DNA, 993 bp, Homo sapiens
ggattgggatattccgactccttaagggcctggcgcacataaggtgtgaccttttcattcccgttgttatggagggccacatctgccagagcctggagtctgcgaaggccgggacccggttccccggcccacagtgggggtgtgcaaacccgagagaactggattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaaagttctttaagctggaaattgtaaattcctcctgaaatgttttttcatgcagttaccatgaactaatactacaataaaggatggtcttgggtgtcaattcttgaaaa

SEQ ID NO: 289 - DNA, 608 bp, Homo sapiens
gccttgagcagcataggtgagcggatcctgctgggctcatggaccaggccacatggggtcactgagggtcagccttcaggacaggagggattcctcagggagacaacctgaatccccactggtccctccgtttggggtccctgacttccctcaacactggtctcttccactgagccttgtgagctcttccaccaaggagggccccctggcattgactggcatagtgagctcttccccccagcagacccctgggattgacgagcatagatggtgactgtggaagaagacttgctttgggaccgctggccccaggccagtggttgtcatccaggtgcccagcccttggtgcacttgagctcaagcccttcctggtgccctggcctcctgccctaagctgtgcgagctcttctgcccagggggacccctggccttaagtgggatagatggtgaccccagaggaagacgtgcattgggtccgctggccccaggccagtgtctctcagccatgtgctcaacacctggtgagctgaagctcaggcccttcctggcatcctggtctcctgcactgagctgtgggttcggtggctgagagagcttttgttgccctg

SEQ ID NO: 290 - DNA, 434 bp, Homo sapiens
atgctgcctagaaccctgtccatttaagaagacacccaggtgatacgcaatgcacaaaaagcactggaactcccagcagaacaaaaccttttccatcagcaaagcattttagaacctcaagctacactgttcccacctgcaactgtctaaggtattggaggtcaaggacagtccaaggccaagtcaaggaccatcaggacacagaggagtaacttctgaggcagcccccggtggtaacataaaagcttaatatgcatcagacaagtgccttcgctgtgagatgttggggaaccaagcccagtggggtggctggcgtcagctcagtgttccagaaaagccaaactgttcaccacgacttgccctgattttgccttcactgctattcaaagaggcctgaagcagttactgaaagcaattccaagaaattgagttaa

SEQ ID NO: 291 - DNA, 216 bp, Homo sapiens
aagactatactttcagggatcatttctatagtgtgttactagagaagtttctctgaacgtgtagagcaccgaaaaccccgaggaagagaggtagcgttttctcctgagcgtgaagccggctttctggcgttgcttggctgcaactgccgtcagccattgatgatcgttcttctctccgtattggggagtgagagggagagaacgcggtctgagtgg

SEQ ID NO: 292 - DNA, 652 bp, Homo sapiens
gtcttgctttctttaggtaaagttttacagtaacctcctttgtagtcctttgaagatgaggatttgagaaatcccaactcctaaagtaggggagagacagcagcagaatatgacccacagccagacccaaaggggctagcccgacccctgtatatattgtacctctctctctgcccacctctcccccacttctccccactgccccattctctcttatcctgcctattcctctcccctatttctctgtctctctctctctcacatacacacacactcactcacaagcagtacagtcactaagttggctaggtaatatccaaagcattctgattgtcctactttttgtaaattgaacttatttaagatattttagaagagatgagtcacgtcttcctttgacccttcacccataacacacataccattctcacaggaggccacatggtgcagtagagtcagactttgattcaaagcccaactctgtcacgtgacagtaggcttgagtttcctcatctgtaaaaagggaagatttcctacttcataaagtggttggagaaattaaagaaatagtatatgaagccttgcacataaaaagcatttgatatatattaatgcccttttgcacaagaggtcaagaattgcttgggttcta

SEQ ID NO: 293 - DNA, 575 bp, Homo sapiens
ctattctggagagggtgaagacgccaggaggattccagctccaggagccagccccgctgtggcccccgtcgtggggaggagaggccgggagcggcgcggtgggcagagtggggccatctgggtcccctgtggcttctgggctgaccctggcacacggggtgcctgcagatggctatatggaaagcacaggtgtttctgcttctggagaggccccaggaagcttccaaccgtggtggaaggcgaagcgggagcaggtgtctcacatggcgtgagcgggaacgagaaagacagagcagggaaacgtgcagaggaaatggttggagagcgaagtccaggcacaggggccatgagagccggaccccacgcagctgcagacctcgacccgaactgcatgcggctgaggacccccaagccaggcagaccccgacccagaccccacgcggccgcggacccccgacctcgacccaaactgcatgcggctgaggacccccaagccaggcagacgccaatccagaccccacgcggccgcggaccccaacccagacagaccccgacccacccgtgcagcccccagc

SEQ ID NO: 294 - DNA, 312 bp, Homo sapiens
ctggatggtgcctctcaaacaaaagtccaattcccatgggatgccttctccaaacagctatatttctagcttctctccttccccttttagacctaggactgccaaagcttccctattgctgctagtcatggagtactgcactaccgcctgtagtttcccttcactctatccacgcatttcatgaactctcttcaaattactccatatgggtagccatcgacttcttaccaaggccctgactgagacactttcattcttttaaaaatatccgagtcaactaatatattaaaatagaccagcatctcttctcaa

SEQ ID NO: 295 - DNA, 248 bp, Homo sapiens
ggacctttggcctgttaaaggtctgtaatcttggtgggcgatacagagttatgtgtgttcactgtaagggcagaccaacaagaactttttcctacttttgagctacctctttttaataggggtgattcttccagttgctggagagaaattgtggtaactggagtgagagagtaggaacagggcatgttcagggtatcagggccaagggtcctaaaggacttagcttgtgttatggccactgagagatg

SEQ ID NO: 296 - DNA, 209 bp, Homo sapiens
cctgcctcgaccttagcccaatcagctctcctttcctctgctttacgggggtccatctgggggatgttctcatgcccattccaggggaggtggcacgtacctgcctcttcttggagtatggacgagtcgaaccgggcacaagcatggagctgcgggtgagtcccggctggcgctggcgcggcgcagtgagcaccagctgacgaagaggg

SEQ ID NO: 297 - DNA, 474 bp, Homo sapiens
atcatattggaagaaacatgggatattaatacattggctgcatgtacagagggaagatgatgtgaagacacggagagaagatggccatctacatgctaaggagagaggcctggcctggaacagatcctccctcatgatcatcagaaagaaccaatcttgatgacaccttgatctcagattttgagcctcaagaaccatccaggaggtacatgtacagctttgttacctgggtacattgtgtgatgctgaagtttgagtatgaatgatcctgtcactcagctcccacgtgaatcattcaagagttaaacaagagaaatggttcctgtcagtgcaggtgatgaaagagatcattacaacataactgaaggtcaagacaaggataaataccagcaaaatcatgtaagaatgatgctatcagggcttatgcttggcctactgatcccagaggagagaatcatagagaattgtggaatt

SEQ ID NO: 298 - DNA, 3419 bp, Homo sapiens
agtcgcctggaggcccgtttgtacagtggaaaagtagaaaatgagactctaaaaatctcatcagccaaatacaaaacattctccttgctgctacgtggcggcctccacagagccctaaaaccttgaagctcggagacctatcttgaagggggagcaaaggcgggatgcgggaagtttgagtccatggaagacactgataccctctccattcctgggaaccctgagcctgaaggacccggcctgaacagcggaaggactgaatccctgtgcaactcatcggtgatggaacataaagccatggtgccctcggtccccaagacgggagggatggggaaggccctgggtgaaggggacaggcggggaaggaaaaggtgaagagaaaggtgctccccagggagggggtagatgtgcccaggacatgggacattggcagaattttaactccgagcacacacacaggcccacggacggcttcccgtctacctgttccttacgggtgtgctgtgccggcctgggcacctgcctctttccccatgccaggtcacttgccgtctaccctgtatactgccactagttctaagcctcccagaacaccctgatcagggccctgtggcctctgttacaggattccaggcctagacgtctgctcgattggaaaactgcccccagagatgccgtggctcagagctcgtcctgctttggggtggcccctggagtctccgcccctcagcaacccacatggtgacaggcacccacatccgctggcctcaggaaccctggggccaccatcccagcgctgtaaggagctggcagtttcctccccaccctttcggcctaccttgcaggaaccaagacaccaggtgagccgccccgggaaagagacctgtgctcccacggcgctgctcctgcgcccattcccagccactccagatgcttcccgtggaccagctgcactcccggcgggcatgcctggccctccgcagcctggcccatatgatcttcacaggcaggcccctccttatgccccagccccctctccagccagctcattccagcctcccccactgctgctggctgctgctggccagaaggctctccttcctcttgcaatccaattcctactctccctcaaggtccgcctcctccatactgacttctcccctgctagctagtggtgacttttctctaccctgattcggaagctgcctgtccacatcacccctggctgggctgaatcacactctctcctccacctccttcaatcatcccttccccacgtctgtctgtccacccaaggttgtccaactcccatatacacacccccacaccctccaactatactccaggctccttgggcaccagggagggccacctttccataccccaggtcagcccccatgcacatgcgcactcatgcacacacacactctctcacgcctatcgactcgggccacctgatggctctaagaccagaattcccagcaaaaccattcaggacacacaagggggagactgataaacacagggaaccagcagattgaggccccactccccgagactgagaaaccttcccccagagccaaaggattgccaactgctgcaccaggatggtctcaatgagcccattgtcttggactaaattacagggtcacaaaactggcttgggagacagccgcagaagcagctccagatggaggcacatgggggcaagggtggagttacacccagagacccaaggaaggggcactaacaactttcatagtgcaaatggtgacagctgtacaacgaacacaaccccaaaccctggcctcccctcccgccacagggctcccgttgagacacgagagttcttccccagaaatcccactgggggcccgacactttctgttaggaactgagagcagagacctcgatcccgcaggcaggaggagagctctgcacaacacagggcctctctccataagggcttactggaaagtggtcagaccggctaagtcgtgccacttggacatttgggacaaggaaggcccctggaggagcggtcgcagggaggagttgcaaagaggcaggggcagggaggtcacattcactcggggactgcaggaggctcaacggaacacagtggacctagggagaccccagtatgagcatgtgcccaaagatgtccagatgaggaggtgttgtgggggaggggggcgggaacagcaagccctcccagctctgcagacccagacctcccctccctctgggaagcagggatgcaaagggatagagcctgaaaaagggctttcaccactaagctgacaaagtaactacgatgtttccagctcacactctgcacagcgccagtggccactggatcacaaccccctcccgtcccttcgccgccccacaccctcctcaggcccagccctgaagaacagccactggcactctgcttggcgtccagccaaagttctggtcccccaggaggccccgcctcccccactcagatagggctgaccccaggtgggccgtgtgggcagctgggctcaggacacccagatgtcagccctggttctggccatggagcggggaggacctcaggctggtcacctcccagcttggcctgacacctggacagtttgctcatttcaacacagcctttccccctcccggcccaccagagggctctgcccaagtcagcctaggagcctctccgaggggcgggggctccaggtcccggcagaggcaggcccgcccctcagaagccctgccccagagcgctggagaccattgtgtgagcttccccttcgcctgctgtatttactcccgcggacgcaggacgcagagccccagcaccggcagtcaagaggacgcaggaaagcgcacgcactcacaggctcagagacgcggacgccagacccaggcttggacagagcagccccgcaagtcccaacacactttgtaaaccccgaagacaggagagagccaaaatactctccctgcccgcacgcaggccccttctgtcccccacggcccgattctgggaggcggatgaggatatccccaggcctggatgggggccatgggacatcccactctagaccctgccacgacctgggctgtgtccgttcggtgctcccggcccacgggctgcacaacttggcggccccgaaactggcgtgggggaggggagggctgtccacccgagcaggacgcggctgtccactcagtcggaggtgaggaacgacctccctatcccgttgccgggtccaagcggggcccgagagccgccggggagagccaaagggaggggaccgatggatttcccagagtgaaactgtgcgtcctggagagttccgaggcagcctcgcgagccctcgaggaggtcgctgtcgcttggcaaacacaaacaacaataaaaggaaggaaaccca

SEQ ID NO: 299 - DNA, 1809 bp, Homo sapiens
cggaagccgccggggccgcctagagaagaggctgtgcttcggcgctccggctcctcagagagcctcggctaggtgtggaaacaggaagagaactagaactggaagtaaagcattgaagatgtgactgaattgctgcaatctcatgatcaaatttgaatggatgaggagttgctttttagggatgagcaaagaaagttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaagtatcttaaaggataagttactttattatacactagaaacatacacaatagctgaaaaacttaaaaaatctcacactgctgaatgtctctgctggctgaagtgtaagtaaaagatcatagtagtgccgctgttgagtgataaagcaacttgtcattaaagatgtgtgtgcagacatggattctgagttaatatctcatctgtagaagtatatatttgtcccttgctttgggattggtttctggacagcactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatataaatagttgttacattgtgtacttatattt

SEQ ID NO: 300 - DNA, 549 bp, Homo sapiens
gcgcaggcgcccagaggcgcacaggagacctcaggcccagactccactccccagctgtgaaaggactgctggccagacccccaagctagcccgccaggcctccatagagctgcccagcatggctgcatccagtaccaagagttggtgggagacgggtgaggtacaggctcagtctgcggccaagactccgtcctgcaagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacccgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatg

SEQ ID NO: 301 - DNA, 486 bp, Homo sapiens
gctgtttcccacactacaggccagcactgtgggctctcagtttattgggaaatggaaataagagggaaggacaaaagtccactgggaagcagactggacagaaaggaactctgagcagctaaactctgactaatcccagggtatacctgcgttttctcttcaccagatttttcctaccaggaagagcatgtgctgaccaacagacatgaatttcagcctggtagttacaacattcacagtatacccacatcactaagctgggaggcacattttgagacccagaatcctgacacctccatgccttcaaaaggacaaactgcggcctggaccagctggtgaaacataattctgaatcctgcccacagccttcggtggttttggatgaaaggccagcgccttgggagccctgcgtttgatttcaagttttaaggccggcactggtggagcaatgaatggtgaaagctctccccttaaaggagcacagtt

SEQ ID NO: 302 - DNA, 493 bp, Homo sapiens
tccaaggaggtggcagatcctcaggaaacacagggtgaagatataggtttggaaaggggatataactttccatggtcaaaagcaaataaactgaacatctcagccagcccatctgcttggagccctctgccttaaagccacatcactctctgagatgaaacaccagccagacagggtgaagacaggagcgagctccaggtttacaagtgataggatccctgtggatttctagttcagactgaaaatccatgaaatttagaataatatggggatagtttacagacatgtgaacttttactgtgtatgttttacttacaatgcaatacctaatacttccactgcgacatcagcaaacatccttagccctgtttgccactgcaccacagagcttttcatgcaaactaacattacagtatgatacaaagaaaactgtttcttcttaagatatttacaatgtgatcaggtttatttaaataaagtccattttatacta

SEQ ID NO: 303 - DNA, 270 bp, Homo sapiens
ttttgctggctttttaaaaaagattcttctgagaaagattaatacaagtcttccattactgacttaagtgaaataaattaatgtacccacagcttaccttttttgaaagaaatggttgagctttaggattaatgtccattaggcctgttcaacacatagatacttgataatttgactacaaaaaagtcttgttgcagtgagctgagatcgcaccattgcactccagcctgggcaacaagagtgaaactccatctcaaaagaaaaaaaaaa

SEQ ID NO: 304 - DNA, 195 bp, Homo sapiens
caaaaatcagtttgggaaatagagacacttgaatgaatgggttttgagataaaaatctgtcttgtcatcctcctgaggtggagcagattgcattttccagctgaggcaggagaatggcatgaacccgggaggcggagcttgcagtgagccgagatcgcgccactgcactccagcctgggtgacagagcgagactc

SEQ ID NO: 305 - DNA, 878 bp, Homo sapiens
tggttgaacggactcaccaggaaacgtgactttcgtgtccgacctctgctgtatcaggattcgattcttggtgttaaacaagacaacgctgaaggctcggtgcagcagccctgcaaaggagtggagccccaacccacgcagggcgtgtcttcatggcttttcctggccaatctgataccaagatgcagtggccagaagtacctgcacttccactcctgtcaagtctctgcatggctatggtgaggaagagctctgcactgggcaaggaagttggccgtcgagtgaaggaaggtgatgctggtggcccctttccggcagtcaagttccctatcaaggacattcagttctcggaaagtggtgaaggcacatgcttcctgcatggtgcccgcctctctccactctctagaaatattgaggctaggctgctgctgtatgtcagggctagtcccttctatgaatccagaataactctgaagaagccgagtaacaggcatgaagtgaagagaaatcgctgtaacaggaagacagcaaagcagatgctaatgaccacactatttaacgaactggaaccaacgagaaaatacggtattactgaagactgcacttccttgaacagagtgctcttctcagcaaatcggaaatgcctacacaaatcgctttacaagaaagactgtttcaaagcagcacctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaacactaatattaaaggaaaag

SEQ ID NO: 306 - DNA, 992 bp, Homo sapiens
aaaatctgcgctccagcagctgggaccgaggcatgagagcgttgaatcatgagtggcaccgttcgcaaaaattggtgtctttgtacaaagacagtgccacaacacaactcagtgaccatcgggagagcagcctcatgatgggcgatgctccatcagttttctcttgcgatcttttgcatagatcggtcccgccccgcatatggcgatgaggactcaagagacacggaaaacgttttctttctggaaaacatgaaataggctttgtagatggacaggaagtcaagggacaagcggtgcgccgcagagagcgaggacccactcttctattcctttgcggaggcacggacacacggtgtggcccgaaacagcggcaggagagtgagacccgggctccgaccgcggtgacggagtctcactctgtcacccaggctggagtgcagtggcacgatctcggctcactggaacctccaactccctggttcaagcgattctcctgcctcagcctcccgaatagctgggactacaggtgcccaccaccacacctggctaattttttgtatttttagtagagacggggtttcaccgtgttagccaggatggtctcggtctcctgacctggtgatccgcccgcctcggcctcccaaagtgctgggattacaggcatgagccactgcgcccggcctaaaaattttttaaattgtatacattatggtttttttttttaccacaatttaaaaaattaatttataatatacatgcagaaaaatgcacaaatgacaagtatatatcttgatgaattttcacaaatggaatacatttgtgtaaccagcagcagatcaagaaacagaacattgctagtgccccagaagccacttgtgtgttccctctcagtcactgctcttctcaaggacaaccactcttctgactcctgataccataaactaattttgcctgttcttgctttttatataaagagaatcacagagtatgta

SEQ ID NO: 307 - DNA, 293 bp, Homo sapiens
ccacccagtctctctctgcaaaggcctcccttggctctctgataaagttggagctgtgggtgcagcatttcacttggacctagcagcatcaatgagccagctcctcactggggaacatgcaaacccccagctgctggtgtgcaggaaaagaatccaggagatcacctgatgaagcccagcattttacaggcagtggagcaggggaatccagttgacactgtggctaaatttcagaaaacctcccatgagatcttgcaaaggagatggagaaaatatggctgaatgccagcaag

SEQ ID NO: 308 - DNA, 1096 bp, Homo sapiens
acaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttgacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagc

SEQ ID NO: 309 - DNA, 455 bp, Homo sapiens
ccaagtctcaaatattgaagaatctctaaccagggacaccagtccctacgaagaccttgggcgattttgaagtgcgggcacctcgattccccgaatctgtagtgtggctggtatcggtgttcccctggtttaactagcctgtttgatggggaaattgaggcagagaagccaagacatgtgctaaaggtcatgcaggctatgaatggagctggaatgtgaacgcaggccatatgaccccagagcccatgttcttgaacccttagaaagacagcagcaacacacctggtgcagcagctgcttagttggagtggctgacaaggttggcagaggatcccgttcctcccgtggagtggctgccatgatactgcctgcactgaagctgctcctatttctgaaatatgtattgttatttttttccctgcatgttgaacattatactcttctgttctttcgca

SEQ ID NO: 310 - DNA, 337 bp, Homo sapiens
cctggaagagtcctcccttccaccccggatatcactgtgaacctgattccccaggatcaaccatctgagcagataccttggaatgtccccagatttcagagcctcggaccagcagcaacacactctgaagtaggtctcagaagacaaaaagctgaaatcaactcatgcttcctgctacacagaatccactgagaggaaaaggaaacttcaccgaaacttcagaaagctacagaaatgacatccattttcacaatcccagaaggaaagatgcatctgaagggaataaaaacagagcaatggaagagtatttgttaaaataaatggctttgacagggca

SEQ ID NO: 311 - DNA, 468 bp, Homo sapiens
atagaccagccggtgctgatggggtccgggacttgacgatggcgcctgctcgttcctgttgtgttctatctgaggcatgattttctttcgtttttgggaggtagagagcacggggcagaggttgcacctgacacattagaactccgttgtcactgctgtggctgttattcccctcggcaagagccaaggagcaaacaggacgtgaagatcccggtgttacacatccaatcgttcacctccttccaagactatgacattccaggaaaccttcactgctaagaggaactaagatctagagtatctcctcgaggaagtacaactgcattataaattaaggaggaatagtaacaaagagcttgaagacatgcacagctcacaggccccgggtggaggctggcgacatcagacagacagaaccaagacatctgaggggcaaccaggaggtgcgtgtggctgcagagcacacag

SEQ ID NO: 312 - DNA, 2281 bp, Homo sapiens
ggggtaacgggggaaactggggaagtggggaaccgaggggcaaccaggggaagatggggtgctggaggagagcttgtgggagccaaggagcaccttggacatctggagtctggcaggagtgatgacgggtggaggggctagctcgaggcagggctggtggggcctgaggccagtgaggagtgtggagtaggcgcccaggcatcgtgcagacagggcgacatcagctggggacgatgggcctgagctagggctggaaagaagggggagccaggcattcatcccggtcacttttggttacaggacgtggcagctggttggacgaggggagctggtgggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctggggggttatgggcccgttccaggcagaaagagcaagagggcagggagggagcacaggggtggccagcgtagggtccagcacgtggggtggtaccccaggcctgggtcagacagggacatggcaggggacacaggacagaggggtccccagctgccacctcacccaccgcaattcatttagtagcaggcacaggggcagctccggcacggctttctcaggcctatgccggagcctcgagggctggagagcgggaagacaggcagtgctcggggagttgcagcaggacgtcaccaggagggcgaagcggccacgggaggggggccccgggacattgcgcagcaaggaggctgcaggggctcggcctgcgggcgccggtcccacgaggcactgcggcccagggtctggtgcggagagggcccacagtggacttggtgacgctgtatgccctcaccgctcagcccctggggctggcttggcagacagtacagcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcgggcggcgacggagccgggatcggtgcctcagcgttcgggctggagacgaggccaggtctccagctggggtggacgtgcccaccagctgccgaaggccaagacgccaggtccggtggacgtgacaagcaggacatgacatggtccggtgtgacggcgaggacagaggaggcgcgtccggccttcctgaacaccttaggctggtggggctgcggcaagaagcgggtctgtttctttacttcctccacggagtcggcacactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctggaagctagaggaaccagacctcatcagcccaacatcaaagacaccatcggaacagcagcgcccgcagcacccaccccgcaccggcgactccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagcaa

SEQ ID NO: 313 - DNA, 579 bp, Homo sapiens
aagaagtcctaccactgaaaggatgtgcgggtagaaatgagcaattgcaactagaagagcctgtgtgcccacaatcaagggtaaggaggagtgtcatggagcagctctctactgccctgagaatgacatccccactgttcaccatggccttaaatcccctgcgaattccacctcatcctctgccacttcccgtcactgctctgaagatgccctgatcttgtttcagtcccttggatgtacccagctcttctccatctttgcatgtgtcatagcctcttcctggaaaacccttcctgctgctcatcccagaactgactctccatgtatttactcttattttgagagaagggggcatttccaccaccagaagggaacttgctgtcttggtagccattgtcccctgacacctggcacatctactctatacagtcaccattcaagtggatgttgaatgagtacacttgtttcacagtttggttgggtaagccccaaagcttggttcccggtaggatcaggctttatgagtgggctgagtttctataaaagtctccctaccagtttccaatcttggtgaaacta

SEQ ID NO: 314 - DNA, 413 bp, Homo sapiens
actgacaaaactaccgaaccacgttcctggttgaggatacctgaaggtcgacatttatctgggatcttttgctgctgctttggtatgacttctatcaagatagctttcgacgagaataactgggagatgaaacaggaagctctatgacacacttgatcgaatatgacagacactgaaaatcacgactcatccccctccagcacctctacctgttgcccgccgatcacagccggaatgcagctgaaagattccctggggcctggttccaactgcccactgtggactctgaggcctctgcatttgcgggtggtctgcctgtgatattttggtcatgggctggtctggtcggtttcccatttgtctggccagtctctgtgtgtcttaatcccttgtccttcattaaaagcaaaact

SEQ ID NO: 315 - DNA, 8842 bp, Homo sapiens
ggagatggcaggaagccctggacatacatggtgtgggggctcctccagaggctgttgggatcctcctggatgtggtgtgggcatggaaggaaggccagtggagacaatggatgatcttgttcttagcagatcactggatgtggcagggagtcctaggacatgtgtggtgtgggcttcttcaggtgctggtggtgttggcatgaggaaaggaggtatcttcgagggacaatcttcttcttgtgcgatccttggagatgccatgaggcccctggacacatgtggtgtgggctcctttggaggctgttgtatcccttctgaatgtggcgtgggcatagaaggaaggccagtggccacgagggacaatcttggtcttgggagatcctggaaatgatagggagtcccttgatatgtgtggcatgggctccttcaggtgctagtggattccttaggatggtggtgttggcatgaaaggcaggcttgtatcatgaggaatgattgtcatcttgtctgattcttggagatggcaggaagcccctggaaacacatggtgtggactctttcacaggctgttgaaaccctcctgaatgtgaggccagagacaggcagacagcagatgtattgcagggagctggatgacatggcccttggaacctgtgcacatgcctgcctttctgatgcacgtccatgttttctctgcacctccccggtggtgttggtataaaaagcaggcttacatcagcaagggatgattgtcgtctcatgcgatcctgggagatggcagaagtcccgggacacatggagtgtgggctctttcggaggctgttggatccctcctgaatgtgttgtggccatggaagtaaggccagtggctacgagggacagtcttcatcttgggagatccctagagagggcagggagccccttgacatgtggaatgtgatctctgttgggtgctggtggatcccacaggtggtctggcatggaagaaggccagaggctgcgatggatcatctttgtcttgggagattcctggagatggtggggagcccctgggcacgtgcagcatatgtggcgtgggcttcttcaggtgctggtggatccctcaggatgttcattgtggaaccagcacagattttcatacgaaagttatttctttttaacctcaaaaagtgacagaatggagtgtatcatgaaaaagtctgacatcaaaacctcaaaatgtgatattgattgggtgagatagaattccatggaatttcattgccaaaccagtgaagtgctaattttgacatttgtaccagctaacgtagctgtgaagaaacacaccaatacacttctaaggacagcatagaccaagatctaggtttcatatggatgaatttattcttccctttgaggcaagacaagaaggaaagaaagtattgggaataatgctgccctcccatcctcaagggccagtgggaactctaatattgattggttttcacagaattccatggactttaactgctgaaccaatgatgcactgattttgtcacttgtaccagctaacgcatctgggaggcaacaaaacaatactctcctgaggtaacatcgaatttttagtaaattcatttttgtgtgttgtttttattatttttttaagtaattgagaatttcattaggtgtgcaaggagtcacttaatacaaatagtattaggcattcaatactctcatgagatatctgagccttcagtttcttttattttaacattttacatttttctcaactttaacatcagaaacatcctataagtgtaataaaattcttatactttacatatagttacatagtaaatcctcctgtcttatttaagtttgaaaaatgaacatgtatacttctcattcccatgtatataatctcttcccacagaatgaggtggaccaagaaactgggcttcatacggatgaatttatttttttccctgtgtggagacataaaggaaaagtatagtgaataattccgcctcccacccacaagtccccatgggaattctcacatgttaaaaagcattttgtcctgaaaataacaacaatttttcttagggaatcaggacactccaatgacagtgagactctggctatgccaggcagccatgggctggtcattgtgctgctggtctccatgattgaatagtgtgggtcattggtgacagatagctatgtgctcagtgtctgccacatatctcaggttcaaagtcccttttataaatgtgcctggatggatgacgacttaaaaatgaatctcgttggaatctgagcaaaacgagtgagcaaaccacttctgtgcagttctgtgaactgaggtcaagcacagggaccatgccaggcaaacacgtgcagagagttcagtttggtcagcaactggtaccaaaatggcctgtggtattggaaaacaaacccactcacatagcttacagcacatgaattgtacagaggtctgtatgtgtttgtatatatttatatatgtttgtgtacatatatctttggggattatatggcatttctttcagtgtttggctggcagtgtccatactctcatagtaaacagaattacacaagagtagagggaacagtaggaaatggttttgcctaccctagagtcttttatacatgtttttaggtgctataatcttgtgtgtgaggtcagtctctcaggttcattagatggacagtgtaaaaggtattatgaggttttacatattatttatctattaagtaaaagaaatatatggaaattgaagagtagcttttatctattaaagaaaagaatgtatggaaattgaagggtactttctatttgtggaaagtcttaacattttaatttccttattgatcttgtcacagaagttggaatttaagttttgcctgtcactcaaagagaagctttttagacatttgattaagggattctagtagatgctatagtaaacatttctaattgtaaaatgattaaatttgcaattcatagagttttatgtggatttcattgcctgatattcattatttttattagtgggtttcatagatgtttaaagggagatcctagttttattgtgtgatactaagggaggccttttggtcttagaaaactgactttcagtactacccatttccagggagtgagcataatttttattctcataccacatgggcaagtgaatatctatggtttatttcttataactcgtcattagtaattatgaaagtaagaaagttgacaaatgaaactcttttaattatgagggtttcatttgtcgacttcctacttcctcagtgtgctttgtgtattggaggtaatactggaattgcatggaattcctactgctgctccagtaacctgctgattttgtcacgtgtaccagattcgttgtctggcaatgagaacaatacacttcagaggtaatattgcaatttttagtaagtgcatttttcctgggttcgttctattattttattttagcaagtaagattataattggtttttcaagcagtctgttaatccaaatggtgtgaggccctaataatctggttagtcatctgaagtttctgtgttctttgtacagtatttttatacttcctctgttttcaaataacattaggataccctactagcaaaataatttagtatattttatatacttgtgcatagtaagcctgttgtatatgtacactatttgcatggttggcaaattacatttgcactttttatttttctataattttttcctattttcaaaggttaatgtggaccaaaaactagatttcatataaaagagtttattccttctacttgaggtgtgacatgaaggaaagtaatggaaataattctgccctcccattctcaagggccagggggaattcaaatattgaacggaagtgattttggaattgcatggaattctcactgccatcccaaagaaatgctgatcttgtcactcttacctgtttcattccctgggggcagaacaaaaggacgcactccaaagatcggcatgaaccaagaactgggtttcatataaaatattttattctgtcctcttgagatgtgacatgagaaaagtattgagaatacttctatcacctcatcttcaagaatccgtaggaattctcccatggtggactttacggttaacctgaacaggtcttggaaaaaggactttaaacattctcctgttctgtggaataagtatacttttttctggacatacaccttgtcagtgagttccatgtgatactagagttgcatagatttttaacctttacgccaatgaagatctgaggcaaacattgccccttttttagaagtttgcatttgtcactgataactgtaataattgatcttgttgaaaagcctgggaaatgaagatctgatatgtcacttttaccggcttcctcaactgaaaaagaatacaatgaaacacgctgagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctggtgagcgtcactcttgagagctgagagtaggtgggaagcagctcatggtgagagggttcagaggccgcctttccctctctgcgcactgcccagttcttctagtcacatgtcccgggacagtaccatacctgtgtgtgtcctgcctgcattgctgtgaccacttttagtggaatcaggtgcagtgcagctctgcagcttctgcaaattgccacgctcccactctcaagcaggttgagtgctacgagtgatttttagaccatttgtttattcccttatcatggctttttgtgacttcttcctccccagtccgttgggtcacctttaaaggtaaagtaatcctgaggtggttgaatttacggaaatgctatgcattattgtgaatgggatgttcaccgggccaacatcttcttggaactttgagcaaactgatagtctggttgcacatttgatttgtctggcagtaaatgttggacagtatttggactgatggaagctagagacaaacacattgactattgttgaataacactggaaacatcttaggagagcagtacattagctaatttaataggtacataaactgaatcccactgtcttgtgcttgacggaccagcagacacatatgcttgtatcgttctcatgtttctacatgtttaccctattcccacaggtcaacaaagacaaggcacctagccccacatgaaactttattcctttcccttttgagatgtgacatgaaagaaaataacagaaatgatttttccatcccatcctcagggaccagtgggaatgaattttaccatcccaccctcaagggccaggtcaggtcgctaagcattttgtcactaaaatattgcccttttttagggattatgtaatactctataaggcactgtctgtgctgggcagcatggagcctgggtcattgctgtgttgggggcttggtctccatgacttaatagggtgtatcagtgtgtcccagagaagtgtactccagagtgctcattttctttcatgtttctgaagcaaacagtgcccccttttttagaagtttgcatgtgtcactgataactttaataattgatcttgttgaaaaacctgggaaaacagtgagttaaataataacttctctgaacatgaggtccagcccaattacctgccctaagcaaactatatggaaggagagttcagtttgttcagctatgtggtcccagcaaggactgtggtactggaaaactaaccagcttacatgcactagagaagtagaattggacagtgatctgtaggtacccagtttggagatgaaattgcaactctgagttcttgattggcaacataaatacgttgatagtaaacagaccctggggaatcagcacttgagttgtgaaaagcgggaaatagctatgcctacactagagccattcacacttttgctggagctgcaataatcttctaagtcatgcttgctctcgtgagggcaatgagatggtcacaatccaaggagagttggggttttcacttttcatttctctattaagtgaaaaaagtatatgaaaattgaaaaatagatattacttatgtaatcttcacagtataatttgcttgccaagcagtcactgggatttaatcagtttctttgtctttcgtttttctcataagctgagagagtaattttgtgtgcacagaagtactgtcttcagctacatgctgcattaaacattcctagatgtgaaatgattaaatttccaagtttttaaaatgtggatttttctggccacttttatatctcttcaatgggtttctaatggatttaaggagagagcctagtcatgatgaatggtgttgtgttgggtatgctgaggaaactttgagaccaatgtttcagaaaaaattatttctatactgtcatgtttcaagtaccgagtattgttcttgtcatacagatggtccagtgaacatctctggtgaattccttacaaccaacctcttgttactaaatattccattaggaatgttttgtttctcaactccctgatttcccctttatagattggaagtgatattggtggaagacaacattttgccgcttggaattctcacctccacaccaaagaagtactgtttttgtcatttgcaccagcttctttctccaggaaagatcaaaacgatgcactgcaaggttaacatccaatttttaatacatgtaattccctggattatttttgttgtgttattaaataacttagaattttttttacaaagtctgttgaaccaaacactgtaaggcattaataacctggtgagttatttgaggccttttttcctctcctagaatttttgcacaatttatattttgaataatatcagagacatcctagtagagtaatgaattagtacattttatatgcagatacatagtgaagcctcctttcttatgcatatttgacaaatggacatgtatatttctcatcttcccatatttttactccatttccacaggtcatgtagaccaaaatgtgaatgtcatatgaaagagtttaaacattgcccttgaaatatgacagaaagtatcagaaataattataccattccatgctcacaggccagtgggaattctcacagtaagcattttgtccagagaatattcttcttagggaactataacattccaatgataatggtagtcagccatgtggctggatcatcgttcctgtatcctggtctctatgacttagtgtggtgatggtgtcattgtgtccaagtgtgacagaattgttagtgtgtagtgtctgtctcctatctcaggctcacagtcccttttataaacatgcctggattgatgatggcttcagtatcttttggaaatctggactgagcaatagaattgcttctctcaaattgatttcaagtcatataaaaggccatgttacacatatattgttaatctgagggaggctgtgatcatttaagttgtattttataaacactaggaccaccagtaagaaaacaattcaaaaaatattaaaagaacaaccaaagaattaaaatagaataaccgaaaagatctgtttaacacaaaagaaggcagttaaagatgaacagaggaaccaataagacatatagaaaacagataggaaaatgacagacataaacccagccatatgacaattatattaaatttttaagagattaggaaattccgttgttttttaaacatgagcaactatacgctgtctacagaagagacactttagaacaaaagatacaaatagttggaaagtaaaaagatggaaaaagctatatccagcgaatccagaagagagcagaagtggctattctgacatcagaaaaaagagactttaagataaagtattgctagagaggaagaaggatagtatttaatgatagaagggttaatatggaatatgtaacaattacaatcatatcagcactaacaacagtgcccaaaactacatacactgaaatttaacatgattgaggggatcaataggcaattcaacaataaaagcttttgttcataccctcttcttaatcagtgataagtcaattagatagagcatcattgaggttacaacatacttcagcaatgttgtcaaccaatttgacctgagatagatagatagacagttagacagacagacagacagacagagaaaacttcacccaacaacagaaatacaaattattttcaagcatacctggaacattctccaggatagagtatatgttaggctataaaactgtactcaataaatttaagattgaaaccatgtagagtatgttgtgtgaccatagaggaattagaaatcaacacagaaataaatttggaggtcacaagatatttggaaattaacacactttacagagcccattggtcaaaaatatatatattaaactagaaaggccgggggtggttgcttacacctgtaattccagcactttgggaggcgtaggtgggcacatcacttgaggccaggagttcaagaccaacctgggcaacatggcaaaaccccatctctacaaaaaaatacaaaaaatgagttgagcatggtggtgcatgcctgtagtcccagctactcaggaggctgaggtaggggaatcacctgagcccagcaggtagaagctgcattgaaccaagattgcaccactgcataccagcctgggcgacaaagtgagaccctgtctaaaaaa

SEQ ID NO: 316 - DNA, 379 bp, Homo sapiens
ggtacttctaaacttcgtggaagagccctgtttcataaatctgagacagccttggtctgagggagcaaagacagagaattcacgtgctgcccaggcatagccacatagcaggtggacatccctggacacttttctgacaaagcacgcaatgtggggacaacacagaaatccaagaaaggcaagaccaatttcaaggcactaaataagtggactgagacaagaagtacacagatacttcccagaacaaaagattttatgtcatagaccctcattggattttcctggaagtacggagagttacatccagagaactctgaacattttggaaggaccccaatcctgcaaacaatgaatggcaataaatcctgggactggaaag

SEQ ID NO: 317 - DNA, 1870 bp, Homo sapiens
aaatgccatcccaattcccctgatgttaaaagaaacatacagtctattcactggttttgcaaaaaacactaacctacaaacccttctgggccaacaagcttgagtgcgatccggtctgcaatgatggaggaattgccatgtgcgatgttggcaaacgggccagcatggacaaacactggagtgccctgtggaaaccaggacaccgtgagctgagctgccaatcctgcttcaaagtgggatcacacattcaacggtatggaattgatttggaatcggaaggaagaatacttcccagagggaaaatataaagtcatctcttttatttcagtaacgtcccagtcacaggtgtgaggaagaatgagaagaaagagatgagcaagtggagaaggtcttgactacccaggttaagtgtgcttaattttttttttttttttttgacacggagtctcgctctgtcgcccagtctggagtgcagtggcgtgatctcggctcactgcaagctctgcctcccaggttcacgccattctgcctcaaccttccgagcagctgggactacaggcgcccgccaccatgcccggctaattttttgtatttttagtagagacggggtttcaccatgttagccaggatggtctcgatctcctgaccttgtgatctgcccaccttggcctcccaaagtgctgggattacaggtgtgagccaccgcgccttgcaagtgtgctttataaccactctgctctgactgtccaaaaccaattcaagaaggcaggagtcactctgctcacctccagtgtctgcatgagattgggcttgattgcgtccttcataagcactgtcagtgcaccactcaccccctacaaaacaaatgtgtgcagcatcaactcccaccagcaaaaaaacccaaccttctgaaaccaatatttgacattctaggcttacccatgttagccatcttggaccaattgatactttcacctgaattggaccattcatggtttttttctggatatgctatgaagttgccaattattaaattatttattttttgagacggagtctggctgtgttgcccaggctggagtgcagtggtgcaatctcggctcactgcaagctccacctcccaggttcacgccattctcctgcctcagcctcccgagtagctgggactacaggcacccgccactatgcccggctaatttttttgtatttttagtagagacagggtttcattgtgttagccaggatggtctcaatctcctgaccttgtgatccacccgcctcagcctcccaaagtgctgggattacaggcatgagccaccacgcctggccaaagttgccagatagaatacaaatgacattcacatgtaatatctggaaaaacatgtaactctagaaacaagcatcttaatcaagctcagctgctgactgatgtgagaaatccattctagactattttagagcacgacaatgctcgttcccagagtactcagttatttgtaactctggtatctgggcagaaatttctataaataccaaactcaatatgtgtcttccaaagctgaaactgcaatattacgcaagagttcaataccaacttttaacatcaggtcactctattaagccatcaaagtgtagctgaactacctagcaacaaagataaagcaatggtactcttgatgttctctgcaaattgaagtcatacacccacttttagagatgcccacaggatgaagatgttactcaaatcatctggaacttgtgatctattactaaagcataccagctattattcactctgatgtactttttaaacatttcataattatcttgtaattagcaaaataggattaaattgatgaattaattgcaa

SEQ ID NO: 318 - DNA, 451 bp, Homo sapiens
gttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatac

SEQ ID NO: 319 - DNA, 1114 bp, Homo sapiens
attcatggctgaagcgtctgaaacaagactaacaagactaacgagattaacaagagaaaaacatacaaatttttaaaatataagttgtatgtgacatagaagcatttataaagaaaagaagaccagaagaaacgggtagacctgggtatttttatgctacttttgatgaaaatgggaatgcttttggagacgcatgagtgaataaaaaaatatgatctaatggtaataaactagaggaaacagagcaaagtctgttcagattcttctctgtgatgctttgtcttcagagctccttcaggttggaaggaatacctttacttgggggcatgtcaattcgtttttctcacttgattcatctttatgacttcctgaggacagatctaattctaaagtaaccagaagcctggccatctcagagcagcaaatccctcaaccttggagcacaaatgatcgctgatagagtctgcataaaatcatcttcctctatctgacagccatgagcagagccttgggggtaaaaaaagccacagccttaaatctcttcactcagaaattaccatgaagataaaataaataaatggaaaggactatcaagaagccaacaaaacataaacaccaaaccaactcatcttgtttcactttggaaataaactgttcccagatgtgagaccaacaaaattaatattaagcaattaaaccagtaaattataaactgatttatcatttgggaagtttaaagtacagagagatgaggtacctgtagccagaattacacatcatttcaaaatatgtagacaaaaagaaaactgaatgaacagagaaacattgcagcaatgcacagtcttaggacgaatgttgctgtttgcagacagagaatgtttgccatcttgtgtatagcctcaaagccatactgagataatagcattgttgtcaattgcttgaaaaattttcacattcaatccttcatgctatattggttggaagaggagggaagtcagttcttactgattacttctcagtgaacttctaatatttgcactgtcacttccattcagggtaatgatgtgtgctgttatttgcacagatggtcccatgagttttgagaccacagcaa

SEQ ID NO: 320 - DNA, 596 bp, Homo sapiens
atgagcccaaggagggaaaccagaagagccccccaggctcaccagttgtttgttggctccctacaaacatgtcattcaagtggctaatcttacaacagcacaaattcatctaaccagagatactctattatagcaaagaagaaagataatttcattgagccatcctgttttacaggtaaggaaaccaaaggccatagaagacttgccttatgtcatgaagaaagtttatgttagaactcagggctcccaattccactgttctttattctacacctgggtggtcacaactgaaaatgttttgcttatttctaaacagaaatcattttttgacatgttcattttaatgatgtgtctatgcctggggctaatgtcatgaaaacaatgtgtctggtaaggagaaaactgaaaaagtcagcattaaaaagacatttaagtccatttcaaatgcctcccatatgcagactccactttatctcctccagttctctaaaacccttcactccttggctttttctggctaatacacacatctagctaagaaagctcaacttttctttttactagagatgttctctctgtgtgtgtgtgtgtgtgtg

SEQ ID NO: 321 - DNA, 867 bp, Homo sapiens
gtcccttctttccgctccaacgcacggagggtgaggtcggtacgcggtggtggcgtcacggcgccagctcctcccgacgccgagaccatgggggctcagctaagcggcggccgcggcgccccggagcctgcgcaaacccagccccagccccagccccagcctgcggcgccggagggcccggaacagccccggcatccgccccagccccagccccagccccagccccagccccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccatccctttctccggctggctgggtcgggggcatccctctctgtcgctggcttccagaggcaggacaggcctcctggtaagcccgcaaagttgctgacctcctgacttcgtctgccttttattaatatctgtattgctgataaccgtgctcttgactatgtgtcccaggtcatgtcccaggtcatggagaagcccgtgccacagtgaccctccccatactcctgggggggctgctctccatcctggatcgtaaggaggcatcatcaggctgtgttcctggaaccccaataaccctgggcccccagggccagcctgt

SEQ ID NO: 322 - DNA, 844 bp, Homo sapiens
agcttcggcacaagggcccaactggaattccacttacggacggagtctccttctgtcgcccaggctggagtgcagtggcgagatctcggctcactgcaagctccgcctcccgggttcacgccattctcctgcctcagcctcccgagtagctgggactacaggcacccgcccaccacgcccggctaagtttttgtatttttagtagagacgaggtttcaccatgttagccaggatggtttcgatctcctgacctcgtgatccgcccgccttggcctcccaaagtgctgggattacaggcgtgagccgccgcgcccagccccaggcggaaattatttcaactgggtcctgagaactgggcacttttcaaggattgtcagcaaggagcaacttcccaaatatacatctaaaaagatgacaaactcatgtggaatgtggatttaaggaggaaggcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgc

SEQ ID NO: 323 - DNA, 1522 bp, Homo sapiens
agtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggcaggccagaaagcagacccagggaggatagcacatgtcttcggctacactggtgaaggcatcgtgcctgctccacagcacatttttattcaagtcttggacgagcctgaggatgtctacaagtggaagaaaagaagccactggagcagaaggtggggaggataaaatttggagcaagattctcaaggaagcaacaagatcctaaggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagcccagtcaagagaggatggtgacttggacttgtagtagagccagttagaatgaaagaaattgacacattcagaaatggttttagagatagagtcaaactggacctgataaagaactagagaagcggagtgaggataaagagaagagccatgactgactcggaagattttgtcttgaaaaacttgagaactcaagacagagtgaaataaaatcacatgtgggaaaaa

SEQ ID NO: 324 - DNA, 589 bp, Homo sapiens
gatttcaatttggaaaatggcatggaaataatccagcttgaacatcgtcctcctcacctcctggactagggcgagggccccttatatttcttcatggcaattgtgtcacagttcaaacgctcgtaccctgactccatctgggatttggaatgcactcagggaagtggctgtgcatggagactagaaatggaagaggcttccaaggtcatgcctttcaggctcccttcaaattctacagctactgtgaagagagttgcattcccacagagaacatgtcagactggaggaaaattgtgacaaaaggtctccccaaaggtctctgaaacttcgatcttatctcattccacaaggcaaaggccagtttcctaaatcaaagaatgaaacaaagtacatctttttcaagcattgttttgacatcactcccttttatacaactggacaggcactcccattctctttaaataatttttaaacactcctgaactttggcttggagatcctcatttgaaatgattttatcactctagacatactagctcatattttttaacttcaacctggcaaaagttaatatccctcataaaactct

SEQ ID NO: 325 - DNA, 391 bp, Homo sapiens
gaaagcgggctagcctgcacgcacgccaagatggagctccaggctagcccacagaacagcccagccgcagccgtcctaccagaccagcaccttgtaaccacagtctaacccagcgggcaccaggcgattgtgagtgccacggggctgaggcctgcgccgacctggtctgctggtgctaccaggcttgaacagtcttcaaatccactgctattaggcaaattacctggctcccgctgaactccagcacctagaactatgtcacactcgtagtaggccgctgcattggttgaacaaatgattttgaaagaatgaatgtcttcctctgtgcctgcatttcctcagaaggctgtaacaaagattaaataggaaaattcgtggaaagttcaattac

SEQ ID NO: 326 - DNA, 734 bp, Homo sapiens
ccttccacactgtgggaggtttgttcttttgctctttgcaataaagcttgctgctgctcactctttgggtccagactgtctttatgagctataacactcaccgggaaggtctgcagcttcactcctgaagccaaggagaccacgaacccaccgggaggaaggaacaactacagacacgccggcttaagagctgtagcactcactgcgaaggtccgcagcttcactcttgagccagagaccacgaacccaccagaaggaagaaactccaaacacatccgaacatcagaaggaaaaaactccagacacgccgcctttaagaactgcaacactgcgagggtccgcggcttcattcttgaagtcagtgagaccaagaacccaccaattccagacacactaccaaaggcagaggggagctcctagacaaagatattttgcttacaaatggaacatatcaaatcaagcttttgtgaacttgagggaagaaacaaagaatatgaagcctaaatggaagtgtcaggaaatggtcgccttgcggacaaggaaacagcagcctggaaggccaggagagggcagactacccacctaaccctctgcagaattttgtgtggaccctggagaccagaaactaacttctcctgcagagacaaggtcttgctctgtcaccctggctggtcttgaactcctggcttcaagcaattcatccatctcagcctcctgagtagctgggattacag

SEQ ID NO: 327 - DNA, 494 bp, Homo sapiens
cagacagcatacaccatccccatcatggccttcgccttcgtctgccaccccgaggtgctgcccatctatactgagctcaaggacccctccaagaagaagatgcagcacatctccaacctgtccatcgctgtcatgtacatcatgtacttcctggctgccctcttcggctacctcaccttctacagtacggtggcaccggtgggcagaggcctaggctaggctggggggaaggggctggttgtggccatggtgccctccataccgaggcgtgtggtgcctggctgtgccttgccgctgtggaggtgagtctgcatgccaatccccacagtgttggggtcccctaggcagctcagatcccacctccttcctggggccacctactgaccaccctccctgcctgccacagacggggtggagtcggagctgctgcacacctacagcaaggtggacccgtttgacgtcctgatcctgtgtgtgcgcgtggccgtgctgac

SEQ ID NO: 328 - DNA, 183 bp, Homo sapiens
cccagactccaggctgggtgacagagtgagaccctgtctcttaaaaaaaagtgctgggattacaggcatgagccaccgcgcccggcctcatgtagaacttttaattgaactttttgtccccgtttacattataatgtgaaaataaaagatgaaaatcaaaatgaaagcatttgttgatttgaa

SEQ ID NO: 329 - DNA, 6606 bp, Homo sapiens
ggggtctcgggcaggggcggggagcttaccgacctcccgcccccgctgcgcgcgtttctggccctgccagtgtctccgccggttgaaagcgcgtgtctgcgtcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacaggttacattagttatacactctggaggtgacttgacctgtcattgtgaacaattattgctcttggacgacccaggacataggccagccagtacgtaccccagtgtgttggagaatcgcgctcggcttcttcctctgtgctgagtcatgaaagttgccggagcaggtgcagttacacaacctccaggtatgatcctgtttaaggactggatttaggataactacttagaggttaaaagtcacaagggtgtatggatgaggctggagtgatctgggaccaaagacatctaggcttgctgtcaaggcttctgatcaacatgagatgaccgccgtgtggtaaactgatgaaccctgaccctgatcaacatgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatcaacgtgagatgaccgccgtgtggtaaactgatgaaccccgaccctgatgaacatgagatgaccgccgtgtggtaaactgatgaaccccgaccctgatcaacatgagatgaccgccgtgtggtaaactgatgaaccccgaccctgatcaacatgagatgactgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctggggcctgcggtgccatcactcagctcccctgggcttcacatggccatggagcacccagcaagtgtaggctctgagccttcagggaggggcggcatcagccagcaccatcgtctcctgggtcttgtgcctcttccttggttgcggtgttgtcagggccagaattgggcaattccgggtgacatccaggtgtggctgctgacacggagcacaggtgaggttcactgaggtaagtgggccatggccttgggcttctagttcagagcacaccatccactcagcatgtgaacccagctccaaagcgtatgtgtgcatgtgtgtacctgtgcacattgcgcatgtctctgtgtatgcatgtgctttgatgcatgttgatgtacgggtgtatctgtgtattgtgtatgcacacacgagcatatgtgtacatgaatttgtattgcacatgtgtttaatgcgaacacgtgtcatgtgtatgtgttcacatgcatgtgtgtctgtgtactgtgtgcaacagtgtgtgcaagtgtgtatatgtgggtttatgtttgtacagtgtgtgtagtgtgtgtacacatatacacctgtgtgcatgtgtacatggtatttaagcatgtttgcacgtgtgtttgtgcttgcatgtgctgcgtgtttgtgttggtgggatgtggggaggctgctgtggagacaaaagctggagagaacttggtagagtaacccaggtcaggaaatggcacctgcaaaggaaggctggagtgcctgggattcacgttgaaatggccaatccgtcagctgggctggacacagccatcacgctgggcagctgtgaggttaaaacagaaagtctgggctgtggggaggctgagaattgagatgcatgtatgagatgagtcacgagggccaagtggtgtgtgtgagaaagcaggcacagcaccactaaacactaaggagatttcaggggagttacgggtggagggaggacatcagatctaccctggaagttaaacgtgtttcgagtgcattaaatactatgggccacagacgccttgtctccatatctactcttttataaatgaagtaaagttcttgggaaatacttttctcactctaaagctcacaatctatcttgcaaaaaatattttaaattccatctcaaataagccagggtgaaaagggagcctgtgcaccagacactgccagccttgcctggctctcgccttcttgctcttccttccccacctgctggggattttcttaacgatggagatgggtttgggtttgtcctgctgtgctctgctccccattcccggatccaaggtcctgcctctgtcctgtcccctgagccacctcagggatgcagggtcccccacctggtcaagtgcccagtgctgtgttgtcatttgcaagttcttcctgtgactgaactccaaatggcactgggactgctgactccacccactggacaacccgtgttcttgcttttggggtttctgaaacagccccaagactctgggcatcttgattttgctcccattgcttctcaggacaccctgctcctgtggtttgcagccccggccttctcttcgaggacgcctctgctcttctgcctcacactcggattggaccttcttcagcacagccagtggccgaggcttcctccctggggctcagtggagcaggacagatgctgcatccaaactcttccattgggttccagtctgttccagtcatgcccttgagcctctaaagctcctaggtgagagacgtagcagctgacagcacttcccacttgatttgggtggactccagcctccccagcaacaataagagatcaaaagcatcgttgaggaagcagcttgctgaaacgctgagtgcccgccactctcaggtcaggtgggaccggcaggccagcatgagttcctgaacacttggttctcaatactggccacagccacactgtaaggggaaacaagagggcactgtatgcaaacatctcttgaactctggagtctgctcaccttcctgcctcaagcccctctcccacgtggtccagtcaccattctccacagagactaccctaaaacccagcgactctcgtgtgcctgcagaatggcacagcccgttctcatagcagcactcctgtttaatcagagggatgttaacgaccaagtcatatttgctcgatttgtgttcaacatatttcatttgtaccgataaaacttaaaaatatccccacacatgcattgcctattaaagagtatcttccaggtacacctcccttacacatcagttaacttgataatttcttcccattcttgtgcaataaatttccttcctgatcagctctgtccagcagcaacaataatccacgtagagacatgcaaactaaaagtccgttagtggaggcacgaagctgatgaggcttggaaaaaaatgaccgatttgattaaaattaggacccatgggagtggagctctgcctattttagaggcaaagtaaatgcctgggagtccaatcaccgacattctgtttgaggtttctaatcacaaggaagatggagaaaatgcagaacaagtggtcaagaacagggagataataaatagaatatttatgggctgaggaaaacaattaccaggggaaagcccaagaagcaaagatgaacagagaacgtgctgactgcgctcgtttggaaaggcctcatggccaaaggaggagaggcattatgaggagcagtgaccgagtgggcaggacccccggggatcaggaaaggtgcacggggggaaatgagaggcctgagcggcttcccagcgaaggtttttgaagcacggtttgattttctctctccccctcaccatccccaaattttagttgtgactatctccaggtacatggcttgcgacaggcggtgtataaaaactaatgtcagtttaattttaaaaccttagccattttctggaacttaaatatcaaagagaaaatgtccacatatgatgttaattgaggtttgtctcactggtgatttgtgctgattcaattcctgtttctttttttttttcttaaggggtcagttttagaattgggagataggtgtataacatatgactatacagcgcaggttggttttttaacatagaaatatctgcctttaaatgagaactgaaaacggagcttcttggaggccacctgctggtggcagtgatctgaccgctgtttaagctttctttgaactcctttttttaaaacagcctccataatcaatggtgtacgatctactctcgtggtaaaacttactcagtgaagagtgtgttttattttctgaggagctgaactgttccaacctgagtattctgaataaggacagtggtcgagcatgagtgatgccatctgggcttagaaataagtgggcctaaaatctgattgttttcatacattgttcagatattgacgcaaatagcaatttattttgtaaaaaatgattggtatccggaacttgcaacagctgtgtgtggcttgaagggagatgaagtggtgaaggcctggtttccaccgaagctctcacagcccagcctttcactgtgtggccgggggaagggtgctccgggtgggggacgggaatggtgggactggggatgccacgggacaaggctgctggcctggaaggtagtcacgtggagaaccgcaggagatgagattggaaagtagtaataagccatgtggataagaacagaggagcgggttttaagggggacgtcctgaaatgctgctcatgtcgtttcagttccatagaccacaggaaatgcaggtgagagggcagcccggtgggaaggaaggaagagggtggtggtgagccaggtgagtgtggagccgcccagggcaccgtgctgtgcgatagctcaggcatcgggtgcttctgccaaacccttcagcagctggtttggggccaaacgtccttcctgtgtgagagaaggcagagcctaggcagcattccaaaccccatccagatgggaggctgagtgcagagcaaacggagcccagcactccagagccgtgtcccttcactgccatgatcacatcacaaacagcgaggcttggagaggacttaagagctccttcaatgccatcttccatccactgcgtgagccagaatagaaaaaaaggaataagaagaggtcggttaagctctctattaagttgagaaaatgggaacttcaggtgatcatgtgagatattcaagttaaaaaaattatttaaaaagcacattcttattattaaaattttagaaagtacagagaaggaaattttaataacctacacctagaacactaagatactggtaacgtagaaaaatgtgtagttaatgccttgatggattcttttctatttttttctctagcaatatttatgtctatccacagaaagcgtacactcatgtatttgcatggctaatatattttatgtaaagttctatatatttctcaacatttcacttaatatttctttataaacatttttccagtgaataaaaatttttccaaacagtaa

SEQ ID NO: 330 - DNA, 416 bp, Homo sapiens
tccaagccccttacaggctccctgctgagccctgtaaacagttgcgactcggcagggagcctgtaagcacctgggaccctcagaatatctgtgtgtcagcgtactttattcaccggtcattgggtcaggggtctgcaagggacagactccccacagctggtgacccctcgagaggagccctgcccccagctggtgccccatgtgaggcgctgtgtgaggaactgtgtgaggaatgctgtgaaggaaacgcgacgaaccgcccgaaaacgaagacagaacagcatgtggagactcacacagtgaaattttcctccaagaagtactgcatgaacataccaggaaaaccaaaagaattcacaggacctttgaaagaagtggcttgccgctgcaaactccatgagacagctgaaaaactg

SEQ ID NO: 331 - DNA, 467 bp, Homo sapiens
cccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcagaggatgcagcattcaaggttctatcttggaagcagagactgtgccctcaccagatgctgaacctgctgagcaccctgatcttccacttcaccttcatcagaactactgctgtgattgcacctgccatcttatgcagaaatgacctgaagacagactgaaacaacgtgttctacagcctgaaaatatctaccttgacttacagttttattaatgctggtgtgatcagactggacaaaaattagcatatgttattaactgatctaattcaagtgccaattcttaatagaaacacaaaacaataaaagcaattcagaaaata

SEQ ID NO: 332 - DNA, 425 bp, Homo sapiens
cttttcttcttttctcttctcttctctttttttttctctctctctttcattcacattatagcttgagtcagaacttcattcctttttaaggctgaaggaccacattttgcttgtttgttcatgtgatcgatgatgatggacacttaggttgtttccactttttagctatcgtaaacactgttgctaatggaatatgggtgtacaaatatttcttcaagatcttgctttcaattcttttgggtatatacccagaagtggaactgctgcatcatatggaatccattcccagggaaattctcaccacatagcacatgaacacaggtgccaggatgcagctgcaccttcctttgtggagcaaaaacttggaaatatccttaaaagtgattaagtaaatcagagtatgaactgtgctctggagtgcaaga

SEQ ID NO: 333 - DNA, 511 bp, Homo sapiens
atgcacaaaataagcctggctgtggaaatgcttatttgttgggagggtgcttgtttggatcgatgatgagaataattgtctgaggatgctgagggactcattccagatgtcaatctgaggtccagatgtgtggccctccaataggacaaataagactctcagagcctggctctatttggggatccctcagtgacaacatagtacctctgtgagcgtgccttttctatctctccgaagagggcattagcatcctgtcttatgagtcagtatgcactttagtatggttagtgacccaagactcactttattttgttcattttgagcagagaattgtagatagatacatatatgggaaatatgttcttgattaacaaatgaaaaaatgaaaaagtttcagtcaagaaaggtcaaggaactgtgatgtatagtgaaggcagggaacactgcatgcctgtattaaatattgacaaaggaaccaattttagtgctttgttatttttactgttgagta

SEQ ID NO: 334 - DNA, 792 bp, Homo sapiens
gcgatgaggaacagctgatcacctgtggaagtcatttgtcctaaattgtcatggacagaccatgtgccttacagcaagaaaattctgtgaataaacaggaagccagccagccagggaagatgcttttgtgatatatcccagcatgctgatgaccccaaggaggaccactggatacctagcaaggaaaaagaagaactgattgaagagtggcaaccagaacctcttgttcctcctgtcccaaaagaccatcctgctctcaactacaacatcgtttcagggcaatatgataaaattgaaaaatttcacaaatgtcaggagaacaagatctggtgtctgggtttcaactcttagagcttcccagctcgtagctatgctcctgaattcctctggcagccctcctcaaggacctctgtgagacaaagtcagaaatgacttcactggagaccaagagagcccacagagctcttcctgctgcttcttctacccttgtactcactcggctctctaaatttgtctcagctccaggtgcccaggatgaaaatctgtgaaacaaagcatcaggaatccagaagaaagactgagcagcaattgataaaaaacataaggctaagggtctatacaactagatattggaatttagctagaggcatgagtaacagattctagggggtgaggtagagggagacaggagcagcacgtatgacatttggtcatggctgacactttctgtggcacatgttttataaaggcttccaatggagaccaatttcacctgagtgcatagtcagatcc

SEQ ID NO: 335 - DNA, 570 bp, Homo sapiens
agtgcggcctggacactggggggatggatctgcagccctcccccccgacaggggaaggccccttcccgggtgtcccaggccagaggccgtcgcgtccctcccacggccgaggctccacacctcccggaccgactccgggccagggtccgcctgctccggttctggcccccgcgggggtgacgttcgggacgtcgggggctcgcgcagatccgcgctggatctcaggcggccctgatggagacaacaggaaggaaagagaccttcctggtcacacttgggccacaggagaacaggcagcggcccaggaggatccagggtcctgatggtggttgagaagctggttcttagtgatcactcagaaacgtcggcctggccttgtggggtcagaccttgcatctcagtcagcccagggagaagaagaagatggtccacacccaagtgcagggaacatcgtggcagtcggctgggtgcctgcgtccaggcgaggacacctcccgcatcagggaaacacacgtttctggagtgaggaggctgaaggcagggcccagaggagagctgagccatggaagg

SEQ ID NO: 336 - DNA, 5428 bp, Homo sapiens
ctaatagagtggtataaatcaaatgctattggtatacaaaaggacaaattttgtcagccaagtgtatgggtatcttcaaagagcacaggtgccatctgttctgagctaatgacccattgaagaaggccacaccaaatttgggggaaaagcagcataaacaaatgccagagtattttccaggcaggttgtatttggagaatctcctaatgttgtatatttaatttgtcctttgtccaagaataatgcaatgaactaggcaactagttgaataaaaattgaaaccaagttcaaacaagcctattgaaaaatgggcaaaagactggaaaaacatggccaataagcgtaagaagagatgttcagcttgatcagtcatcaagaaactacaaatcaagaccacactgaggctgggtgtggtggctcatgcctgtaatcccagcactttgggaggctgaagtgggcaaatcacttggacaggagttcaagaccagcctgggcaacatggtgaaaccctgtctctactaaaaatacaaaaagttagctgggcatggtggtacacacctgtaatccctgttactcgggggctgaggcacaagaatcacttgaactctggagagagaggttgcagtgagccgacatcagccactgcactcaagactctcgatctctctctctcaaaaaaaaaaaaaaaagaccacaatgaaatacaactttggactcagtagactgacaaaaattaacaaatgttacacagaatctcttatattgctggtaggagtataaattgtttcaattatttttgaaactaagggtttgcattatcttgtgaagtttaagatagattcacatatatgctcaagcagcaattccacctctgggtatttacctaaaggaaatgatagcatgaatgccccaggagacatggtcattaaagttcttagtagaactgctcacaatagcaacaacaaaccaaatgcccattgacgagagtggatgaataaattacagtgaaatattttgcagtcaaaattaacagataaatccaatatgacttaacagtggtttacagcgaatgttttgtttctctgctgacacatcaatacttgtgtcttcatatgtttagcatttttattctgaacttatatgtggttgaaggtcatctgtgggagtcagaaactaaattgagcatgctgcctccagagagaattagcatttgcttgtttttttcgggtaacatactgctatggactggggccactttagccctgtttgagtatcctaggctattagtagagtcaacttttacttcttacagcttattcccaaggcttattctccagtgtaaccctagatttattttttattatttttatcttttttaagattcaagggatacacatgcaggtttgttacatgagtattgcataatgctgaggttcaggcttctgatgaccccatcacccaagtagcaaacatagtacccgataggtagttttttagtttttcaacccttgccccactccctcccttcccatgaatccccagtgttagaaatgcttgttccccagtgccgtaaagaaatagcacttgaacataaatttaatttcttcagcaaggccatttttactttctgcagaaagggtacactcactagcagttttgtcaccagagtacacagaacaaaggagacagggtcatttataacctgatgcgtccacactactgctgtgtctgatttccactggctggaacgggacctcacattctgtatttgtcctgattggctagcaacttagaaccttttaaaagaggcaaaggcagaggagaacaaaggaaggaggaagtaacttgtggaatgctgagaaaggtaaaaacaccttcaaataaggaagaggaacaggctatgacctaatgcttgcttggaccagtataagcatgccagggcaaatatttaggctaaattgtgggagataacataaagtacattgatttctttattacagatagcagatatttaagaatgttggcacaggtctttgaataaattttgcttctaaggaaagttactgtttattcctaattagatggggaagaaagtctttgaagaggaacgtctactttttttttttacaccagtgtctattgttcctatctttgtgtccatgtgtacacaatgttgagttccaacttacaagtgaggacatgcagtatttgtttttctatttctgcattaatttgattaggctaatggcctccagctacatccatgttgctgcaaaggacaggatttcattctttttaatggctgtatagtattccgtggtgtatatgtaccacattttctttatctagtccaccattgatgggtacctgggttgattccatgcctttgctattgtgaatggtgttgtggtaaacatgagtgcaggtgtctttttggtagaacgatttattttcctctgagtatatacccagtatgggattgctgggtaaataataattccatttttagctctttgagaaatctccaaacagctttccacataggctgaactaatttgcattcccaccaacagtgtgtaattgttcccatttctcaaccctggaagggttattcagatagtgtttgccagactgctggaagtgtatttcactaactatagtttgattcatatgtcttccgtgacttatctgtaaattccttgaaagaaggaacttctgacctaaaattttgaataaaacattaaagttttagggaaatttggctgggtgcagtagctcatgcctgtaatctcagcactttgggaggccaaggtgggaggattgcttgagcccagaagttcaagaacagcatgggcaacatagtgagaccgccatctcaaaaataacaaataaaataaagttttggggaaaattcttatatatttagatactatggtaacgttttaataaaataaactgagttgcttttcatgtatttctgttttctaaaaattatgtgctatattaattacctgttcctgccctggagatgatgtttggttatattttcaggttctttcactatttttatttttgtctgtttggacttacaacttttatctatgttaaatctggtatttatacttccctttaaagccatatattttatcaaaaaattattagagaaaatttatactcacatggtattttctaatattaaaaactccttaaaaaaactcatgtctgtcaccttgctcatttcctttttttattttttgagacagagtttccctattgtcacccaggatggagtacagtggcacgatctcggctcactgcaacctccacctcccgggttcaagctattctcctgcctcagcctcctgagtagctgggctggcaggcgcccaccaccatgcccggctaatttttgtacttttagtagagacgaggtttcgccatgttggccaggctggtctcaaactcctgacctctggtgatccgcccacctgttgagtgctgggatacaggcatgagccaccacgcccggcccaccttgctcatttctaattttgttttatcttctgattatattttttcagaaatttgtctgttagtttcttcaagaaattatcaatttatccttttagaaatgtttaataatttctattgttatttcttatattctaaccttttttaatttttatgtttttgtttttgtttttttgcatttcttcttttctcctcagttcattttcgattctttgtttttaaaataacaccattggcctggcgtggtggcgccacctgaaatcccagcattttgagagtttgagatgggtggatcacttgagcccaggagttcgagactagcttgggcaacatggtgaaaccctgtctctaccaaaaaaatacaaaaactagcaggacatggtggcatgtgcctgtagtcccagctacttgggaggctgaggtaggataatgacttgagcccgggaggtcaaggctgcagtgagccactgcactctagcctgggtgacaaggcaagaccctgtctcaaaaattaaattaattaaataacaccataatttatgggtgtgtatttatttatagctttagccacatataaactcttaaaatgttatagtgtattttattacttctaagtaacctatgattttatttttacttcatcttaactcacttattgaagaggttaatattttaggtagttgaaatgttttcctgttttaattgtcagtattaatttctagttataaatttggactaaagaatgtgacctgagcaatttcttcattttggatattactgaagttttatttgtgaccaatatttgaaaccatttcatggttcctgaacaagaaagcatggtatgtgcttcaaaatacaacattcaacttatagctgtattcagtgttgttaattgtattttgaaagtaaaaactaaccattggtttttgtctacctgatatatatgtgcctgatagtatcttgttgtcccctgctatgtttttgtttctgtcaatgtatcatattttaaatcatagttattttataaaatgtgattgtgagttattatttaaaccatgccttctttagaggttggaccttttatcagtgtgaataactctttttgtcccttggatatcaattaaattgaattctaatttttttttttaaccttacctcaggtgctgtttggctcctgcagccaaatacactgatgatttaattaaaatgtttatctcccccaaattttaagaactttatttgggttatttggaataatgtataaaatatctatatagattattatataattcagggggaagcaaattatcagaacaatttcatgttatacaaataacatcagaaaaatatcttaaattatatggcatattctattgattcatccacaaatttataagtccttaccacctttcattatattggtactaggcattatagtagtgctaggcactatagtaatgctggggtataaacaagaataaaacaaaataagttccttatttcaggtaacttacagtataggtcagtggttcttagcttgctttttaattatgaattcctttgaaagtctagtaaaataatccaacaccattattccccattgcacatacccccagatgttttagacatattttcaattgctccatggaccttaagaaaacttggttggtgtgcagtttggtgtattatgggtaagactggacctggtgttagaaaatctgcatttgaggctttgttctgacagtgtctagtgtaaacatgggcagaccacttaaacctctctttagtcttctctgtagaatgatgataataccatctaattagcaggattgttgttttattcagtgagacagcatatgtaaataacttagtaaaataaaaagcaacgtgtttataa

SEQ ID NO: 337 - DNA, 5067 bp, Homo sapiens
cagggaagccaaaagattggacaccccagctttaaatgtagagtatttaagaggttcagttaaatgtactaaatcagacttgtgtgatttagacacaaaatctgtgtgtgtgtgtgtttggtcttttaaaagatactgcatgtacaaacatgatttctaataattgagggtttattaagtttttccctttaggctaaagttttattttattctgcttggatagtaaatacagcattttaaaatgatgatgctaagtgcttttttaatatatgcatgctgcttcaataggtcttttaaatatagccaaggcagggtaatatttcctgagtgatgatagaattatagaaaatcatgaaagatgtgtgcccatgtttcattttataactgttccagtcatattgctatgaattctagaattttaaaacctgccacacttattttggatgttatatacacataatgcctcaaatttccattatttcatattatttttctccatttccctcgtgtcaagtttcattttgttttcaatgttttgtttttataatattgccattttaatggcttcaatcatgctatgacagattgtgccaatttagctttaaaaaactcatgggctacctccatgaactcacacatgcggcattgttaaagaaccttttttaaaattaaattttctccagcttttcattttgcagcatacaaaaaaattgaaaaattggtataccacctaaatccaaccattattaacattttgccacactagctttatctctgttgggacactttacccctacatactccagcatgcgtgacctaaagatatggacatcttcttaattaacctcagtgccattatgacacctaagaaaatttaaattaattcaggtcacttcatctaagttcaaattcaaatacaattgcccctctgtaaacgtgggggattggttccaggacccccacctcgtgtataccaaaatttgggcacactcaagtccttaaggggaaaccgcgtataagaaaagtcagccctccctatgggtgggtttcacatcctgcaaataactgtgttttccatctgcatttggctgaaaaaaaatctgcatataagtggacccatgcagttcaaatctgttgttcaagagtcaactgtattcccagttgtctcaaaaatgattttttatagcttttttgttttggaacgagggtaaaatcaaggttaatgctttgtatttgattgtctcctttggtcttgaagtccccttcctgcaccaccacctgcccctcaatggcttttttataccaagagactgaaaatgctacctctaatgacttttctccccatgatagtactctttgaaggaccaaagttactttgctcctattatgtggtttgatttgttccctttattcctttcatgtcctttgaactggaagtcaagtctataggtttgattaccttcaggttaaatgtattgggtaaaaatatttcacagattttatattgtatcatattaaaaggcacagataatctcattattaatgttggtaattatttggttaagatgatgactaccccattgtaaaggttattgtaaagttctccctgtggtaaaggtcatttgttcacccttagtaatctatggagtaatgttttagcaccaggagaatattctgtttcccaatgcctttagcatcaattgatgattcttgactgaatcatttattacactggggtgcaaaatggtgataaattttttttagtgctctaaatttcttctacatttattagtttatattcttttttaaaataaaaaagtatatttccctcctgtttctctaatatccctctttaaaaaaaagaccatgtcttcatgaatttaaaaaaaattactcaatatattatagccaatcggtcacagttctttttgatgctcatatatattgtgagcctctagcccatgtaagtcacagcaagctagctcttgggttttttttgagatggagtttcactctgtcacccaagctggagtgcagtggcacgatctcggctcactgcaacctccaccctccgggttcaaatgattctccttcctcagcctcctgagtagctgggactataggtgcctgccaccgcgcctggctaattttttgtatttttagtagagatggggtttcaccatcttggccaggctggtcttgaactcctgacctcgtgatccacccgcctcggcctcccaaagtgctgggattacaggcatgagccaccgcgcccggccactcttgtgttttttaaacatgaccacattagtcttttagtccttatttgctttaggcacaagaaatctgaggcttaccttatatttgtcttgttccaaatttggattatcagctaattctccaaggagccctataccttttaaggggagtgggatttatttaattttttctttggagtccttctagccagtgaatggaatttattatagaatccattgttactgagctgtcattgtttctaggccattttagtggacatagctaggaaatacaattttaaaagatcatgaattcaaattaatatttacaactaaaatttagcaacatggccaggtgcagtggctcatccctgtaattccagcactttgggagtctgaggtgggaggatcacttaaggccaggggttcaagaccagcctgggcaacagagtgagatcctgtctctacaaaaaaaaaaaaaaagataaattttttcgaaaagttttatatgaaaagtgtactctgaaaaaatctagctgtcatacctatccctccattcctaaccatctcttataagtaattattatccatctcttataagtaattattataagtattttcttagttttccaatttatctttcatgtgtttctttttaaaaagcaaacaaatatgcatattgctgtacttactgtgcctctttcacaacatggggtctttataaaatttctttggatgtttagaaaggtttgtatgctctaatttatactgataacattttatataatgcatttagagtccccaatttgcttgtctaggcctctactatttaatttgacacctttaaatgatgttctttgactcttatctaattgtctatgtgaccgtcagtgaatatattatctgttcatattttctgtagtcttatttctttttgattagaacatataatatttacacactattttcccatcctaatccccacctttgtaataaaattaattaaaattttaaaaaagtatatttaataacctactgatacttacctgaagtctctctggtcaacttttggctggatgaagctcttctgtagagtattcaaggagggcttgtaagtactgtacaatattctctgagttgtgacatgtttaaaatttcttctggagcctagatacttaaagtacaccttggccatgtagaaaatccttgacaaacatttccttttcttgagtttgtctgaatttgtgcttcactgttgggttgcttgatgttatcatcaagaagtgtggcaccacttgatttttttcccttttggaaatgacattttgtttgttgttttttacctagagacccagataattttttctatattattttatctatgatcctttttatctcatttttgttctcatagctgttttattcctcttctctgtatttcttactttacttttatttgtgtctctcaggtaccctgtgatttagttttcatttttagatgattttatcttttcagtatattgcctatgtttgttcaactctcattttacatcttactattgagtttaaaaatttttatttgctgtgttcttttatatgtgcaattaatgatattcatgttggagtgttgtatattatttgcctctgcttcatattgtctagagggtagtattttctattgattgaaaagttttcattttctgttttttataatagccttgtatggatttttggtggcttttctattcatgattaaatgtgtaggatcttcttcaatcagcaataacaggtggctctatagaatggagggtagaagggatgtgggtgacttactcagtttttagttaaagaggaccctcttctgttagcatggtgaagtgcagtttctttaataaattgtgcatggtgggggtgggatttggattctgtgatacaatcttgtttctttaggaatcttttacttttggccacttgcctttctttccaaggaatcccactccctttcaaggtgcctcatgaactgttttcatgaactttccaaacattggtttctgcttgtttctaagcctgattcttggccttctcattaattttcaaaacttccaatatccttccaaataattcccttttgcttacgttagcgagtactagtttgttagccagtgttagtttctgttgatcctaaccaaaaaaccctaactgagatatcagtctcttagcgcaaagtttgtgaatacggtcatccctccatatgaggaggggagtgggaattggttgtgggacttccgtggatatccaaatcagtggatgctaaagtcccttacataaaatggcatagtatttggttatcatcctccccatacatcatctctagattatttatagtacttaatacaatgtaatgctgtgtagtcatactgtattttttacttgtatttttgttgttttgtgggatttaaaaaatatttttattctgaggatagttgaatccacaggatactgagggccagctgtattcacaacccaaatcacatacaaagcgacaagttcatacacaataggcctattagaacaggactgttctctcttgtttatcattgcagcctttctagcacaaagcctgggacattctggacatttagtatgtgttaaatttctcttactacattatttccaacagtatttactgcaatctgcaattaccttccttttgttttgtaactgtgtcccccactagaatgtaagctctgtgcagatagtgtctcatttattgatgtatccctggcatctaataaaacactgacaacac

SEQ ID NO: 338 - DNA, 565 bp, Homo sapiens
actttttcctcctgctggaggagtctgcgttgcttcctgacctcttcaacccaggctttttcatcatctgaactctccgaactttctgcatcacttggttttccttccggctcttcctcctcttcctgagaataaaaatatggattcagaagcctaaattcttcactctcttcatctacttggaagtcagggttctcaaacataactttaaatcgatcatcggtgagaatattaggaagactctacaaggaggaaaaagcttggaagccagatgaaacggcttactcagaattgtttgtcaatcagagtaaacagccctgaacactgctggaaaaagctgacctgtttgtgatggactctgactctgctgaacagactactttactatttctccactgttgagagtaaacaagattgcaggcaaattaatccaagtcaggtcataaataaaaaccaagtgaagcgcttttcatagcgaaacagtcctaacccgagaatcggatgcagcagcatttcctacagttaactccatggatcactagtcccaagagatcttctgagaaaa

SEQ ID NO: 339 - DNA, 549 bp, Homo sapiens
agaattactcccgaactctaccagctgaaatcctcctcaactcacatcagacaagacggccctgccacttacctgtcagatcactttgggcagtttacaggagagaagatgcagcctgggagagatgcagcaggtgtctgaggccacacagcaagtcacccagggccaggatctgaagctgggtctctccagctccactgcctgggcactttctcctccacagcgaccttcaggtcatcatgaggagcctttcggactaaagctagagagctgggattccaacagttcagcaacccatgacttctccatggcagctgctgcctgaccacctagtgcctttccactaagattgttccttccctctcctgaagattatcctcctgcccctctctcccaaacatctgcggtgtgcacctgctgcccaaagttgaacttttttttgttagagacagggcctcactgtgtcatccaggctggagtgcagtggcgtgatcatagctcactgcagcctccaactcctgggctcaagtgaccctctcacctcagctt

SEQ ID NO: 340 - DNA, 616 bp, Homo sapiens
ggcaggcaacgtgttggaccttccggagcttctcagaagacagagggttttcttttgaggatttaaacctcagacacagggagctgacctattcaccttagaatcctctggggcacccattacagtgtctgtaccaaggaggcaacaaagaacggcggaacagactggagcagaaggaccacccagcagagccaagccaaatcactgaccctcagaggcctgatgtgaatgcttatggcttcagtccattggattctgcagtaatctgccgatctacagtattaccacagtaaataaccgatagacctgaaaacgaatgcatgccttgtgccaaaattgcaggaaacctcaccaggagaaacaattttatatgagggaatgtactctctcctttgcattttccctcaaatctatatttttagcccctcacttgtctctacagagcctcagttgcttaatctaattgctgactgaacatctccaggaaactgtgtgtacgtgtttgtattcatagtatatttatttattatctgtttacttccatgggatatagtctccataagagagtagtcatcattgtatttgttgatgcttaataaataatcattgaatgggc

SEQ ID NO: 341 - DNA, 711 bp, Homo sapiens
gtgacgttccctacgcggtcgggcgttgggtttcgcggcgctcgccgcactggttgttcagcaccttcggtccggttgaggttgtcaagtcggaccaaacaggttgtttctctgcagtttccaacatggcagggaggtttaatagacatggataagaagtccactcacagaaatcctgaagatgccagggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaaaagaaaggacaaaatatgaaacaccaagaaaaagagaaggaaaaaaaggaggaaacaaccacatatgtcacctttccaagagggactgaaactgggctgacccttttgatttccaagctcagcgttttggtgtaaggcggccaaagaaggatgcggagcccagcactgtgaagcctacaaaaacattgatgcgctggcttggggatttgaatttgaacatctttcacactaagttcagactcatgaaaccaatcttcagatgctctgtaaaccacataataaagagtttggaaattat

SEQ ID NO: 342 - DNA, 658 bp, Homo sapiens
gtctgcctaactgcaaaacaatttggttggcttataaattgctgcctctatcatgtgcttctgaattaaaaggaacggatggtttttaaaggtttatctgtttcattattgatgcagaatgacctcgtgctgacaaatttcgattttcacacggtttctttgctgatgcagtatctctgccacccatgctctagggcagcgtggagccacttcagagcatggcttttgtgagccagcgcccagcagggtgttcttttctgagtgcaaagagagaatccactgacctcatttgcttccatcctgtgaacctctcagtgtgtttcagaacaccagggtctgaacagagaagcttcagaatactttctccgactagagaacttttttatggtgggaggaaaaaatgttgccagtcccacttcacagacacctggaattcatgaagtctgaggacttctttcattttactttcaactaaaagctctagcacgaaacagcaaaggctcacagaactaaagatcaggaggtggccctgtgagagggtgttcagcctggatccctggtgaaactccatcattgagcagcatatctacttcagaaagcgtggaaagaaaagagcctggtgggaaaagtctatcaagtgatagtgacgtgcccttat

SEQ ID NO: 343 - DNA, 365 bp, Homo sapiens
cactacaggcaagaacagcaaacctgggagaaactgactctataaccagtggaagaaaggctgcgtagccatcgccggatctctaggggaaaagagaagacacagagacacagacctgccccggaggaatccagagcccacctgcccagagaggctcctcctgatttccctggctctgggcacccccttaaaagccctttatgccatctttcctttcagtcaaatgatgcaggatttgggaccagacagcctttgctcaaatccttccactgttacctaccagcttggtggccttggagaagttatttccctgttctggatgtgcttcctcttctataaactagagacgctacaaattcccacca

SEQ ID NO: 344 - DNA, 505 bp, Homo sapiens
accggaagtcccgcctctgccgtgggcctgcgagaatcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcagtagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggccctggtacagaaccatgactggctgctgaattctgaaaaccaggacttggttcaacatttaaatttgatagttgccctgattcccattttgggtttgtgaaaagtgtatgtatttaaatttgctgtaaaacataatcactaataatatgcaataaatattttcttgaaggaaacta

SEQ ID NO: 345 - DNA, 2886 bp, Homo sapiens
ggctgccctcgggcctggctcgcccgcgggcggatggctccgggtctctgctgctgaggatgtggctgccgggcggaggtcgtccactcccctgggcctttctccgcgagccctcccacgccgcccgctcctctcccggggcgaagggcggggacgaggcgcgccgaagccccgagctgaagagaagggtgggggcatgagggcgctggagtgaggaacagattggagccttcccacttcctctccaatctcagcccccgggaggaggggtgaggccctcgagggggcccggagttaaggaggaatagaccgtttctctctctcctgtctcccccgcctctgcccgtcttccctctaagccggcctctaggtgcagaggctgacgtccaggatggggaccggggaagcctctggagggtatatccgggaaggcaccaaggctgaagtgagagcggttctggggaaggctttaaaaagcagatatggaccagggtagagttcgtacgctgtagcttttcaagaacaccgatctcattaattaaagaacagcaactatttaattccagttataaactattgttttccagttagtctgggtaggtgtggccgtttgtagaatagttagattacattagtctattgcgttggtacagttgtctatagcttgagcatataaaaactcctgagcccagcagaaaagttactttccaataccagtctccatcctccgtgctttggaagttgcatcgttttccggtttttcgtactcaaagaacactgtcaattatgacagctctgtgacctctgaaagatgcagtctagcacctcagttaagaatatggactctaaagtcagactgccaggcttcaaattccagttctgcgacctcagcaaagttacttaaccaagctctcagtgccttgttttcttcatctgtaaaatgaggatgacgtcacagcattgttgagagaattaatacaggctccagacttgtgaatggagaagtgttgaggtgaccccagctccagccaccagctgacgacaaccataccggagatcctgagagctgcctagctgaccccaggcaccccccagacttattcagcacttagaagaatgccaggcaggctttccccaccaaccaagatggaataacagggaaaagacatacccttctatcttcaataattggaaacccagacaaagtttatgaaacgctggttttcaagacataggacatcagacaatcaaggacagtaaacactgagatgggaaacaaacaaggatgttacaaaggacacagatcaagagccagctggaagagatgcacagggaaggggtgcggagctcccatgccctctccagggcaccaccctccaggcacctccatgtgttcagctatctggaagctccccagactctgtccttttgggttttcatggaagcttcattatgtaggcatgaataattatatcattgaccactggtgaccaacccaaacttcagatcctttcccttccccagaggttggagggtggggctgaaagtcccagccctctaatcatggctgggccaccatttacctcattagcatacaaaagactcctgttgctttagagattccaagggtttgggaagctatatgtcaggagacaggagaagaccaaatatatatttcacagtatcacacacacatactctcttgatcacaggtgaagttttgcccaaagcaacagaagtgaagcaagcttctattctcacagaggtttgggtccggtagatactaataacttctattctctgatgcattgtagtagggcagacattaagcatttcatgtgcattttttttttctttttgagacagggtctcactctatctcccaggctggagtgcagtggcactaacacagctcactgtagcctcaatctgcagggcttaagcgatcctcccacctcagcctcctgaatagctgggattacaggcatgcactaccatgaccagcatatttgtattttttgtagagacgggttgttactatgttgctcaggctagtcttgaactcctgacctcagcctcccaagtagctaggaatacaggcacatgccaccacagccagcatatttttgtattttttgtagagacagcttactgccatgttgcttaggctgatcttgaactcctgagctcaagggctccacaggccttggcttcccaaagtgcaaggactaaggtgcaactgccacacccagcctttcatatgtattatcttatttaagcttcactttacaagtgagaagggcagccttggctcagagaagttaggtgacttgcagcaaatcacataattgctaagtgatggatctgagctttagccccaggactatctgaccttgggtctaaacttatactactgtatttttcgttaagtcagtcagagttctatcctttgacagaaagtataaccttcttttaaggcagaataagaccctctgcccaaccctgctctttctttctcctccgcactaagaagacagcgaatacagtagagggttttggactgggatagtggttgcagagaagatctggaactaaaaatatggaccaggggtagaaatggtggtgattccaccaaacttggaaacacttaacaagaccccataacatgcaagatatgcaagaaatggggtacattttctataccagtgccttaagtaaaaaaattccttgttaaacaaatgatttagagaagacagaaccaaatatatatatatagctgtgtgtgtattctaataaaggttgttaaagtcttaaagttagtggtgggagaaaacaataaaaaaatatgaaatctccctatgttaataaactaatttcaaataccaa

SEQ ID NO: 346 - DNA, 748 bp, Homo sapiens
ggcattctgggaaactcaaaccgtcaccgagctttctgtgaagtacttaggttttcccatgtagagaggtagcccagctcaatttgaggatagcgtcttacttactgaaaggcagatctcaaagccatgtcccaaaaggcagggagtctgactctctcttcaaagcaaatagatattctaacacatgaaggacaagaatatcaccttaatacaacaaggttcacattcaggctctcaacggtgaagcaatacaatgaacaccagtgaggtgtgaactcctctgcagacatggttggtgctctgcaacctcagtgaacacccctatagtgcaaagaaaaaagggaaatcaaacttcatctttttttccaagattgtcctctgcaaagaaccttcatttcagaaacccagaagttttcaaaacaactgtgggaaagagagatgaatttgcaggccttctgaactctacccacaaactctcaagagaacccacccgctgcagcctgtggctcccaactgtcctgcctacgcccaacagggaactggggatccgtattccagggaaccctctggaaacgtcacactcagttagcagattcttgagggcggtaactatagttttcagatctttgtgtcctctgtacctggaccaggtagagacttgataaatatctgtagttgttaaataaatgaaatgtttatctttgctgatctcttaaaaataaatcagttttacctacttgccatgcaa

SEQ ID NO: 347 - DNA, 655 bp, Homo sapiens
ggagtgcatgactcatctcctggcccctccaggaaaccggagaaggcagaaaagggcaagaatgttgtgttgtctttgggctgtggagttcatgattatggacactttctgaattattggcactaagggcacatcctgcttagcatggaggctggacagctctgggaaagcagagattctttttagggagtccagagcatttttttcttctttcttatcccctctttccaatagagatgtcagaagggtgactgttagggttgatacattatgtggtgctctgtttttttgagcattgtctactcagagtgattaccaaggtggagctcattatgttacctggcacctgcaactacttgcctcatgttggactaaagtggaaagactcctattgggaattcactcagggaggcaccaggcattgttagaaaagcagtatcgcagagcacttaagagctgagccttgtgatcgggtggacttgggtttatgtcctcgcactgtcgcttcctagatttatgacctcagtttcctcatttctaaagtagagacagggatggagggtggggagaatatgaattaatttggattaaatggatgagaatcagaagtatttatttggaattggtgtgaattggagcacatggggaactgaaa

SEQ ID NO: 348 - DNA, 3231 bp, Homo sapiens
atttttgtaactttttataatgagacttacacattgatttaaattatatacaggatgctcagccagcacaaagctgtggtgagatttgggcccaagtctccgactccagattccaaaccacattaaaaaaaaaaaaatcacctgcagactgcctatagctttaacagtctctgtctccccttcttcacatccttccggtggagaaaagtttgtgaatattaagtaaatttgattcaatagacattttatttttttgtaaagatgatggggtcttgctatgctgctcaggatggtcttgaactcgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgtttccacacaaagacttgtatacaaatattcatagcaactttatttggaatagcaaaaaaaagggaaaacaacccaaacagccatcagcaggtgaatggataaacacatggtggatatccatacaatgaaacactgctcagctgtgaaaaaggaacaaactattgaaacaatatccctgttcaggagcaggatttggagaatataagaagcatatcttttataatttaaaaacttgctttctaagatttgaactgaaagatcttttttgaagatgagtgtcatggaattgacatgatttgaagtgttatggcacttcctttgaataaaaaaatcaaagttgctaacaagttccatgtacttaaaaatattgggacagagcgctcaaagctatgaaaagttttgggccacccatgaatatgagataagattaacaagagaggagaaggaagtgaaaaatatggctttccatgcatttccaattgtatgaattaccattgaaggctagtgatgaaatgttactctctaggagtcagtgttttcacatctaaaaatggtatcagtcatagaaaaagcttatctgtctactgccaaaaagggaagagggtaatagcacgtattgagcacctactgtatattcagatgaggtcctgccatacgaaattcagtccccactgttctgggggccatgcaatcgtctttagataataggtgtggggctaggggttccgctgtgaagttaccttccttcccagggtgctcagccagcacaaagctgtggtgagatttgggtccaggtctcagactccagattccaaaccacatttaaaaaaataaaatcatcacctgcagactgcctatagctttgacagtctctgtgtctccctttcgtttgcatccttcgggtggagaaaggtttatgaatattttagtaaatttgattcaaaagacatttcttgattatcacattggttctcaaagtgtggtccctggaccagtgacatcagcattacctgggcactcattagaaatgcacattctcaggcctactcctgactcccaatccagaaacacagtgtgggtccaacaatctgttttaacaagtcctctggttcgctccaggctccagggtgggacagtcactggtgcttctgctggctgggacaacagggccccactgtggaacttgcagcccgtgaccccctcctaacggctcctctcagttcccgtggtcccaaaagccctctgtcccgtgcagggctgccccacagtggccttccacatcctcctgatagcagaggcccccgccacccccagggccacctctgcagctgtgccgcagcttctctgcccaggcacctgcactgacacggagcaccctgtaggttgtctgcttgaggcctttacctaaatgcttgccgcagctgtttctaaactacaaaagcacacaatcatgaaatgaggcagaggtgggctgagtgccacaatggatgccaagaggaagagagatggacatggcgctgggaggctctgggcaccactggaggggggcgctgagttcccgggctgccccggctgggagaggagtcgagtcttaatctcctttaaggaaacataataaataaactactttgccactagagtgatttatgtgttgatttgggtggaatctctttcatgaacacattttatgtctttttaaaaaaattagattatttcttggccaggtgtgggcacagggtggctcatgcctgttatcccagcactttgggaggccaaggtgggtgcatcacttgaggtcaggagttgaagatcagcctggccaacatagtgaaaccctgtctctactaaaaatacaaaaatttgctgagagtttgtggcaggtgcctgtaatcccagctacttgagaggctgaggcaggagaatcgcttgaacccaggaggcagaggttgcagtgagctgagatcatgccactgcactctagcctgggcaacagaatgagactccatcttataaataaataaattagatttcctaccactacagtgaagcataattttatgatttaggcaactaccctaaagggaaataaaactaagtgagattccacatggtctcagtaatacctgtagtgcaaaatcaaatgcttatagggagtgaaacagaatgcggccgatacctgtggaaaagagtgcttcaattgtcttatgtctacgaccagcctaagctcatagccatacaaatatatataccatacatgtgctgaaactaagttaaatttcttgtttttaattgtcttaagtatcaaacttggatcatcagaacatgttggaaaaacacggctctgaagccaacttattaagcacctgtgctgtatcgaacattttacatttgttcatttaacatatctagataaatctactcatttacagctatagtgatccaagatttcatcacagcagattaaaacaaaacctttaagttaaaaataatttaaaatcagtgaatatattaatactatgagagtctttgcctatgagaatacagaactttggcccaaatgtttcattaatctacagggttatatacatttggagcacagttttgttgtttgtttgtttgtttttaatcctcttcccaaaaatgggtttctttaggcagctcgagactcctgtgttagacaagaggaaaaggagtgggtgcctctcgactgggaccagtggacattattatgggaatataccagtggtggcaggttgatga

SEQ ID NO: 349 - DNA, 1911 bp, Homo sapiens
agccccatcagcccctcagcccttagccctcagcccctcagccctcagccccctcagacccctcaatcccctcagccctcagccctttagctccttcctcttttccatcagttggtgttctctgtgcccccagagctgtgctctccttcttatggggcaacctaaattcagagagcaccctggcttggtttgccactttgttgtgtgggcaggttcacgtcttccaccagggcctttgggtggcatatgacagtttgggactgtccagtctctgtactttctggggcctctcctgttgaatggctaggcacctgcaggtgtaggggctcagggtcacctccggcctgcaggtcaatgtcttgctgctcctgtcctggggagggcagctctctcctagcccaacccaaaagcccccagaagcctccacacagccagctccggagtctgtccttggcttaggtggcttcaggactgggccaggcacctccctcacaggacaatcagacatgaagggtacctttcaatcacacaatcctacacagtcctagacattaggtgggtcctctgccctctgcaggtgacctcatcagagagcccagcagcatctgcccatttcctgtctacattctcctccctagtgcactgggagtgggaggagagcccaaagctcccccagatctttaggaagccccactgtcaggctgagtggagggccttagtgacaagtgataacttcagggaagtccagagtgggagacacatctggggtccagcttgctggtgggcactccctgctcatgcccacagcctcgaggggaaaaggtcataattgacaggtggttcctggggtcctgagatccagcccaagggatgggacgacatgctaggaaggggaaagtgacagaaggttcatatgcatcacacaccactttgacaaacccatacatagcattcactatagtgaatagaaaaactcacgaagcaccatagttccagcactttgcaaatatcccccacccaatacctttgaggtgagagttaccatcattgcctagttactggtgagaaaacagaggttccatgacgtgcctgaggcactgagggggatgatgtcagcacttgtggccgcacgtgcaggcacacgccctccatgtcacaccagtgcactcactttgcagatgaggagcgatgcctgagcactgggatggcatcattggcttgtgttggacagtgcctatataggagtccagcttctacccacttgttccagtctatccacattttccaccaacagaacgagtttactagaaacctctcctcaaattggtacaaggactacatgacatggcatgtgatgacacacacacagaggagatcctttttccagcatgcaggaagaggagatcccatacatgggcttgggggtggcttccctcactgcagtgtccggtcccccagcagctctgggagcaggagtgactatctccgttttgcagatgaggaagcagaaccataaaggtgaccttttttctttttcttttttacatttaaagttaaattggtctcccctcaaaaaatgcttagacttaattattttaattatcctcacatatactcctccggcttctttactgaagtgtaatttacacaccataaaacttaccatttgaaaacgtgcaattcggtaatctttagtatattcataaggttgtgcaaccaaccaacaccattatctaattttagaacattttcatcaccccaaaacgaaacccatacccatcagcagtcactcttcgttacctggtagtaattacctacccctaccctcagcccttggaaaccactaatgtactttctgtttcttcagttatgcctattttggatatttagtataaatgggatcatacaata

SEQ ID NO: 350 - DNA, 1298 bp, Homo sapiens
gtgcgtagagtttaagcagtgtggagatatttcttcacttttccttagggtgtccacatcaagaccctgaggccatcttaccacccttctggatcagaagaggccttcagagccctccgctgccgagacgcggcagactcccagagcggctcacccactcatcgaagcggattctgggcggtttcgggctgacccgcgctgtcagggcgcggactccattccgggcgcattgttaggagaaggggcccctcggggcggcgcgcctcgaccctgggctcccggtgcccgcagagggcggagatccgcggcgccctaggccacctatccgcatcttctcgagccaaacccccagcgcttacccggacccgacggcccaagcactgactcccaggcaagagtcgcccttcctggtccccagggaactgacactaccgcgggacgttccctctaggacagtcagcaggtcccaggagcgcagcacgcaacagcgcagagcagacccagacttttcccggggtgagacccggaggcccgcgctctggaccgtcctccctacccagcctggaggccggcgttccccggcccaacccggagacctccccgcctccctcctgggccgccgcgcgccccagttggagcagcctcgaggggctgggccctttcggccggactcccttctcccggacatccaaaacaggttaccttgtccacgctctccggaccacgctttggacttgctcacttttatttaagagtccgacgggggaaagagggaaaaaaaatccagaggagatccaagtcaattggaagaaaaaatttcaaaagggtgtccacagaggcgaaaaaagcccaggctctaccgaccttcaaactacaacagagctttcaggagaatgcggagagacggcttcccacccggacctcaccagaaacccgcacaccccagccacattgctcctcattcagccagaaaggactccaactccaccaccaggaggccccccttcctggtgctggccagttgcagaggctgttcatggcatcccacaggtggcgactgccccccaccctcctcctagcactttagagggtccctctgtggcagacaccatggctaggtttctctttccaactcctgttggtctggcaagtgacagatcatcttcactacattaatcagtagtcacccgaacattcctatactgtcccccaattcctttcagcaccagctgcctcccccactggaattattcaatatggaactagattaaattgaagacttgccctttagtttttaa

SEQ ID NO: 351 - DNA, 312 bp, Homo sapiens
ggttggagaagaagaacctagtgctgaatccagggtttgtgacaaggctggaagaacatttggtctggctagttaaagtgtggaaagagattcacgctcgtgccaagtatcaagagggatactctgatggactgttcagagccccaatttctgtaactatcacttctcagtgtattgaaagatgctaaacattagaatcaactgaactgactttatcattttattacactatatcaaatcgggttctttgagattcttattctccaaacaatgaaaggaataaatataaactgtgcctgacaaatgaagaaa

SEQ ID NO: 352 - DNA, 563 bp, Homo sapiens
cagcttctcttgcagctcgtgcagcttctggcgcgcgccctcttggagctctgcgcgcagcggctccaccttctggcggtagagctccatctcctcctgccacttcttctggaagtcgtccagatccaaatggcaaaccttcttcatccaccaggacccaacccacaggctacttattgctggaaacctacgttgttccttggattgaagtaatctctccctcctctggtgcgcccacagcacttgcaccaacagtgggtactcaacagactagcgtgcctgccgaagaaggggtcctctgacaatcaggggacaatggggaattatgctctccagactttctacacacacaagtcacacaggaaggaaggtaaagagaaactagagaaaataatttttgaagaaaaacatttcaggaagtattgaaagtacacggtaactcagcctggggcaggggtggagggcagcagcactgtttgctgcagctatgctccttcctcagtgccctgcacacccgggacttgctcggtgagcatctctcgtgtcagtgacagctagtgtga

SEQ ID NO: 353 - DNA, 3329 bp, Homo sapiens
ggcagtgttttgacgactgcctcactaaaggaagctaaaagctgtgctgatgcctcccagacgagcctcgttggaagcacagaaccttcacggctcggagccgctgacaccgtgacaaagggagccctgctcaggatgcggcagcaactcactgtgcatgtttttacagctcttctccagtaatgctgccatttccactgcagaccacaggataaaaggaccgcttcaccgtggcccaggatacccttttaagtaggagagccagatcaaggaaagagacaggaaagcagatgattttacctgccttccctaagtgcactcgggaagagaaggatcatctcaaaaagggttaaggaatgagatcatggaaatcacttacacacgcggtcgcggcttggacttggctagtgaggccggcctgcccactctgcttccattcactcagacacagcttgggcttttcctccaagtgctggtagcagtcatttatgagggaggaaaggagcagaataaacacacttctcagctcccaggcactctgtgtgtgtagacagaggctcgggtggatgagaaacctcagcacacccatgatctttgtcaaggctggagacttgcagtgcacactccaggcctgtggaaatggttccacctgggtccctctattgctcctcagctgccacattagggcacctcgcccaagtccacgtgtgggatgtgcctgcctgtggcccacctaacgtatgcagtctgtctggagtgccaggcacaggctcctcacgtgggcttcagctggaattgaaaactgcatttctcaagaatcacattgcctttgcctcgtaggctcagttggatctccaagtggcggtaccgttctctccacttcaaaaatacacagaaacatgtggaaatgttctgtcatccagaatgaaaagcatgtgcaccaaattttcacagacctgattcgaatgtagataaaagtgcaaaatccagaggagggaacacgctatagaaatcctgtcttctatactataatttaatcatcgtgtgccacagaatgtctttgcataaattacaaccacaataatagcatcactttcacaaaaggtggcctctaatcgatttgactctccaagagatggctgggtttttcaaagcagagaaatgatgacctgcagtcttaaagagctgttgattgcacctggggctcccgtggccggcgcccatcgagcagcccatcctggctgttcccttgttcagctgattttcttttttatcttgacatttgctaaccgcttggtttttattttccgggaagagaggattattggcaactggcaccacccccatgtctggaggagggacgtttctaggatgacccccagagtggagaaatagccgagtgctttggagtcttctcagatgtggacgaaaacagttcgtgagctgcgctgagcagttccggagccctggctccctttccccggggcctaagcccccaagaagagagtctttttcaggaccatgggagcaggttttaaaaggctttctattgaagcgaggccgtcagccagccgtgcgtgtccgcattgtggtggtcccagagccttatggacaatcctttgaaagaatagggttgggaagattctcaggacagaagcggctaatttccatccttggagctttatctcacaaaggatatttgatagaaagaaaaaatggagtctgtggaagctttgctcctatttccaaatgggttgactctggatgcaaaggaatattttcacatttttcccaatagaggaaagcttttagtgccaaaatcctcaaaggagaatgaacatcacacattacacatgtatgtataagggtagaataatatggtacaaaatccagtgagtacaagcacacaatgggcattcagtacaggttaaatgaatatgcaagaaaaattcaaagttgttgttgctgtttataagggtggtgattattaatagatgcaaatgtatactcccttttgtaatcacagcaaggtaaaagtcttatctctgatcattaccatgaggacacttaaatatttagccctggggacaaaatggtttgtaggcaggacgtcctgtgtgtttatgcacacataaaatgccgccctggccccaggactgcaaggcctctgactgcatcatttacattcaggggtggtcctgatcaacatggccccatagaataatagagggaatttcagatagtacagcgttagataataagcgctttccactgactctgtttacatgtggaaattagaagcgctgagtgaaaaagagtagtgaaaataaagacaggaagtatatacacaacaaacaatttttcctctctgcaaatcggattattcccttgcgcaccccctgcaacccccatctatgatgtcaaactcaatggactgttgaactaatagcctgggagtcaccagcgtgagagtgtgtatgtccacgctgtgcaacttgaattaggctggccaccacggctgtgtacagctaccccaggaagagcccctcccctcctcagcatttcagtggaaaacgtgctgactgggacccagctacaggaatcacatttgggcagagagaatggcttatccttttcatgaggggtcttgactcaagaacacttgccaattctgcttgaccgtttcccattctttacggtttttcctatcactccttagactaagaaagaaaaatctgtaggaatgattcggtgggatttctcttttgttcctaaataaaccttatccctggatgagctcgttcacactagggaagttactaccactggctttgaagccaggcagatctgggtgttccttcccatgtctttatttgctttgtgggggatcttttcccagcctttctgctttcatccttcttagtgagagcttcttcagctgcagaacaggggcaataatgcctaccttgctgggttgcagcagagaatgctgcttatgcaggaaaataaaaaaacacatagcacacaatgggagcttaatacataagaattataaacagtcttttgtgtatatatcaatgtatttcatgtccttaatgtttatttaaagcaagtacattcttttgaattaagcataaaaaggtcataaaatgccagagatgtgcttatttgaaatgtttgcaatgctttgcaattgttttaaaataaggagatgatataacagggtgttacctccgccactaattagttacgtaatcttagattatgtcacttccctgggtctcagttgtaaacagttgcttaataaataatgtttgttttgctttcat

SEQ ID NO: 354 - DNA, 3210 bp, Homo sapiens
aggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagtgagtatagtacctgcctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacagtatctcacagtccaggctggagttcagtggcattaacataactcactgcagccttgaacacctgagctcaaacgatcctttcaccttatcctccagagtagctgggactacagtcgcgtgtcaacatgcctggctaattttagttttctaatttttttagagttgggatctcactatgttgcttagactggtcttgaactcctggcctcatgccatcctcttgcctcagctggtattgtaggtgtgagccactgtgccaggtactaattttttttatgttagaaaacaagtttttaggtattttatagttacttccttatgacaatatctcatcagaatctaggcctatctgatatctgactccatacgtttataccgtgtagtcagccattcccagatagaggtcatttgagttacttagtgtttaccagcacttgtttactaccttgcgatgatatttacagtgtatttttgggtatggttttggggttatttggttgttgttaaaatgcctgtaatcccggcactttgggaggttgaggcgggtggatcacctgaggtcaggagttcgagcccagcctggccaacatggcgaaaccctacctctactaaaaatacaaaaattagcctggcgtggtggcaggcacctgtaatcccaactacgcaggaggctaaggcaggagaattgcttgaacccgggaggcggaggttgcagtgagccgagatcgcgccaatggcactccattcagcttgagtgacagaggtgagactcccatctcaaggtaaaaaaaaaaaatagaaatcagcaactgctatttgagtttacaggagtgagaagtcctctcttgcatggtgagatggggaacatttaattcaatagaaatatttgagaccaggtatggtggctcaagcctgtaatcccagcactttgggaggctgagttgggtggatcacctgacatcaggagtttgagactagcctggccaacatagcaataccctgtctcaaagatacaaaaattacccaagcttggtggtgtgtgtctgtaatcccagctactcaggaggctgaggcaggagaatcacttgaacctgggcggcaaaggttgcagtgagccgagaccatgccactgcactccagcctgggtgacagagtgagactccgtct

SEQ ID NO: 355 - DNA, 1924 bp, Homo sapiens
gtgcttggctacagccgctgctgcctctcgcgaactgggctccggggctcccggctcccgagaactagaagagaaacgcgagcgaagggatcgaaacccggggggttaccgacttgcagacaccgccaggacagtctgtaacgcaggaagatcccagcggctccgggtctggtgaggggaccataagcatgactgatagcgaatgaggaagggcagccctaaacttttcaagcaaagcctcagagttttgggttcactcattagcataggaaatcgattcaccgaaaacccaaacaaagaaaaacaagccgacagtccaggcaggatgcaggcaaatccagttcgggattaagggtaaaaggctttttgggttttttttcctttggtttgattttttaaaatatggggaggggggtgacatctacccgattctaggctccggcaggaacgcaatgggttaatgaatggacaagccgcggagtattgatcggctgccgccggagaaagaaagaaaaacaaaaaccagaccgaacctgccttcccgctgtggctgctcggcgccccaattaagcagggtcatctcaggctggctgcatgcctcagctgaagatcccagctcctgtcaatgccacctctctgcttgactgtctccttccagattcgagcaggtatgagctgggaagaatgaaggcagggcatgcccgtgtgccagctctgcacagctggatagctgaggaaagatgtggaggagaagccggggattgtgtggaagtctaagggtgttgtttgccctttgggttccagaagatgcatgccaggaccctgggtggcactgccaggaagcaacagagaggagataaaactcacagcagacagacttgccttaacaacaactcccttgaattaaaacacgcttttcaagaaaacaaattatcagttcgatcagcaaacagcagagaagtttctctcataatggcaaagaagggccgggttgctgaccagtgaaagagcttcagaaaaggagaggggagatgagatggccagaaggagcaagagcaccgtacatccctggacaacctcattctaatgggtcaggggctgggacgtgcattttggagtgcaggagaagtggcaactcacaaatgctagattttcttctagagatgaccaagctgtagttcttaaagcagtggcactagggcagaaaactctcacactttgatgtgcacacacagcccctggggatcttgttgacatgtagattctgattccgtaagtcgggctgagattctgcatttccaacaagctcctagatgaggtccattttgctggtccatgaaacacacttagaataagtagcaaggtataggaggatactgactttgctcagtgatgcttgggcttccgtccaaactaaaataaaacaaaagcagacataaatggcccaattcaacagcctgagaagtttggtgataatgacccaagccctggcctggtgaccaagtggctgctcagagagctctatctccaaactccttcccttcctgcctcccctccaagagtgagtaatgtgccagagttcattggggtctgctgtccccagggaaaggtggcccagttgccaagtgcaagtgtatagaacggcttacctgtgcaaagctatcagccctggacctatgggcctagaaacattacttgccactcactcactcactatcattcattcatttctgcaacaaacacttcctgagcatatgctatacaccaggccctgagctcagctctggggatacaggatgaatggcagattgtgccatcaggaagccgactgcacagtcagcccgctggagcacatatgaaaaacaatacggatgttttgatttattatcatattgatcattatgatggtagcgtatacttttgg

SEQ ID NO: 356 - DNA, 662 bp, Homo sapiens
gggttccgcttgactctgcattctcctacttccctgcctgcttactctctgccatcatagttttttgcttcaaccttcaaatgtagccattctttttctaaagcggtacttattctctttattagttaaaattattaattttatgcacttactgttctagctccaattttgcatttccagttccctgctgggaataaattaaattggcagaagctcagtctaagtgcctgcaacagaatttgtcccatatccatacaacttgctcctccacaacaaatgggagaatcatcctcttacctccaggctgtgatggaggagaagctacccctcagcacaggattttggtagaataagaataaaaatgacaagtcccttcctgaaaagctcttcattgtctcttgaaaacggtctgtgaaagtgccaaaccaccagctctccagatgtggctgaatatcaaggtaaatttaatttagacttagcttgggatccccgtcataacaaatcggataaagcgcatgcacacacatgtgcacacacacgcacacacactcagacatgtaaaacccatcctagacagttcaaacaaggtttgagtaccactttccacgtatcaggcttacaaggtgccaagaacatagagttcctgaccttgaggagcctgc

SEQ ID NO: 357 - DNA, 565 bp, Homo sapiens
gagcatcgtaaacattatttcaagaggtttccgaaaaggatctctaaaattatcagagaattcacaattcaagagtacctaacgaagaagaagggaaattaatccttcatatggctcaagtgttcacaagaaatgtggttgccagctaaagaggagaggagaaagattctgtgcaactgaaaggtctaccttaaacatcacagtccaacattcaacagtaccacagtgcatctacaatgtcccaagctttagctccgcaccctacagctgtctgggtaaaggagagcatgtgagtggacccaaagaatggctaggtaaagccctgtccaagtctagaacagcaacagccatgctgcagcaatgtggaaacagacctgaagaaaaaactagcactgtgaggatggcagacggaagatggaaagagcttgggtccttgaggacactgtggaactgctgaagagaccatggaattgagctgaccagcctccattcttattctgtgtaattatacatgtctatttttttaaatctccaaaccaaagaaataaaactcttcccaggcttc

SEQ ID NO: 358 - DNA, 2380 bp, Homo sapiens
gaggccccgtgaggacacgcgcggtggtggcggtggcggcgggcgcgcggccgcagccggaggaggacggcgggagcgtgcgaggagctggctcggttatttcggagcgagagccgaggccgggggaagttcctgcggagtgctcaagggcagaagaggtgccgcgtcccgaagaggggaagcggagaagtttgctgctgcccgggtcgcctcgcgacgctgagagaatcgcccagccctccgcagccgcccagcgagaaccggagctgcggccccgcaccggcgtgagtccagctgagctgacacgccgagccggttgtgcctttccgagggaggaatgtgccgtggaatccaaactttggaaaacgtcccacccgaattcccagcgagcagcaaggagaccagagcgtcgatggagccaccgttagttgcgggagggctgtccccaagaggaattcatcactgtcgtccgctgggagggaccaaccttgaaatggggttggtggagagagggatagagaagagccggcgtgcttataaataacaaaacttagctatgaacccttccgattcccaagtggggaagatggggtaaaattctaagtgacttctcgctccgaagagggataccacaaaaagcggagcgcagggtacttggcgtataataagccatcaataatttatgggtgaaattgagagccaaatataagatgataaactgaagaataaaaacagctgacaaatactgtatagaaaagattgcgttggaatcataactgtggattggaagtgatgttaaggattattggattgagtatttgtagctgaatttctgctggcatttctatcagtggggaaagccctcacagctccataggtaatttttgttaggggaggaagaagtgttgttctgtcacccacccccaggcaaagagtcgctgatctaattctccatttctttctttctttcctttctttccttccttccttccttccttccttccttccttccttccttccttccctccctccctttcctttcctttcctttcctttctttcctttctttctttgaaacggagtttcgttcttgttgcccgcgctggagtgcagtgcagtgctgtgatctcggctcattgcaacttccacctcccgggttcgagggatcctcctgcctcagcctcccaagtagctgggattacaggcgcacgccaccgcacccgggtaattttgtatttttaatagagacggggtttcaccatgttggccaggctgtttgaactcctgacctcaagtgatccgcccgcctcggcctctcaaagtgctgggattacaggcgtgagccaccaagtcctgcctaatctcctttttatagttgaggaaagctagtaacttgactgaagtctcatatattagagctgtaactgaagtttttaagtgtctcaattctgcaactattcgtttttctatcacatcactgtttggcatatatatagcgggaaaaggaaaggctggaaattagttgaccacacactgattaagcttgaaacatatttctactggagaaaaaaaggtactgtaattttggcataggcatcacatattgctggagtggaaagacccatgcactcaggtcctgctttctataatctgtgacctcgggccagtcactccatttctcctgaactagatcactgatgatctgttgaaagaaaaaatatggctagtaatgccttaattatctcacagaggttttacatggagcaaaaagacaatgtatttttaaatgtactttgttgaaggtgtgtgttgtcgagacaatacagcagtgaagagaaggcatgcaaagctgtcttgttggagtctggctaaagagcaccaaagcagcctgttgtgggatgtcctctgggggccacctggacttgctatgttaacatggagggactaggcaggggtatgaagaaggaagcccagcagagcaggaggcagcagcaacaatgagagattggttatccatatgacttggatctgtgtccccacccaaatctcatgttgaattgtaatccccaatgttggaggtggggactggtgggaggtgactggatcatgggggtggatttcttatgaatggtttagtaccatccactttgtattgtccccgtggtaatgagtgagttcttaagaaatctggtcattgaaaaatatgtggcacctcctccctctctcttttgctcctgccccggctatatgatgcaatttgtcttcagccatgattgtaagtttcccgaggcctccccagaagctgagcagatgccagcatcatgcttcctgtacagcctgccttccatgagccaattaaacttctttcctttacaaatta

SEQ ID NO: 359 - DNA, 3792 bp, Homo sapiens
gcgcaccggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggaaggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttaggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttggaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctca

SEQ ID NO: 360 - DNA, 1727 bp, Homo sapiens
agctcctgccgccgccgcagccgctgccgccgcagcgaagaggccatgttgtgtggtgtgtggggcggggggaggaggaggagggagtaaagcctagagaggagacgggagagagacaccacacacacggcacaagatggccggagaggcagcagcaccccgagctgtcaggcgttccgccgcggccgcgaggcccgccggccggcggggagctacgcccggacggccagcaggcccgcgggagtggggctgccgcggctgaggcgaggcgggccgcgcgcgtcggcgtcacagcccgcggcagaggcgcccagggcggccgggcccacgacgccgaaagcgccgctgcggttgccgcctcggaggctcccccgggccccggcggctggacccggcgcgggcgggaggctcgggcgggcggtccggcccgggactcgggtttgggcgaccaggaggtgccggtggccgcgctcggacccggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaatttctcagtttgggtttttttttttaagtggaagtttaattaaatgtttagttttattttagtaatactttggcctttgtagttgccgagtggtaaagtgtactgaatatgaataaagctggtaaattggaaatggtgtaatcgaaaacattttacttggtttatgaagatttacgtttttcacaaagttgtgctcttagatggtcatttggtttaaatactgttttgtttgtgctttcatgaaacacctttcaaaacaactcaatgggtaataatagaatctgattttaatctgccacaagattttaatgaacttgaaacaaactgcttgttgctcgaaaattcaggatgagtgatacacatatacttctgaattattttgtgttgattgaaatggtttcttaagctttttaatactataaatacatcttgctatagaatattcatctgaatatttaaattaatgtctcctattgtcttactattagaggaagaagtgttggatttatgggttagggtccttggagtattcacaattttttaaatttgaaattatgtgtgtaatccattttatataactttgaagtaggattaatatcttgtatcgtctttattttgtacaattggggatttagaataaatgaattgcaccctgc

SEQ ID NO: 361 - DNA, 2063 bp, Homo sapiens
gatggtttcagctagataagactggaagacagcaaggacttggaaatgtactcacagaccctcctacccgtgataactgacttcagagcacaccttcattcccacctttctatattttaacatgggattgagactgggacagaggttaacaaggcatctcaagccaatcaagaactagatgcacataactgcatttgatggggaagtaaaaattactacaaatttaaaaaaaagtgtatatacgttcaccaagtagctataattctagggtcttatttttaaggaaaaaaaaatgcattaaaggtagaaaaggagaaacataggtggagggagaggaagaaagctggagaggaaggcattttgaacatctatcactattatattaggaacttcacatgaaccatctcatttacctctcacaaaatctatgagattgagacaatgctgcttattatggcatcgttaatcatagtgaaaaattgaaaacagccttcttgtatactgctaagaaaactggggccttaagtgggtgcaaatgtttgtctaaaccaatacattgactgctctacaagaaaatgctggtgtggtccttcagatattctgccagggttctccactgagtgaactcaaccagaagccaaaggacatggaaacccattgatgtccctcccaggacaaggtggatgaacagaaattgatctgaaaggacaaatggaagaaatacaatgcaatgttgatgaaatttcatcctctgcccctcttccctccatctctctcacctcttgttcgtagaaatgttccaccccaaagcagcaatggtacctgaaccacgtcagtccctggtggacactatttttcatacacaccttgaggaatgtcctggaggaatcgcttggcaatcttcagacgagaaatgctcatgactagaagagaccaaaggatgctaccaaaatcagtccctgtcttcaagcaaaagtgctcactgcatttcagatcttctcggaggaagagtccagcctcacctaagacactcacctgcacaatgaatgacacgtgacattgtcatggcagcttttgtcctgacctagccttaggtagcactgacaaatccactgcgtgctcactattgggtcatttgacatttggaatcggtgacctgacaacactgccgtacggaaaggctaacggaaacagaggctgcagccacagcccaggaacggtggtctttcgcacacatggggcagcctctgccacaactttttcttccaaggaaatcaacacaaatgaaaactggctgatgctctggtccaccagaggctgaagaagaaaaccgcaaaatggagactgcccaattctaatttaattcagaagaacaaacagggcatcactcagcggacttcaaatccccagtcagaagattttgcccgtggagcaaatcgtttcatgggccatctaccccacctactccctcctgccacagcaaggaggtgaaaatagctcatgaagccatggggagttcaaagtggaactgtgaagtttcccaagctccatgcaggtcactgaagtccaccctgcaaacaacagtccttcaccttctgaagacctgtcacctatgaagcagcaaggaaggaatttcttggctctgcttcctggcagtcattacctgtgatcttctatcccaattggttgaccctagcaactgagccccatgaaatatgtatttagtggactgaatgaattggacaattgaatcagaaaaagcaacaagaactcccaaggttaaaacaagtccaggactacactcctctcttcctgcctctccacattgatctgcagcttctagagaagactgagcaaagagatgctggtgtctttgacttcagggaagagcaatgtcaaggagagaggccagcagatttttttaaatctctattcacctgtcactgtccagcctgccattgtggtgggtgaagacaacatttagggattctagtgctagtaggatacaaacaacatttctattttgttattaagtaaataaataccactctttatcaacctgc

SEQ ID NO: 362 - DNA, 529 bp, Homo sapiens
gttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttgaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaa

SEQ ID NO: 363 - DNA, 3148 bp, Homo sapiens
acaaagcaatccactgacgcagcagtccccgcaggcttttgagacacacattaggagaggactctgcccgctgtctgtctcacaatctgctcgaaatatcttggtcaggaatctcaggatgtctagtgaccccgagtgaggtgctgccttttattcctgagcatctttggaagcaggaagcagggagcaacggtagcgagaggtattcggatctgagtatcagcaggaagaagaaacagaggaagaagtcccccataaggaaggcgtgaggagcgcaggaagcgctgtttccctgcctgagatctttattctactaggtctttattctacgtagccgatacgctgtaaaattctggaagagaaggctaggggtttaaggttggtaatctctcagaagatctgcgtctcggtgacggaaagaactaagggtaagtgctgagaagcctctctttacagccagagaacgagccagagccgagcttgagaatgacgggatagatctagcagttatgcccaaggaagaccctcggccctttgaatttgaaggcactgaaaatcgtataaatgttttcatataaacgtatgcatctttgatataaataacaaaatggcttttagcacaaattttgttttggaaattttgaaaaacgtcttaataagaggaatgtttactcttaagtctgcagtagattttgaacaccggcagtaactgtacaaatatatcagattagttttaatagccatctccccttcccctacaagtaaaggagagtactacagcagtatgtactctgaattgctgctattgaagaacccctgagcctgtgcagcgtggcactcctgtggtccccattactcaggaggctgaggcaggaggattgcttgatgccagctagaggctgcagtgcactatgagaacacctgtgaatagccactgcattccagcctgagtaacatggccagaccccatctcttaagaaaagaaaagaaaccctgaaccagaggagcagagctgccaccacttagtggtggggatggggcagaacagctcagggcaagacacaggccttggatgccaatgccagccgtcagatattgagcaatgtgtaagtggggttagcctgcaggagaacctgctcgccacctcctcctcttcattctttaggtgatccccattgacctagacaatatctttaatatagagttctcctgatttttctacacaattttacagggcatacagaatatatttcctgtccaataatgacagaaatacttgattttgaagagtaacagttatagcttggaatagaagactggaggcagtttgagggccgacttcagagtcctggttgaaatgaaggttgagaagtataatgcagtcagtgcaggtgactttcagctgggtatctagtcctatcagaggtaaaaactgtggttgccctaaccaaaacaataggactaagagaccttaaatgaaagatgaaagttattatagagagaaatgatcatactggcaaacaattcacctccaagaattatgatgtgactctttgtcagatactcacagatggaattctaaactggtagcagaccctgaaggacaatgtcaccatcagaaccaccaacaaggacaaactgtccctctcctgcatcaccctgcataccatctgcatccacaaaaatgctcattcttcaacaagcctcctatttcttttgggtgactgggaacactgcccagcacctccatcacatgctttagcgcttcccaccctaacttagggtcccatatgcctcctgtttcttcttgaccagtgacctgccactgtgggcactgtcattctacatgtcagtgagtgcagagtgctatggttaccatgcagactatctttgagctgactctgcaggccagtgaccagggttcaacttgctcagtgtcatcctgaacctgcatgtgatggtggatgaccattgcaaaaatgcaaggacactatgccaggagttgcagccaagtggggccctctttgatgctgcaccactcacaatgcaacccagctatcccatcaccaaagtggacaccagctggggcataaaggctgactgtcctatcatgtgcttcaggccagctaatgtggctcttcaaactagggatgtgcacgagctagatgcgtgccgtgtcactgtgggtaacagagatgcaacctgccaaggtttgttggtcaccgtggtcaatggtgaatcatcacgctgaaacatcacctggttgctgctcatagtttgcaggagttgctaccagacctcagcaatcgcccagcacccaacagcaggcagcagacagcacccaacagctggcgatggccgttgccttgatctccatgctgtttctcctcagtgtgactctggccatctctctgaacctgcaatgccccctatagctccattgcctggggctgttttcagctggatctctggtccaagcccggatatggagttgtctccaacttaaagaaaggaaatttgccctgttcctacaacgtatgtgtggttttagatatttttaaaatcttaatttctttaactcaagaaacagctttgaaccaggtattctctgcagtgccagcaatgaagctttgttttatttttgtttttgtagaaacggggttcactatattgaccaagctggtctcaaactcctggcctcaagtaatctgcccaccttggcctcccaaagtgctgggattgcaggcgtgagccactgtgtgtgggcagcaatgaagctttaaatgttgcatttgattcaaatgtatttgtgtgatattttaacatttttattttatacttaccatccttttataaatcactcctgcgtgtttttggttgctgaaagtagggagctctacaggtttacttactagttcttatgtatattttaatttacctcattagctcacaatttctttggggaaaagtttatgcctattaatgtgtattctgaaaagttacattctctgttaaagagttacttccttgcaatattgaagatgatttattgcacctttaaatttctactctttggctccatgtacttgtctttgagaagctgagaaactgtagatttggttaagaactaaagttctctttccaaaaa

SEQ ID NO: 364 - DNA, 361 bp, Homo sapiens
ctcagttctttggaaaaattaggtaacttgaacgtagggcacatgggctgtcacaccaccccatttagagcccttattggcatagagatgataaaagtggactctgtgatggcctctcatgatctcaggatagcaggataggggaactctgagtcatggccaaaataattggtcaatgtacagcctcagacagctgggaataccaccccaaatcacttggataaggagatgttttccttatcctgtgtctttaactctgagacggatggagttgaacaatcaacgattgttaaaaatgtaccaaatgtgtaagcatcatgaggtgtttaagctgagcttttaaattaaaattctgctgggt

SEQ ID NO: 365 - DNA, 712 bp, Homo sapiens
gttccgggtctccacgccctcctggtttgcgggcagccgcgaagccgcgagtggaccgagcgagtgcagctgcctccgcggggccgcgcctggccgccgcctccctttacctccggccgccccgtggcaggtgtagaagctgcagaggccgcagcagcccagcgcgccccttccgtgtggccgcatgccacccgcgccgcgcccagcattccagcgtccaacagagcatgcgtgcaccattccagcatccggcaacaatgcaccagcattccagcgtccaacagagcatccgtgtaccattccggcatttggcaacaatgcaccagcattccagagtccaacagggcatgcgtgcaccattccagcatccggcaacaatgcaccagcattccagcgtccaacagagcgtgcgtgcaccattccagcatccggcaacaatgcaccagcattccagcgtccaaaagagcatccggcaacatcccggtgtccagtggcacatgtgcacctggacgttccagtgtggtgagctttcaggcacggagcaaggccaaagggataaaaagatgaaggtgacgcagtactcccccttatagtgcctacaggccttataggccagacagatctggaaataaataattcataataaaaaataattacagaataagaggcataataaccagatagaaagtattgaataaatctgtaagaaatg

SEQ ID NO: 366 - DNA, 7844 bp, Homo sapiens
accttgttcttgagctgtccggttgccacagggtcggacctggaggctgcagaccatcgtggccctttgcagtgttcggaaacatatgcgcaccccagaaaaaaacattccttggaaaagctgaacaaaatgagtgaaaactcataccgtcgttctcagcggaactgaggtccagcgcgttgcctccagcagggactgttggagtgagggagagcttccactagtccctataggttccaccacccagggcatccgcagggacagttgccgtgggaggtccgctgcctgctgtcaaggaagatggtcgatgcttctgagaaacaggccctgcgggttcctggatttggtgtggcctggcatccacggtgcaccccgtgctggcgggtggcccaggacggggcagttgccttgagaggcccaccgcctgctggcatgacagatggtcagttcttccgagcagtggaatctccatggagtcgtggagtcggtgtggcctcgcatccacagtgcaccctgtgctggtggatggctcaggacagggcagttgccgtgggaggcctgccgtctgctgaaaggaagatggttgatgcttctgagcaatgaaggccccatggagtcctggattcggtgtggccttgcatccgtggtgcaccccgtgctggtggatggctcaggacggggcagttgccatgggaggcgcaggcctgctggaaggaagatggtcgattctcccaagcaacaaaggccacgtagagtcctggtttcagtgtggcctggtatccacagtgcaccccgtgctggtgggtggctcaggacgcacactcatttcctctgcaccttcctggtgtcattggcatggaaggaaggcccttgtccaagaaggatggtcttcgtcttgtgtgatctttgagatgccatgaggcccctggatacaaatggtgtgggctcctttggaggcttttggatttctcctgaatgtggcgttggtatggaaggaaggccagtgaccgcaagggatgactttgatcttgggagatttttggagatggcaaagtgcttctaaacatgtttggcatggtctccttcaggctggtggatacctcaggatggtggcgttggcatggaaggaaggactgtgtctgtgagggatgatcatcctctcatgtgatccttggagatgccaggaagccccttgacacatgtggcatgggctccttcagaggcttttggatccgtcgtgaatgtggcatgggcatgcaaagaaagacagaggctgcaagggataaacttcatcttgggagatccctggagatggcagggaacccatggacacatgtggcatgggctcctttgggtgccggtggatcccttcatacggtagtgttggtgtaaaaggcaaacccgtgtcatgagggatggtcatcatcttgtgtgatccttggagatggcaggaagccctggacatacatggtgtgggggctcctccagaggctgttgggatcctcctggatgtggtgtgggcatggaaggaaggccagtggagacaatggatgatcttgttcttagcagatcactggatgtggcagggagtcctaggacatgtgtggtgtgggcttcttcaggtgctggtggtgttggcatgaggaaaggaggtatcttcgagggacaatcttcttcttgtgcgatccttggagatgccatgaggcccctggacacatgtggtgtgggctcctttggaggctgttgtatcccttctgaatgtggcgtgggcatagaaggaaggccagtggccacgagggacaatcttggtcttgggagatcctggaaatgatagggagtcccttgatatgtgtggcatgggctccttcaggtgctagtggattccttaggatggtggtgttggcatgaaaggcaggcttgtatcatgaggaatgattgtcatcttgtctgattcttggagatggcaggaagcccctggaaacacatggtgtggactctttcacaggctgttgaaaccctcctgaatgggcaaggactggatcgatgatgacttccatatgtacattccttggaaagctgaacaaaatgagtgaaaactctataccgtcatcctcgtcgaactgaggtgttgtggccatggaagtaaggccagtggctacgagggacagtcttcatcttgggagatccctagagagggcagggagccccttgacatgtggaatgtgatctctgttgggtgctggtggatcccacaggtggtctggcatggaagaaggccagaggctgcgatggatcatctttgtcttgggagattcctggagatggtggggagcccctgggcacgtgcagcatatgtggcgtgggcttcttcaggtgctggtggatccctcaggatgttcattgtggaaccagcacagattttcatacgaaagttatttctttttaacctcaaaaagtgacagaatggagtgtatcatgaaaaagtctgacatcaaaacctcaaaatgtgatattgattgggtgagatagaattccatggaatttcattgccaaaccagtgaagtgctaattttgacatttgtaccagctaacgtagctgtgaagaaacacaccaatacacttctaaggacagcatagaccaagatctaggtttcatatggatgaatttattcttccctttgaggcaagacaagaaggaaagaaagtattgggaataatgctgccctcccatcctcaagggccagtgggaactctaatattgattggttttcacagaattccatggactttaactgctgaaccaatgatgcactgattttgtcacttgtaccagctaacgcatctgggaggcaacaaaacaatactctcctgaggttaatgtggaccaaaaactagatttcatataaaagagtttattccttctacttgaggtgtgacatgaaggaaagtaatggaaataattctgccctcccattctcaagggccagggggaattcaaatattgaacggaagtgattttggaattgcatggaattctcactgccatcccaaagaaatgctgatcttgtcactcttacctgtttcattccctgggggcagaacaaaaggacgcactccaaagatcggcatgaaccaagaactgggtttcatataaaatattttattctgtcctcttgagatgtgacatgagaaaagtattgagaatacttctatcacctcatcttcaagaatccgtaggaattctcccatggtggactttacggttaacctgaacaggtcttggaaaaaggactttaaacattctcctgttctgtggaataagtatacttttttctggacatacaccttgtcagtgagttccatgtgatactagagttgcatagatttttaacctttacgccaatgaagatctgaggcaaacattgccccttttttagaagtttgcatttgtcactgataactgtaataattgatcttgttgaaaagcctgggaaatgaagatctgatatgtcacttttaccggcttcctcaactgaaaaagaatacaatgaaacacgctgagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctgattggaagtgatattggtggaagacaacattttgccgcttggaattctcacctccacaccaaagaagtactgtttttgtcatttgcaccagcttctttctccaggaaagatcaaaacgatgcactgcaagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctctccctctctctccctctctctctctcgctccctgacctctgcgtgtggactccaggcatgccatatacccctcaggacctgaagcaaaagaatgaattaaagaaaactccagagaatgagctgacaacctactccctggtcagtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacatggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttatcagttgaattactgggattaagtatgtgcacactttatatttatattttgaaaattattgcaagattgccttcaaaaatgtggttaacaactttatcttcaaatggcaatgaatgagattgccagctttcctacagcctcacagacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttaaaaatgttttattcttttaatttactacttaattgtgggtattttaatttgatttggaatttttacaagtatacaactaagtgaaattgatctgtgatttttcttttttgtgctatttttgtcatgttttgatatcagatattctggttgtgttaaaataattttgaggattttcttcttatactgtgttctagagtgggtaaaaaagccctagtctcactatcagtgtttaagtgaacacatcagtgacatcatctggactctcctttgtttttgctggtttggagttaggacatctagaagtttttttctttttttcctttttttgtatggttattgcttgttctttgttttgtgtcaaatttaacctgttttctcttagcaaatcacagctcatgcagattttcaaacacattagccttgttatacaaagtgttctttcatcattctattaaatttccattttcattccagttatagttatttctgctgtgcctttgttaatgaataagtttaaacagtggatgtttagcatcactagccttccccttccatctcccttaatcaggaccttggtataatttatcaggtattttttaaggttctaatttacttatatatattgtttctgtattcttttgtttcttttcttaataaattcttaaacctgtgtaa

SEQ ID NO: 367 - DNA, 580 bp, Homo sapiens
tgggtttgagagtttaatctgtgctctggcgcccacagtgctgcagcccctcatgggccagagacaggatgcacggggactcccagcccctacccggcaagagaggcatcactgaggctgcatctgccatgcgctcctggtgtgactgcaccctgtcaggcctgtgaaaggtcagcagagccaaggagcaggcaggagaggctggagccccgcccagaaccttggcgagctggtggccctgccaagtcctgctggccactgaagagggaatccagggcaaggcaggtgacctcctgggccaccagtctctaacccctaccccagcctagggaaggggaggacaggaagagactggatgctttgtaaaggacttcctgttcttggggacataactctcgtcccctcccagagccctggatgactgacaggcattccttggccaacacatgcttgagccgcgctgctggctgcagggcacctggatgacaggcattccttggccaacacatgcttcagccgcgctgccggctgcagggcacagaggctccttcagtggaattttgcctacgacacagagcac

SEQ ID NO: 368 - DNA, 499 bp, Homo sapiens
aggaacgcgtcgccgcgtgtccgtgaccagggcaccgcgccacggatgccagatcccaggctggagagagcgggttgccccagatccgcgggcagaggcgcagagccgaagcccggaggagaggagtttgagagccgccatcttcgggcggtgaggcaggaggaggctgcgggttggagcgcgcgtttgagcgtcggtgcgcgactgcgaaggaaacccgggcgggctggaggctcgacagcgcgtcgatgacgtcctcccggcctttcgagccgcacgccaccggcgcgctgctggctgctgcttttaaaagaagtgaggctgggcggggccccggcggggagaagaggctctgtgcagccggggcggatcgcggggaagttcctctcagcgcctcaggtgtctgggcgtgtgcagctgtgttggcgcacacttgccgctacagcccttctgtcagccctttagcttcgatggggcgctggtggccgcctccccctag

SEQ ID NO: 369 - DNA, 825 bp, Homo sapiens
atcccatgggccagcatttactgctgctggtttgttaacagaactccgacctcatggacatttggttgcttgatggttatgtgctgggagtagggaatgggaagatgattggaacacctggagtataagtggagtaaagagtacagaagaaatgcctctggcggaaaatttgaagcagtttctgtgcaagactggagctcacacatgaagccaactctgaggaagtacaaagtgttgtccccaatcctcgtaatatccagcttctttggcagcttgctctgcccaaaagaagataggagacagacagacagacaaacacacaggcatacacacagatgcgcagatggacagacaataaacttttcctggggatgtgaagaaagaatctaagaagtaaagatgggactccgtttcagatgatgaagctctaaaatgacttcagttgacgggtaaagcccatgacctctggcctcagcaggtttcagagaacaggcagatgggtgataatactcagaaaggcatccatttatcagtgagttttccttctaagctacatcccacacagcagctttgtgaatgccttcatcccacacctcagcaattttgaaccagaacaagtttccgtaaagggtaaggatgatctgtataaaatggtctgtgtaagaatgatctgcataagaaatgaaaagagcaggtgtgttcaaggagtcagacctcttagactctaagcacccccctctctcataataccttgtaactttggagacattctttaatctggttaaacctccattttcttggttatagcatgcaaataactaattc

SEQ ID NO: 370 - DNA, 793 bp, Homo sapiens
gtaattctggaccttgcatttccactttcaaggtttttctgaagacataaagacaaaaatgtatgcaaaatatgcatgctcactatagcactttttataataacaaaaaatataattagatattagaaacaatataatatacattatataaattaaattaatattcacatagataacaatttaaataaggcatatgtcattcatatgtgcaatgtatcattcatgtatgtttgtaaatatttagaaaatgtcttgaaaaaagcacatcaatgtgaacagtggtttcctctaatttgtggaatttatggatgaagagaatgaaagttacatatatgcatatatgtaactacagttatacataattatagttgtatataattatatataacatgttaattatattccatatgattatatgataattatatgtatatatttctatattctgatgatctttaaaataatttttaaactttttaagataactatagattcacatgaagttttaagaaatcatacagagcaatccagcatattttctaccaagtttcctccaatggtagtatcttgcaaaactatgctgctacatcaaaaccagtatgctgacattgatacaggtaaaacacagaatatttctgtcctcataaggatctctcatacagctcttatataacacactcacttccttcctgcccccatcgtctccttaacccctggaaattacaaatttgttctttatttctataattttgtcattttgagaatgttacataaataaaagtatacaaaattt

SEQ ID NO: 371 - DNA, 753 bp, Homo sapiens
ggagcagaataatctgcagctaggggaaggccaggctgggtctcagggtgagagttacagaaggatatgaaataatcggggaagaggcaagttacagcgggtatcctgatgcagaccatccccagccagaaacacagccgcagaactgagcccaagctccagaccaaaaactgagcccaagctcagggtctgcatggcccagagctggcatctgtccgggggactggcccaggcaaagtgaccactgtcatccagtccaggagctgtgagctgcatggaaagaatgtgaatgaagacacaactctaaatgtggaaccatggacgctatgtgagccagtgtgctccctagccgtccagaaaaacaaggcccacttgtacattctgcaagagcataaataaagctgtcctcaggcggcgtgctgtggtggcccatccttgcagtggcttcactggctgcacccctcagcaaggcctctggaacactgtgagggcagcacacccacccaacagcgtgggtaaaaaacggtctagctatggccttgccgcacgtggtgatcgctaacttaattttgcagcaaatttaatctgctctgtattggtattaattagaaatgttcaaaagctggtaataagggcagtgcagaatgggtccttcaggccaatttctggttctgggtatttgaagctcatatccctgcaaataacaggaagccactcacctgattcttttaactttgcgtcctggttatatgt

SEQ ID NO: 372 - DNA, 382 bp, Homo sapiens
tctttcttttcctccttcacaccctcctcttctgtctctctgcaacccctcctggtgatctctgagtctctgagcacctccgccttcctctcccactgcctctttctccccctcatcctctgggactcacattccctaaatactaatggcagggatttgctgtgccccatggctcagttaagttctgctccccagctctgccatcatctgcctttgcctgaaggtaccaggatggctctctgcaaggattcccaccaggaatgccaaagccagagacttagggaccaaaggacccagaagggagatctgaaaaattcctgcttaggggcgggtcctggaggctctgatttttctgggtattgagggacccaaactcaaccag

SEQ ID NO: 373 - DNA, 3361 bp, Homo sapiens
taatcttgcagcacctcagttttcccatttctaaagtgtgctgctaccttccatgcagggcgttgaggggcttccctacgttattacgcacaaagtcctcctcacagtgcctggtgtgtggtcagcatttatatgcctggcaccaggccgggggctatggaggcaaatcagctgggccctgccctcacagagttgacatcacttagtacgtaaccacattgggatacatgttttgaaggagaggacagtgtgtctggccagtgagcaacagtgggccatacgtctccagggaacccccgtggggtgtgggaggagggaagcaggtctgtcctgggggaatgtgtgggaccacctctgccctgcttggcagtaggtggatttcaggaccatgggcctgtgctgtttacagaaccttgtccaggtgcccagctgtgggagggcagcatggagaggaggaagagggggcccctagtagcaagcttcagaaacttgccacttcaggctagagagctcgcaccctcccacggcagcagggtagccatttctccctgactggggtgtccaccatggtgctctgcagccacctctcacttcattaagagtccacagatctaggagcagaggactggtctggagctgggcaagggcaggcagcaaatggggagtttttgctgtgtgacctgaggtcacttgcctgccttctctggactgcactgtagggcctggagacctgttcccctgttccaatttccccacctcagtgaaggcacaaccaacagctgctccccgggcatttccaagaccctccaggcccccagctctgaggactagggtggaggcagtgtttctccccagcatcaagtgaccagagaagtgaagtgaccccactgccgccacacagagccacacagtgcgatgtctggagctcctgcctcctgcaaggtggagggtggggcttggccaggagtgaccagactacagagtgaggggtgtgcttgtgggggtgaagggttggggtgagaactgagcccgagtcgaactcatcctcctctgccctgatgcactgtgcaacttgggggagtcactgtccctctctgggcctcgctttccccatcttcgataggacttggctctgcctggccactcctcctccaatgggggaattcctgggcttgcctctgtcttggctccagctcaggtgtcagtctcagccctgtcccagccaggaacaatgggccaggcagggccagtcaccccctgtccctgggggctccacccacggccctggactattttcagcccttgcagatggagtcagaagaggattttccactcccagtacaatgactgccctggaccattgtccagcagtgacgcgggggacctgcctgccccaaaatatctcctgcccctagtttccaagcctctttgccctgctcctcacctcctggccctgctccttacctccccaccctgatgtcatttcctggggctcttaactcctgaaggccattgtgaaacatcacgtgagactcctgggagacacaaccagttggaatgagttttccctcctggcagggaccccagggattgtttggctgcttagtgggactggtggcccagagagggctgtgccttacccagtcacacagcagtcagtgtgaagcttaggtgtaagcccagggctctttggctgctcccactgcctcagccaacttcattagctccagtctgtggctcctggactggagctacagtggtgagagctcaccactgagcttcctgggatgggcacctgggatagcagcccaagtggtgtgggtggagaggtgcagctcatgctctgaccttggagtgagcccagtgcaggggcctgaccttaaaccctttctccccactgagtcccatttttaccaaatgtggctgttaggaactgaatgtttgtgtcccccgccccacaaatccatatgtcaaaatcccaactgccaaggtgatggtattagaaggtggggcctttgggaagtaaccaggtcctaagggtgcagccctcatgaatgggtttagtgcccttacagaatggaccccagagagctcctcaccctctttccaccatgtgaggatataatgagaagttggcagtctgcaacctggaagaggtccctcaccagatcccaaccatgctggcaccccgatcttagacttccagtcttcagaatggtgagaaataaatgtctcttgtttctaatccacccagtcggtggcattttgttatagcagcccacgctgactgtgactgaactcagggtgacagagcagcagctctggggcaaaggggagggtgggggccacagggcagctgatgcaggagcagggctctggcacagttcagccatcaccaattctgggactgcaaattcagtttcttcatctggaaaattgaactggtaataccaatacctcttttcccggtttactagacagagacaatgcagtgaggcacaaacatgcaactgtttgattttcctcccacccatgctccctgctcagtgacgtgtgattttcctttcccatccataaactgcgcatttggcaaactccaaacttttgagtcacttttgggtaacaaagtcaggtttaagatttccatcgcctgcttaattgaatgctcacctgtcctcttcccccatgctgtgaggaccttcatcactcctcttctgggtccctctctcctctaggtgttggggcagggtggggaggaaagggaccaatgtgtctttcctggtgatgctacagccctctcttgctgaccttgcttcctgggccatcagtgccccctgcacagaactctccaaacatcagtccacacctttgtaaaaacagtctctccgctaagctatcccaaaatgacctgattagagtgtgcaacgtctttcctgctgggactctgactgataccctggtctccctgagtgattttcctgcacaccctgctggggatgtggaagcctgtccccctcccaccccacaccccacacttggctgagatctcacagtggcaaagatgtctttgaatccatggtgcccagggttcagcgtgtagagtgaggtggggtgtgtagagagctggggcaaggaaccctgagaagatgtcttaccccagttgtttccaggtttctttagaaagcgggctattttaccccatgtgtcctcagatttatgtcctggaaccaaattccaaatcagcagccacatgaaaagtcccctcctctctggcgtggaattaaactgttagacctgcctttgtgaccaaagcaattgtaaaacgtgggggaggaaattaaaagcctgccaccttagtcca

SEQ ID NO: 374 - DNA, 657 bp, Homo sapiens
tctttgtttttggtgttttagagtcggtgaaggctttaaaggaagtaggcagctggaacccggctgtggcgggttgaaaagcccgggcgtttgagagctgagacttgccagttcccacaggccaagccaggcgtctgcaccccattctcttggttccgacgaatatgctctccatgagggtgttcttcagggcctaccacaatggctggcactagagaagggcacaaaattgaagaacagtgaagacaaaagcaataagatgattaaggccatgtgagacagcaacaatatcaggttcctgaacacacaacaacataaaagcagtaaagaagctgagggatagctcgctcacctggcaggatggtgttcgggagactcccgcagttggaatacgggcttggtctcaaatgaaaagagtcctgcagttctcgggaaccttgttgcaccagaggcacctggaagcatcgaaggtcatgtgaggaaggccacacctctgtttccaaggaggaagatgtcaccgatgcccacagcctgccacagctcggggctggtaggctcctctcgattcctgcacgtttctgcttctgacactgcttctacccggagagttgtgtatttaccaagagtcagttgtgtgattctcaaacatacttatgt

SEQ ID NO: 375 - DNA, 753 bp, Homo sapiens
gaggattgggatattccgactccttaagggcctggcgcacataaggtgtgaccttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaag

SEQ ID NO: 376 - DNA, 3207 bp, Homo sapiens
gatcgacatgcacttggatcattgcagtttctgggcctgctgtcatctcccccttcagtacttcccacatatgactaccaactgttagacgatgtgctgctgccagaccagcctttcatttcttggacatccggctatttacccaggaaaagtcatcctttgactatttttcatgacctttctcatctgactcgtgatctgcccatcttgttactccctagcagtgtggtaagtgaattcttgtttctgccttaaatctacttctgtctcagccaaattcattctcccaagaagacaaggatcgaggactgtggagccaactcagactcgccacggctaacaatgtttcctgggatcgcctcccaaataaactgcttgtacttgaacccttgtctcagagttgactactggaagaaccccagataagacaatctgcgagtagacatgtcagataatgcagttagatatgaatctggaattcagaggagaggctcatgcaatttgcaagtcatcatcaaaaagatgtcatttgttctgtttgtctactgcaggaagacagattaccctaaaatttagtggctgaaaacaactctattttatcgtagcttacaattttgtggattgggaattagagcctgtctcatctgggcaactcttctgttccccatggcatcacctgaggtcactccatggtattcagctaccagacgaactcatctggagtatccaagtattcattcacgctcatatctggcaccttggcagggatgactggaagcctgggctcagctgggactgctgaccatagtacctacaaatggcctcttcagcatggcttcttaaatggctgctcggagctaccaagagacaggaagtagaagctgctagtttcttaagacccagaaatggtacaatttcattcctgccattggtcaaagcagtcacagagccttccaagaggaaacacagaccctcacttctcactgggaagtatgtcaaagagtttggggctttttttttgagaaggagtcttgctctgtcgcccaggctggagtgcagtggcaagatctcggctcactgcaacctctgcctcccgaattcaagcaattctcctgctttggcctcccaagtagctgggattacaggcatgcgccaccacacccggctaatttttttgtatttttagtggagacggggtttcaccatatgggccaggctggtctcgaactcctgaccttgtgattcacctgcctcagcctcccaaagtgctgggattacagacgtaagccactgcgcccagccctggggctgtctttaatccactacaacattgcaaagctgtgagccaggatgagaacgccagaggtatgaatgtggattaaaagtccaagcactgaaactttcaatgtttagagaccagtgagagaaagaaccagcaacagagactcagaactatatcatattctgctgataagccaataagatgataatgataactaagaattgacattggctttagtgatgtagacataattggggaccttgacaagagcagtttactgggggtggttgagttgaaactttgattgtttcaagagagaatggaatgagtggaaagatagtttgtgagtgctagcaattattcagagaatttctgctataaatgggagcaggaggatgtatcaggagctaatgggagaaatgaggtcaacattatttcctatgtagctttctcttatgcccaaattccactggatatcatccacttctggttacttctggtttgggatgtataggtgaaggaatagttttggatcctcctttattacctgttttatttgcataattggacaataactaaacttgctttaaatatctcttaaagcattttaaattcaaatttggagagaggaatatgagagtggtttttggtcattgtttagccatatacaatattgtcttaccttctgcatttgaagtttttgatacctgataaatgtttgtattgtgtagttgaacaagaatttgccacatgaaggtttacagttgtagttttatgttaagttctttacagtagtcccctctcatctttatcccccacttggaactatctacagtagttccaggacccccctcccagtggatgattgaaaccatggatagtaccaaaccctatatacatattatgtttttcctatacatacatacctatgatgtttaatttctaaattaggcggagtaagagatgaacaacaactaataatgtaatagaacagttgtaacaatatactataataagagctacatgaatgtggtttctccctctcaaaatgtgttactgtactcacctatctttggtccatggttgtctgtgggtgactgaaactgcatataaggcaggggactactgtaaccacaggtgttggaaggcagcatagcagagtagttagggtcaggactgcggaggaagactgcctaggttcatattatgatgtaaactctccatgcctcacttttcttatctaatgcggagataataatagtaactcatttgtaaagttattataagtattaaatgagaaaatacatgtaagacacttagagtatcacaggtcatcacttacttagtatgtagtaagtatttgatgaggttagttactattcttattgagcagtgaatcagttaggaatgctttcggctgcaaggaggagaatactgatttacagtggcctcagtgagaagcctgcatttctctcacagagcaggcactgcagaggtaggcagctgctaaaacaggttcctttctacagctccaggggtctgagttggccactcttcagttccctcggacctcccctgttgtttgccacaccaccaatcatcacattctcaaaggcattcaaggcagaaagctgggaacaaggaagggcggagagtttctcttcaggagcctccctcttactagagaagaaaaaaacctgccttttatgggttcttttgtcttgtttttcatgactgtcttcatttgagaaagtcctcaggccaagaaatggaggtgctggcagttggagatcaggctgtccatagcacactgatgtggcacaggcaaggaatatggctgaggcaccaatttgctgctactgctgtctaacaggcattggaagtcttatgtgttcaaaaataaacttctgatttctactcccaaa

SEQ ID NO: 377 - DNA, 1482 bp, Homo sapiens
gaatacattgattgggttttgatgttcaaaacccaatcaatgtaaatcactattaactacaaaataaaagcaatatgatcatctaaatagatgtagaaaaaaaatctgaaaaaaacccaacacccattcctgattaaaaactattagaaaactaggaatagaaaagcattttctcaaccaattgaacaattgaagggtagctatgaaaaacctacagctaatatcatatttcatgataaaagatggagttttcttactctaaattcaagaatcagggaaaagtgtctgctctcaccactctatttaacagtgctggaaatattagccagcaaaacagataaagaaaaataaataaatggcatagactggaaagattcatagttggcacaattatgtatatataaaatcctcaggaatgtacactttacatactagaatttaaaagtaagtttagcaactgtgttagttcgttttcatgctgctgataaagacatacctgagactggacaatttacaaaagaaaggtttattggacctatagttccacatgtctggggaggcctcacaatcatggcggcaggcaaggaggggcaagtcacatcttatgtggatggcaacaggcaaagagagagcttgtgcagggaaactcctgtttttaaaaccaccagatctcatgacacccattcactgtcaggagaacagcatgggaaagacccacccccatgattcaattgtctcccacaaggcccctcccataccacatgggaattatgggagctacaagatgagatttgggtggggacacagagccaaaccacatcagcaacatgtcagaacacagaaaaaatgtaaaatatcactgtatttctatgtactagtagtgaactgtcagatgttaaaattcaattgcttagaatggcatcaaaaatatgaaatactggccaggcgttatggctcttgcctgtactcccattgctttggaaggctgaggcgggtggatacctttgaggccaggagttcaagaccatcctgagcaacagggcaaaaccttgtctctactaaaaatacaaaaaattagctgggcatggtggcctgtacctataatcccagctacttgggaggctgagacacaacaatcacttgaacctgggatgcagaggttgcagggagctgagattgaaccactgtactccagcctggggaacaaactgagactctgtctcaaaaaaaaagaaagaaatacttatgggtaaatctgacaaaataagtgtaagacctgtacactaaaaactacaaaacattgctgaaataaattaaagaagacctaaataatcggagagatatactttgtttaaaggtcagaagtctcagtattgctaaaatgagaactcttcccaatgcagtgctaatcaaatttctagcaggctttttgtagaaattgaaaagcagatttgaaattcatatggaagtgcgaacaaaacc

SEQ ID NO: 378 - DNA, 557 bp, Homo sapiens
agaggcggtcgcacaagggcgagctggagcactagtggagttggcgggaaaggcacggctgcgggcgccccctgtccgcacggaggagccgaagtcccgcagggtggggtccccgcctgcgccgagagggccacctggtcgagagaacaggcgacacggaaacctgagaaactcctctgtctggtgcacctaaccctcttcctcataaagtgcacacgaactctggtttttccgttgcaaattttgctttctacatagaccataccattcgttgctctctgaggatgagctcctggcttcccagtccagcagaagtatctacatctatttctggaaaggacctgaacttggcttctcgtccttctggaaagtgaggcgaaaatgccaggctgcgcagctatcctgaggcccggcctggaacctggctagccacccagtcctgatacctcatctcctttctgttggataaagtcattggataagatcccccagggtcttcttaatactgaacatctgttcataatcacataagtgaccaagtatagtggaaaacccga

SEQ ID NO: 379 - DNA, 1836 bp, Homo sapiens
gaccattagtttccactgcagtgtttgcagatggagtcgaatgtaaccccccgggaatggagccgggagggtcagagaacgcggctgcgctctggatctccgaaggggggcgggggcctggaagaggtccgggcccagaatggacctccaggtccctgctgccgcaatctggccctgccctccagcctaccccttactcccagaggaagggacccagggagacccacccagatgccctgaaaggaggtggaggatgggggtggggcaatacgcagagtttgtctggtgaatgcaggaaaggggtgggggctggagaggaaaaggatggagcagccgtcagcttgtcaactccgcatctgctggctgcctcggccgggctccagcctgcgccctcgcccctcggaacagcgggacccaccaccctctctcaggcaccttcaggatctggtactgttctggagtggcccgttgcagacactgaaccaccagccagctgcatttgttgtcctggatgtcagtgccaattttgccggtcacactggggtccccaaagaggtcaaggcacgctgcaatcctgtaccctgaaaccagctagatgagcatgtcctatagaggccaaggctaccatgggcaccctctgggcatcgggccctgtctgcaatacacctgcaggaagagctcgatcaggttcagatctgtccccggcgggtaagggatgaatccatgatgtcatctgccaccaggaagaaagcttgcagctagaaagagtggaataagacctgcagggctcctcattactgttccttctatcagcaacagagctgctactttatatctgtatatagttttgcttttttttggtaggggacagagtctcactattatccagtgcagtggtgcagtcacagctcactgtagcctctaactcccaggctcaagtgatcctcccacttcagcttcctgagttcctgagaccataggcacataccccatgcctggctattttttttttttaatttattttttgtagagacagggtcccactatgttgctcaggctggttttgaacccctgggttcaaatgatcctcctgcctcagcctcccaaattactgggattacaggcatgaggcatcacagccggccagagctgctgcctttgacagtccctatgagctgggaaagtcaggatggggagacagaagacttctgtgctatggagacttggaaagtgacataacatgtttggctcagactccccgcctataaaatggaactaaaacactcttgttttaggttaagaaactagaacagatctttgacatctctaatgagccctagattattcctggtgtcagggagattaggaaacaccttcatataccgtactctattcttgccaaaaacctcaatgaatgcttaaagtaagatctattcatgaaactgacttcacattacttcctaaataaaagaaggctattcccacattgcccccagcactgtgtttgaacaccctggtgactaggaacacagccttacctaaagcagctccttagcagtgcaggtctaataaggtggaactgaaatctgactttgacctatgagtctcagacatctttaaacatctttaaacattaactaagggcttactcttctgagtgcccatctgaaggtacctgaacgtgtcgggtttcccactagaccatgatctccttggaagcagggacagtaacttccccctcttagcatttgcagagcctagcacagcattaggcctggagtgagagtttcctaaacacttgtctgacaaagaaattaataaaacactctaacattc

SEQ ID NO: 380 - DNA, 4660 bp, Homo sapiens
gacgtcatctgcaggccctggagacgcgactgcagttaccgagtttctaaggcctcgtcccctgacgggaaggcggcgttggggggcggctgggtttacccttcgagagtccgtgtgagaaccgggacacctgtcctgttgaaaagggggacgcaaaagctgaaaatgcccggaaggatatggcttccttgaactgcgggacgtgtagctgcagctgtggggtggaccatggaaacagatcagcaggaagaagagatggaagcaacgccatggaccttcacgtccttcagagtgtgggtgggcttgggctttgcagtgagagcaagtatcacccaggatggagatgggaggtaatgggtggccccgacaggtgcctcctactgctggcagcaaggagagagtgaagaggcagaatttccttggtctagactagagtctgggtcatgggcatggcagtgcttgagcttttgaccagaagcaagtggacatggatttgagcttcgggtaagaagggagacttctctccagggaccataggggctggcagctgaagaaggtgacttggcccctctctagagggtgaacgcaggatcaattcaaggccatgaagtggatgcagctgggagagcctgcttggtgcttttaaacctcaacatgtcaaccgcaaatacctcaaacactgctcacaccgtggtaaaatctagttgcgaaacctgtcccgcggcagccttctccatcccaggtgcccaggccccatctcctgggagcaggcagctctccccaccccgattcatgtccctcctacagcccaaggcaactccctgccaccttggtgaatgaagcacatcatgctgcccaggcttctgagctgtttgccgtgttgcggagatgcagccttcagccttggatacccacccactcctctacttgggcattgttttcacaggctgctcttccctgtagcttcagagaagtaggtcaagtaggttaactcgctttaagggagaagtgccaggggttcaagtcacccagcctggaggcaggaatcctgggttctatttttggcttcacagctaatccgctgtgtgacagtcgttaggagctcattctcccctctgggtctccctgagcccttctctaggtcccacaatttttttttttttccctgaagctatattccctggactgtcatattcttccctcttccctccctctgggaggtgctttaaagccgttggctgctcaaggctggcgccctaggcaagaggggctgcagttgttgtagctgatgaggaggagataagaggcttttctgtagacacagttgagctgatgggctgtgtgaggctggagtgccaggaaaccagactcctgtaactacaggacaggccctggtgatgtgatgatggggatgtgacggggatgctgaagcctggaatgcgagtgggggttcctgcgttttatgcaatggctgtagatttcctcccacttctaagcctccctttctgtgacacgcagggaaattcagtctctagttcatatggaaacttgggacctcactgtgctgcttgctcttggcagaggatatcatttgagctgtcatagcagaggaccacatttaccagggtgcactttggccaaagaatagtaacctttctaaggcttagttcctctggcctgaccaaaccagtcccaggaggcccctgggttccagtcaaggtcatgggagaggcccaccatggatgaggcctgggggagcagggtggaaattaagtgcccaggtatgttatggatagcctgcagccctctccaatccctaccctccaaacccagtgaagggggacatgaaacaggtgaggcagaggagcaaatgcgggtcaagaattccgaactatacttgacttacagtgcagctgtgatgtgcacattggtgtgtgccacgagacagcatagtgtggtggaaagaaaatgggttttgaacagagtgtcctgggtttgaatctctgcttgcccatgtactagagagtagtcgaacctctctgggcctcaatttcccagatgtaaaatgggaatagtagtacttaccttgcacgggtgctgagagaattccatgagacgacacaacccgtgtaaagtgcctggcataggcatatcacattagggcactcagtaaatgtgatgtcttttctacttgccttcctgtcataccggtccccatgttttggatttctgcagctaaagttaagaagctttttaagataggaatcccaattctcactttgcctccttttcatagctcacctaaatggctgacttctgttcagcacctcttcatgggtgcactattctggagagggagatcctagagttcccaccttctgtttgtttgtttttgtttgtttgtttgtttttttgtttggtttgtttttgtttttgagacagagtctcgctctgtcacccaggctggattgcagtggcgcaatctcggctcactgcaacctccgcctcccagtttcaagcaattctcctgcctcagccttccaagtagctgagactacaggtgcctgccaccacgcccagctaatttttgtatttttagtagagatggggtttcaccatattcaccaggctggtcttgaactcctgaccttgtgatctacccacctcggcctcccaaagtgctgggattacaggtgtgagccaccatacctggccagcccttctgttctagactgtgagcccgaagactgcattctctcccaggctcagtttccttatatacataatgccaccgtggtcaacctctacagcatcatttcctgcacatattttgtctaaacaccttgactgcacctcagagaagctgggtatgggccggattcctttgccatttaatgcatacagcccgcagaacaatgttgtctgctgagcccctgggggacagcagagaattggagcctcttttcatggttctcacaggccatgtgacacacagatgggagaagctggcatctgcagggccaaaggcctctggccaaggcacccataccaaaggggacagactggccaaagcagccttatccctatctccttaggaaccacattctagtgggatctgtttggtgatacaggttgggagcatgggtggggaagcctaccccaggcctgattcagtcatgaggatccaggagcaccctccaatggctgttgctaactacagttgccagataaaacttaggtggaatctgagtttcagaaaacaaacaaaaaatgtttttagtatgtctcacctactgcctggggcgtacattacaaatcagtccttatatatttgaaactcaaattacattgggcatcttgtatttttatttttttgagacagagtctcacactgttgcccaggctggagtgcagtggcgcgatctcggctcactgcaacctctgtctcctgggttcaagtgattctcctgcctcagcctcctgggtagctgggattacaggcgcctgccaccatgcccggctaatttttgtatttttagtagagatagggttttgccatgttggctaagctcgtctgctaaccctagagctgacaggaaggcttttgggttgggcggttttacggggaaaatactctgtaacagcgtttttcctttactctcacatcacaacaatcaacgcagaagagttatgaccaaatgtcggggtggggggggggcgtttccccacacaccaagcagctgggtgtcctctaatgcagtctgacactgaaaagtagtgtcagatcccacattggagggctcagtccccaagactgttcccccaacaccagttgtaagtccagacctccagaacttctgaccaactggcttcaagttggggttcccgtgactccctcttcgggttcaattaatttgctgaagttgttcagagggactgaaatttacaaaggtcagagatggtagaggaaagagtatggtaagtgtggtgtgcaagcccatctagtgggagcacagttgaggagggaacaggaggtggaagccaggtgggaaaggaagtctggggccctgttggaaggaccttgaatgctgtgttgttatgatagacagttttcctccatgattcctggctcataactcccatagcccttgttacagtcttttgttgtaatattgagtgtgttaggccacaggaaacagactctctccttctcctgccctcctttcacctgcccccaggcaggactctaatctttcctggactttccaatggttgttcttaagaccattcccagagaggttcccaccctataccccgggggaaggaatgctgacgttataaagctttcataaaaacccaagcggacagggttcagggagctttgggataactgaacacatcgaggttcctggagggtggtgcctgggggagggcttggaagccctgtgcccctcctcccacacctgaattgttttttctttttcccttcatgaaactcttccctgctccttgtatgtgcctccatagtcattataagattttatgataatttttacatgtctccccgctcctaagtaccttccacagtgtctagcatgtcatagggagtgattggtaaatagctgatagaaagaacaaattaaactatcagccttgtgaa

SEQ ID NO: 381 - DNA, 1489 bp, Homo sapiens
tgccactgccatgtaagaagtgcctttcaccacccccacaccctgccatgactctgaggcctccccagccacgtggaactgaggcagctgtatggaggccaatatgcagacaagggaagtaactcaggcattttgggggagaggtacagaaagaagagaaaagactgaactgactgctgttctgaacaagaactgtgactatatgtggtactcccagaatgctggtttcctttcagacccatcaagtggccatcctattggcttggactgaagacccccactggagaactgtctctgcagcctatactgatgacactggccactgtccagggctccaccccaaggagtccaagccccagacatttagccttagagagaatccagattttgcatttccagtgcagggattgatggagccttgtgtatcaaagtgccaatttctttctaacaagctagggaggataccgttgacagcagcagaaaggggtagcagtggtttgctttccaaatggtaataagaagggcctggcagtggcaacctgtccacgtatcattaaaaatggactctcctgcttcgtttggaattcaacccaatgaacttgaataaactctggacaatgaccagcacagagccctaagcaggatacagcaagattatttgctttactcatccactgagtacctaccatgtgccaaatactatgctatatgccgagtatacactggcaaataaaacagatatggtccctggagcctatgaatcttaccccatctagccacaaataataaaaataagaagaatctgaaggacaagtgggacagaaatactcaagcagaatgagggtgagattgaagtccctgaacatacagtgccctttacacttgatcttagccaaaaggccgagaagagattacagtgctttttaaaggtagcatttcacccagccaataatcaatccctttggccttcttgaggtgcaaggccacacactcaaattctttaatcaaacaataggctagtgcaaatggagctatttcttaaacccagctgtttacacagcagctacaaatctgttcagaaggaatcccccaccatccacaactgtctatcgagcagatgtgcaagagtatttgtctctcaccaccagggttgcagtcaggacaagagagcaggtttgaacgtcttcggctcctagaactgcacaagctgtgtcttcagtgcccagaggcggctgcaacgtctccccagttctcctctcagaacaatggaaattttttttagaggcgtaataggaaggtttgcattgaattattaaacaatgggtattgaaaaatatgttttctttgacctctgtacttctagcttttaccagtcagtgttttcttgtaccaaggctaagatatgtataacactgaaatggatgtcttcttatataatattttacaagcttttgaaaacctgtgccctttaataaattttaaaacgttt

SEQ ID NO: 382 - DNA, 216 bp, Homo sapiens
aaggctatactttcagggatcatttctatagtgtgttactagagaagtttctttgaacgtgtagagcaccgaaaaccccgaggaagagaggtagcgttttctcctgagcgtgaagccggctttctggcgttgcttggctgcaactgccgtcagccattgatgatcgttcttctctccgtattggggagtgagagggagagaacgcggtctgagtgg

SEQ ID NO: 383 - DNA, 716 bp, Homo sapiens
gcctgggcacagtgctgtctcctcagggtcagggagacactttcagaaggagtaggggcactaactcaccacccccacccctgttgaacccccagcacactgtcttgctcggctgcaagcccgcagctttggcctcagctgttaatcctctcagaataggacggaccagtggcagggaggaacgcgcgtctgcctgtggaatgagagactgtgatttcttaaccttgatggaaaaggggaaagccacatcttaccaaactcttccgctgcgtcgtagggaatttaattacatttggacatttgaatgagaagcagatgtggctctggcccgccggccagcagctctcaaaggacagccactctcctgtggtctgcagggctcagtgctatctcgtcacgctggagggtagctcggggagaccccttcctgggaactaggagccgtacacgcccagtgaggtcactagagcagaccctcccctcctgtgccacagatgctgacgcagatgagaagtgaagtgacttgcccaggtcatttggcacatctgtgacagaactgaggccagagtgaagtctcggcctcctcgcacagtcctcctcctccctgggccatccacagggagtggtagggcagggcttctcccacatctggccgatcctgagcatggctccagccagtcctcagatacatccaaaccagcgacagaggagctggg

SEQ ID NO: 384 - DNA, 555 bp, Homo sapiens
aatgcacagcttctccgcggtcagcgggctggtctctttgagtttggaggccaggaacatgcagacagcacccaggagttgcagatgggacttcggagtcgggaccccagccaagaaacggtccagaagaatctaccataaaaccaacagactcctcctgatctctacctgtgctgtctgcctctctagttccggacactgagagctggtgccctgtggccacctcaagctggaaccctgcaagatcaccaagaagactgcatgcctcgctctagccttcctaagggaaagtagactcctgtttttgagagaaattacctgatttcaagagaaacataaaggactttttttcccttaacattccactcgtaaaaatgaagtttggaagaacttctgcaaactctgagtgttttggtcaattgaccttttactgtactaagcaaatctgaagccacaaatacattggggaggaaggtatacccttcacaaaagatccgtcacttagccagatactctgttgccatgcttctttaaataaagcacatttctggtata

SEQ ID NO: 385 - DNA, 800 bp, Homo sapiens
agaatgtcctcatttgtatggtcaaggctgggttgcagagaagtccatgttgcagctcatggaaaaaaagaaccaaagggactcaagaacactggcttatgtcttagattggagatgacctggaaagtcaactttcacccataacccattggcctaaaacaatagaaggcaactggaaaagaggcaaggattctaactacatactgcagaaaaaatattcacacctgtcaaattccaacagctggcattgttgttgttctacgaataagcacacacagaatcctcgtgaatagttctttgtctcttgctctagtaaatcataacctgcttgtagcttttttatgaaccttcaggaataactcttcagaggatgctaatacatcattaagattaaattgaacctcaaaggtgggttttttttccaaaatgataaaggccaccaacactgcaaggtttgccgtcattcccttgatctggtaagtgacaccgtcttcagggtttgtgtactcaaagatatgattaataaaacggtgaccaagacgtgtgacgtaatgctggtcatggacctgtggatgcaggaaataggccagaggcaccaggaatacatccttaacttcagcaggattcggctgggcctggaagttgtggtctattaaacccacaaatggagttatcaatgtatctgtctaaaagcagaaaacaaaacagacaaattaagaagtgaagtgatactgcttcaaatcctaaaatcatgccacttctaggtgagctaagaaaatacaccgaacctgggagaaggg

SEQ ID NO: 386 - DNA, 754 bp, Homo sapiens
gtgtgagctgactgtcccctgggagtaattctgtgaccataattagccacacagctcctctggaggcccctctaaaggacccccaagcttgggcacatgacccaaggtcagccagcaagatgccctgtcccggaaatttacatctgtgtatgagccacatgagaacagggaagcttgcagtgagagcacagcgattttcctggaactgccccacaaggctgtctctgagccccttttgctgggtccccagagctgctgtggctcccattcttcctgaggtctgagattccatcttccttcagttctgtaggatcctgattgttacacgaactgtccacctccatccagagccgtgtggcttgtagtgccttctcgtggcaggtatattttcctgcctgttcacgtgacttgtgttggccagtggaatatagtttgatctgcagtagtttgaatctgaggatgctgaacctgtggataaggagagcctacttttcttggacaaatgccctgtgtcagaagagtgtggtaaacagaagctcagctccttcaaggatgacagccttggttacaccaccagtttctctaggaaaagagaccaaagtcagggagcagtcgttttcacatgggatgaactcagtgtaagaggcaagcagattgtggaagattagaagataatggatactattattccatccagattcctcttcaggaccaaggactcattttccagctggcaggaatgttagctactgac

SEQ ID NO: 387 - DNA, 436 bp, Homo sapiens
gtggcaaacggtggggggaacaatcaagacggacccaaagcggttgcagcagagagggaggcatccaatcccgtccaccagcccccaaaggccgtcgtcctgcctggagaacctagcagtgctaggaaactgacttttctcaaaaatgaactctccctaccaatctgcaccatgaaattatttcagcaaacaaaaaataatggttgcccatcaccgcacactgcgtgtgactcagccatcactcacaggcaaagaagggtgttctctcctctccctgtcagttactaattctctgtaaatgaccatttgacatcctggccggggaggattcagatcagagatgacttccccactgccacaaagtatggttctgggaaggacaaccagccccaaggccacgaagattctgaaaaagtttcttctcatttgaagtcca

SEQ ID NO: 388 - DNA, 829 bp, Homo sapiens
cgccaccagagcttcgtggcttaatgggggaggcgaggagccactgcggacctgctcgggacagtgaagggcgccagtctcagccctcatctgaaacctgctccgtgaccctggactagttcctgctcctctctgggccaaatcctggccctgctcctttctggctgagtaactttgggcaactgtgccctgaaaccctctgccctgctgaagaatggagaggactcccccaccagcacctccacctaggacacatgggaactgtgggacttggagcaaagttttcaagtctctgtgccttagtttcctcacctgtgctgttctaggcgctgaggatgcagccgtgcacaagacggatgaaatccctgccctcagggggccgacatttgcggagtaaataaaggaaaggccaacatgaacagctgatttggataccatcaagacacctgaaattttagcatgagccagatgccaaggaagagactccgggaggatcctgaggaccccccggttgcagccatgtcgaggctgatgctgaggaggaccccaactgtcacgagaaacacccgtcgaacacagccacccagctggagacagatcaagaagctgtcacagatgatggaagaaaacctgaggaaagcgggacaaccactcagaatgagtaatggtagctatgatagtggtaatcaccattgccgtgagtattccttaaagaagggctgacacagagaacaattatacttattaggcatattcatcaatcttggctggcaataatgcctggatgtaatcactctatgacacagttacatgtgctttctgatctcag

SEQ ID NO: 389 - DNA, 451 bp, Homo sapiens
ttttttttgtttttgagatgaagtcttgctcttgtcacccaggctggagtgcaatggtgtgatctcggctcactgcaacctcgacctcccgggttcaagtgatccgtctgcctcggcctcccaaagtgctgggattacaggcgtgagccaccgcgcccggccattccttaatgtttaacacccagtgcatattcagattttcccagttgtccgcaggatgtcttttatagctgctttcttcaaaccaggatctattcggagaccacacattgcatttgatttttatgtcttttgagccttttaaaatttagagcagttccctataaccccttcttttgtttgttttatgaaattggcttgttgaacttcacaaaacacgagttggggtcatgccaactgtaccgttagtgattagtttacatatagggaaaataatttgtgaatgttggtc

SEQ ID NO: 390 - DNA, 135 bp, Homo sapiens
cttggcccttatcgaagctgcagctgcttccgcatagctgctgtggtcaaaaaggagcccagagtgacagttttccttgacggtcgccgttctgtttgttgtaactgatctgcaacattttgggaaaatacagtt

SEQ ID NO: 391 - DNA, 914 bp, Homo sapiens
cagacacagacagagcctgcaaaagaggcaggagagtaagcagcggtttggaacagacaggaacagaacaaactgtgggcaccatgggacttggcatccagaggtggggacactgtggagacaaggagcactgtggatctgcccagccacccagctgtgtgagatgagcccttgtggaagctccaggccatgcaaaggggacaaagaatcctttccccttgggacgtttccagagcttcttggataatcccatggtttgggtgtctgaaatccctatgggaagcccagcacttccagagtgactgctgggattctcagagcttcccagaaccagctttgatttgtgcggctaagctatgggtgaccagctgcagaacacccctggttccgggccagctctctgggcatggccagcaatggtccatggggacctctccaggaacactcagtccaaacgtgctggagtctgttactgtgcatctctgggcatgagcctgtgtgtgggtgtaaacggacaaatgagcgtctccccacggcgaacctcactgtgttgtcatgttgtgtcttcacttttgtccactagcatgtgtgtgtgggaggggactcacgtctagatatgggtatataataatatgagcatacgacatgtcaaagctcatgtgaaagagggtaggttggggtatgtagctgtgtagccatgtgtgtgcatatggatacaccctcctagtggttctccaccccgttgtggcttacagctgccttagaaatttccccttttgctgcctcaggatccctggcatgttccaatgtaacctgggccctgccttgcagagaccggcagtttggtgctctgttggcctgcctttgttcctgcagggtgcagctcctgtctgctttccctcgcctcccattgg

SEQ ID NO: 392 - DNA, 733 bp, Homo sapiens
ctagcccagtggcttccaaacctggagggtcggcctattttctttattctacaagtgcctccactgtgcagcaaagtgtggaaaccacttggcttgagagagctgggtcctctggagcagttcagggtcaccacagaagtaggccgtctcttgggcctattcgccccagcttcgaggtggtggtgctttattagtgttattaaggctagagtgcagtggtgcgatctcggctcactacaactcctacctcctgagttcaagcgattctcctgcctcagcctcccgagtagccaggactacagtgtcgaggtcatgaaagccactgaaagactgagaactgttccagaaaggagactagagagacatggcagccaaatgctccacataatcctgtcctggattcttctcctacaaaggaaggggtctgaggattaggtggtagtactgaatcaaggaactatcatctcctattgtgctgtaggcaaacttgagtgacatggtggaagccaccagagagaatatctgaagcaattcattaaaatcttggcagccagaccccagctcccactttccctgaaagctccctttaatgaagctgaacgctgtcccagcaattccctccacagaagacctactgtcaccacctctggaggggcaattcctggaggaaccaagtcagccaatcgaaggtcctgaataagcaaaaactaagtaaataaattaccatctcgaa

SEQ ID NO: 393 - DNA, 3457 bp, Homo sapiens
ggtttttggggatagttaagcccaggccttaagacagtttgatattcagttttgttatttaggtctgggttagggataccgccagagagcatccaaacatttctgtggttgggaaggctagttatctgtgagcattccagatgaaatagcctataatgggttatcaccttttgatcttacctcagagaagattgaattggatctacctatctgatttagcagaattaaactggatttggatggaagggtaatcagctatttaatttgccagttgttagttagcatttcttcttgctgtatctcaaggatttactttgaatattctgtattttctctttcctgcccatgatgggttttccttttaaaatgctcagcacaggctgggtgtggtggctcactgatctgccagccttggcttcccaaagtgctaggattacaggcatgagccactgcactcagctagaagaattctgataggctctgagcatccattgttccaggtataacaattctgactttttcagatactctgatgcttttatggtatcctgcttgctgctgtcttcttttgaaattggagttcaatcactctgcttttctttcttaatacttgtctgtttcctagattttacatgcttttccatgaacactaatttcctgtatgaagagggaatatacaaatgataggatgctttcctgtaactgagatggcagggggaaggagaggacagcaactcatacagaaggaaatcagcttttgttgagcacccagaatttaccagatcagatagagaggacaggtgtagaagaaaatgagcatgtataaagtggaatagtgggacaataaagtacaaatatggaaaattaagtggaaggcttttaatgctgttagggaacttggattgggttagtaagttatgagactgacatttttgatccttgaaatgtcataatcagaggtgaattataggttatataatccaatagtttagataattaattaaattgggaaataagtcataggaccaataaagaagtgttttgagagtttctcttaaggaatgaagacctaacgagaatagcggcaccgcagtagaagtgttgctaaagtacattggacagaaataagcaattggatattgggaaagaaagggatgaataaaaggtgacatgagatgttaagcctgggtgatggagagaatgtgatctcagcaggtttgtgggtggaggtaaaaataagttttgttctagatctcttgcttttgaggtgctggtaggatattcctgtggagatgtgtagtagaatccgaagtgtgaaactggaacttggagggagagatcaaggctggaaataaaacatgtatgagtaaggagagttaaaaataaagagaaaaagagagcatttgttagctggagtaaaaggaagggtacaggaaaagcatcatagagaagagagaatttgatctgactttaaaagatgccgagtcggtatatggcattctgttcacgagctttccttgttgaggggacatcacatttactaacttgagagataatacatgggaagtgttggacaaaggatactgcatccagaatgacctttctaaactacaaaatcatttcccctctttcctgcttaaccctccctcagtggcttcttatctttcttcagataaaggactgactcctaaatgtcttcatcatcaccaatttgaacacacattgtgtctcacactcctcctcgttcctcactcttcttccccaagactggacagaatgtgaagaagatatgatttccaccagatggagtactctttatacttttttggggtcctttatggttactttttgtggccatggtcaggttcttatccataaaataattattgataacttcctaatgtaaaatgaaaaataatgataaatcacatacttccctcatttttacagaattccttgcttgccttatctcttcaagtgttgactgcaaggttcctgtacacttacttgagttggccactccggtcactataccctgatctctgacacttggccgtggtagcctggagcagcattgttactgggcattgctgtgattgggttacccagctgtgctgatgtggaaacctcagggctatttattgatacttggtttcctaaaggaaagttgagggaatgtattttatgagagggctttatttacacgattaaagaggtttataaaatgtggagatgaatataggtgaaacagagaaagaatgctggtataggaggtgttttcggctgggtttggtggctcatacccgtaatcccagcactttgggaggctgaggcgggtggatcacttgagtccagcctgggcggcgtagtgagacccatctctacaaaaactacaaaaattagctgggcattgtgttgcatgcttgtagtcctggctactcaggaggctgaggtgagaggattgcttgagcccaggaagcagaggttgcagtgagccaagatcgtgccactgcactccagactgggcaatagagtgagaccctatctcagaaaacaaacaaaaatccccaaaaaaccaggaagtgttttcttagggtctagttcccaggcgaatggtatatcctgattctaggtttataaaaatagtatattattcataacatttgtctaaagtgacacatttacatacagtatatagtattgagtaatttccaactctttaaaaataatggagaccctttcatgtagtagtaactatgtttttagtatctgttgactgagaaaatacgtaacagcaaaagctactataaaactttgaaataagttcttgtaaatgtaaaaaaaattctcatatatttggaaagtatacatgtggaaattatgacttatagagtctatggacacttgatttcttgctttatggatactctcaggaagttctggtctcaactttgagtatctcattgtcctcttactttagaatgtggggtatgggggaaaacttctatttgaaaatttgagccatagcggaaattttggaatgacagggaaacaccttctcagaatcctcttacaataaaatttatatatgttatgccagacaatgtactttatactaagactggacttttaaatagtctcatggattagaagtcagatacaataaataaatactttttaaaaattatatttttaggtatatgagcattgttgttgggactacagtgctattttaaagtgaaatttagttgatttgcatgtgagtatacacctacaggtctctgttatagccgtgacatgtcttctgttactataaattacataacaaatccttatggtttcttgggtcacttattttatttaaagacaaaaacatctttcagtacatatgtaagacttaaggcattattgaaaataagcctgtgctacatggtagaatctattaaaaaaaaaaaaa

SEQ ID NO: 394 - DNA, 784 bp, Homo sapiens
aagcaccaaccaaaagaagaaaggaggatagaaaaaataaaatggaagatgtagggtgggcagattagggctgcgtttgttgcttgctttcatgttaccatcatagcgtttttgccacttacaaaggaggaaaaaaatcaattctgtgccaacccagacaacagagacctgagtgggggttgggaagagagatttttcagcacagaatcagactccttctccaaagagctgtgtggccttcacctgcaaggcgacctcttccacaagcagaggccaggacaaaaagaggcacctgtgagcgacaaagacggtttccttggtttccctcacggcgccaagcggagtggccgcctcccaccacagggccccctaatgggcgcttttgtcctgcggggcagagggacctcattagaaggcgctggtgctaaagggaaatgcatttccagaacaggaggtttcatcattcctagcgttagcgacagaatggtgacagaagctctgtggacgtattttccagcgttcagttcacatcaaggatgggtatgcactggcggaaaaggtcagctcgcagaatgatcgcccatccacacagcgtttggaggtcagacgttcctgatgactgtgaaaatggggaggtgagaagaggtcgtcaaagggagcagccttttaaagccaggtcagctgctaacaaattttgtgactttggaaaatgtactgaacttctctgaatgtttatttttttatcccatctgttgaaacggtgctaaaaatattatctactctt

SEQ ID NO: 395 - DNA, 805 bp, Homo sapiens
ggggtgcaccagggcagcagctacagggctctcctcccaagcacccaacgagcaagatgggtctgaggatacctgtgagaagtaattcaacacatctttcacacatgggccaatttgctggtctaagttaaattggagtgacaaggacagctgcttaaagaagacgaggtttcaccgtgttagacaggatggtttcgatctcctgacctcgtgatctgcgtgcctcgacctcccaaagtgctgggattacaggcttgagccgccacgtccggcctcagaccatttttctagagatgcaagctacagatgacagagccgaggtcgtctcctccaggtcccagagctgctatgtggctgagctgcagttcagagccagggtgactcagcttgcaagcctgtgctcctcacctccgtggcatgcttctcccaggctggcactgaatcaccggaaggactccttaagacatggataggggatccaccccagaggtcctgaatcagcaagtctggggaggagactgagaattgacttttctatcaagttccccagtgatgctgatgctgctggtgtgcgtaccacgttctggaacctccgctccctgctctagggccttctgggtggagccctagagctgagctcccagctgtgggcatggcaggcactgaagagtgttgctttagggtaatgtgttaacagtctaagaaggtgcgtggtgagtaggctgaccatttctctctcttattgaacaaaatattgctaagccctggattttctcagctgtaaatcactgaaatctgaataaaa

SEQ ID NO: 396 - DNA, 643 bp, Homo sapiens
gtcctctttccctgtcccacacctccttcctcctgcatcaggcctggggaggggggcgtgccgatgtcacccccaacccccaggcctagagtcctggacacatggacgcccctgccagagctcccctccccgcgcttggggttactttgaaccccgcctcctacaagaggatggtccagcctattgtcggaacctgcaggaatcccaggctgcgacccaagaatattagcggaggcccagcctggctggggctctgcaagtccgacctgggtgccccagagagctgctccgggaaagacgtttacctgctgcccagagctgggactgcagaccctgattggcgagggcttggagagtagctgagaaccttcccttcagctactgaagaccagacagggctttctgtatcacgctgcctgacgatgatgagggtgcagtgactaagagtgcagatgaaaggcccagctctccaaccaggtggatggatttgcaaggagcttctatctgggcgtggtggctcatgcctgtaatcccagcactttgggaggctgaggcgagcgaaccacctgagggtgggagttcaagaccagcctgaccaacatggagaaaccccatctctactaaaaatacaaaattagccggg

SEQ ID NO: 397 - DNA, 1346 bp, Homo sapiens
cagtaacatctttaaactgcatagtgttaatttaaagaatcagaacatcatcttttttttttaatatattgcttttcatttcattgccaatgaagttgaataaggatatttattttctgaacatcagaagatttgcagacaaatgatttgagtaaaatctgagcaagttagaaaatgtttatttcttagttttttcagaagaagttttgttttgttttgttttcttttgtttgagacaaggtcttactgtgttgcccaggttggagtgcactgacgcaatctcagctcactgcaacctccgcctcctgggttcaagcgattctcctgtctcagcctcccctagtggctgggattacaggcacctgccaccgcacctggctaagttatctgtagatgacatttcacctgaaggaagttggtggtaacccttacccataaccaaacttaggatttttagatatgggaaaagcaagtatgatgacttacaaagctctgccttaaagggtaatacattggtttaatcaggtttactccacaacagggaattcaggtagcttagttttatatcttctttgagtctaatgacagtcttttgagttgaggagttagtagcattttttttccagccaaaattcccagttgatctttcttcttaattctccagtgttcactagatttgaaattctgccctgcttgcccatggtgctttgtcttatggtagtctcattctccaaaatcatttatcttgaacctcagtgtgacttgtctttccagatctctgcctttgtctgatctctgaaacaccaaagctcttcctttcctttcaaactttccttgtgaccagagtcacaaacgttgctgtgctctgagatggttggttggaaaccagcccaagctgcatttggcacagtatacaccagtgaagacaggttgccaggatgaagccataggctgtctcacagttacagatgaacagcttcctgcccccaggttccccttctactgatgtaactaaggtctctaacccagaactccctaggcaatccactatagcaccattaccgatggttgatggacatgccaaggtattgacctcttaagccagtagtggctggttagagcttggcaaaggagcagccccctcagtttatctcagtgtgccatacaaataatattttctctggatgttacagtgtgaaaaagggtgggaagtagtgccctgttgagccatattagagccccaggcaaaagaaaaaaatgtgcattcctgtatattttttcttctttaatggctaagtttttttccagaatattaaagtagttgaaaaaatagtgaaaaaaaaaaa

SEQ ID NO: 398 - DNA, 738 bp, Homo sapiens
gctgagaggcctgtgagaggttctggggcgccaccgcagtcattctgttcagcgggtataggactttcattcatgggactgtccctgattcccagccatcacggggaggctctaccttcaagtgttatccagaatcagaccacctcacctcatctactgtggcctccctgggatgggcctggcctccttcagtctgttctcaccacaaagccaccagaaggatccttttatttttattgattgattgattgatacggggtctgactctgtcagcaggctggagtgcaatggcacgatctcacctcactgcaacctctgcttcttggactcaagcaatcctcccaccactgcctcctgagtagctgggaccacaggtgcacaccaccacacccagttaatctttttgtatttttggtagagatggagtttcaccattttgcccaggatggtctcaaactgttaagctcaagcaatctacccacctcagcttcccacagtgctgggattacagatatgggccaccacgcccagcgccttttaaaagtgcagttggatcatagcatttatctgctcataacaatggcttttgcttccccgctcactcaaaagaaattccttcttcactgcagaactgcccctcctaccacaggatgtttagggttcctggctgcaacccccaaaggtcctaatggtgctggtcatggggggatccacaccattgtgacaacgaaatatgcc

SEQ ID NO: 399 - DNA, 335 bp, Homo sapiens
gccgacaggaaggtgaagaagtcatctgcgtgctgtgagggtggcgcaccccaactccatggggacagaaggtcctgcatttaggacccttccagacctcacacctatgtatctcttcatctggctgattacttatatcctttcaaagacgcttcttagtaaactgtgcctccctcacatggccagcggagaagggccttgccctacctctcagactgcagccctgagccactccttggaggtgaggagcaccattcacctgagcagctccccgccctggtgtctgagaaataaatctgccttcagtcatacggttctaccaatctgagcacacg

SEQ ID NO: 400 - DNA, 2961 bp, Homo sapiens
gcttactgcggaacagcaggttggtgtccacagcattcagcatctggaacacggcctgggggtggtagcagatggtgtggcctgtgtaacagacgggcagctggtggctcagggctccctgtctcctggggggctgtagcccacccctgcccctcttcagccccaagctcctcctcatccaccccctttcctctcttgtgggtggtgagtcagggagggtcaagggtgcttgggtgggggcaggcctgggggtctttaagcccggcctcgccctcccacctatgaagagtgtcacccaggtcttgatgtggcaggagtggctgtgcaggtagctgagggcctgtgacaagtggatgctgaattcctcctggctgcgggtcatctggccggaggagagcacacctggctgggacgggctgggggccctgggcataccagggtcctccagccccagtttgccttgcccagcccctggagctgctatagcagctgtgtgtgagacgggagtgaatgggggagccgcaagcctggtctcccccactccctggccctgttcctccccaccgatcccaggcctctcaccaggcaggtccagaggaagtggcgggcgctgaggcccctctcccaggccagcgtgcagaagagggtgtgcagtagccgccagcggagcagcacagcacagcggtagaaggtgaacttggcctgctgcagggacaggcgtggagggtcacccaccgcctatgtctgagccctttcccctagaggccacaggcctccatgggcactggaggcagcctgctgtgcgggtgttccctggttctgtcctgcttgtgcccctcggcaagcctccccgaccctggcaacagcacctggccccccggagcccaggctggtctgcccgcggccctggccctgccccttccacggttgccccgtatccttttccccatggcagggagacccgcgaggccaagctctgacttcgtgggctgtgcacagggcatgtgctgccacggcaggcagggcacagtccatattcacacaagctctgtgagctgctggaccccctgccccgttacagggactgggggcacagcagtgagcagaaaagaccgggtcctgccgcatcgacggcaagtctcgctcgcatgcgtgtgcgcagtgggggagcgggcaggccaactgtggtcacagaaaccagtgcagatggccagaccctctgcccgccacttgctgccccgtgggagctcccccaactctcaggcagtgctgctgccatccgtctgccccgtaccctggcctcctgtgggtcccagccctggccaaggtgaaggcctatcacctgcctttcctggggtgggcactgaccgtggcgacagctgggcattggtccttcaggtgtaggagcaggggcaccatgctctggtgcacctgggtccgcaggccgctcagctccctgtctgccatggccgccaccaggtccccgaacagtgccatggctgccgcccgaatcccgtcccgctcctgcaaggcagaggctcagaggcacggccagacctgtccaggggtcccagctttggtccaagttgggaccccacaccttgtaggggtacaactcagttctttctgcaggattccttcacccaggctctcggctcccggggaagggaagggctggggctcccccctcacacagggctctctggtgtccctgaggatgtaagaatcacatctcccttctacccacaactgcatcctggcagcccaggcctcatgaatgcatttgaggggcgcctatcccccagattccccagtgaaggaaaaacagccacgctaaccgtgctgacatgtcagaaagcaaatctgggtaggctgtcgtggggccggagaccactgcacttggagactgaacgtgagaactagttcagccctgtggagaaggggtgagcgccaggggcccacccagcccacctgctcagcgcccacctcaaccgagggccacaagcgggcagctccccagggcctgggcctccctgcttgcagcttggggttccccctttggcagaggaagggagctgggttgggaggagggtcctggagggcgtgagcaggaggtagccccgccctgccccagtgctcacgtcattaaagaaggagcgtgtgctgatggcaacgccgaggctctgactccctgtgccctgcgcgcccaggcggtgcagcgtgtctgacacggtgcccatgatgcacacgatcacctggtcgctgctctggaagaagccgtcgagcaagggccgcagctgtccctggagcaggcttccctgggggtggtggcggctggtgggcggagagcactaggacccgctggccccatgcccccgcctcgttctcccacttgaccccctcaccccatctgcactgggtgggggggtggggggtggtgattcagagctgtgggtcccggcctggcccttcccgccatggggagctgtgggtcccggcctggccctgcccgccgtggggactgtgcccctaactgggctttgtccaccaggagctgcgtggtctggacagggtggcctcttttcttttttgagacagggtctcacactgtcacccaggctggagtacagtggtgtgaccatagcttactgcagccttgacctcccaggctcaagcaatcctcccaacataacctcctgagtagctgggtctacagccagttccgtcttctccacttgattgcgtgtttgcagtgatttcctgagttatcgggatgaatggtcagaaagcagtgtgcccaccaatggatgtttcctgccattgggccccttagcagtgacttgggtgcaaaccagggtgatttttacaacttttaaacaagtttaaagcagctttgttggctttcttagctgtttgctttgaaaatattaaattcattttcagcaagtgagtcattcaaca

SEQ ID NO: 401 - DNA, 332 bp, Homo sapiens
tcaggtttagcgcgggaggggaggatggcgacttcacccggcctttaacaacacgtacgcatctttcggcgtcttctacaatggctatgttaattacgtggccaggaactaaactatcaatgaagccacctctgactacttcagttacagtgagtttaacaggagcaaaaaagcacgtggcgccctagggcaaccgaaacgagggttttagacgctgattatgggaaattgaaatctgagttgagtatgagatgacaccaataaattataattttgttagataatagctttatcagccataaagtaatcaataaaaataccagtttcctgga

SEQ ID NO: 402 - DNA, 704 bp, Homo sapiens
gtctggtgtctggtggtctcctgactgccaggcaggccagagaaaattaggggtatgttttcatttaacatcattccctgctgactcttgtctctctggaaaattgacagttaggagacaaaaacgttgccatctccagcaaagagcgcttgaacagctgggcatttctagaaaggaatgggcctggaagacctggctaaaacctttgaatcatttcctgccaacatttggccgtgacccattttggaaggtcactcagctattggtctgaagaagccttttttttttctatttggccttctttggaagccaatttatcgtctgagttcttctcctgtaatctgaactacaggttgcaggttctgaactacctgaagccatgcaagtcataacacatcattactgacttctagctctttccttcaagtctctggcattgcagatgttatttctgtcctaagaagagcaagaggagctgcaatatgaaaccagaaaacagacacacttcatttctctctgctgttggtgttttctggggagaccagtggagtcactctgggcaggactgagggggacctgggtatatgaccaagccctggacagttcatgtgaaggagcaggacccagcttccaggtcaggagggaaacatgcctgacctttgtgctgctctgccaggtgaggtgtcctttcctctcctcaccca

SEQ ID NO: 403 - DNA, 492 bp, Homo sapiens
atctgtcttagagctattggaatcctggatcattgtgggaaatgaaaagaactggtttttagcaaggagaccaagaaactctactccctaggggctagcaatgagagaaaggaagccttgagtctttgagcacagggtgacagtttgggtcctatgtgagatgatcaaatccacagcaacagaggaaaggacaaaaggaaaagatacttcgatggaatcagcagccattgatccaatgccaactccaagactggaacgtcgcaatgatagttccaaggcggaaatttgacgtaattcttttcgacacagttttacaggtctggatgcccattttaattcttctgaaagcatgcctccttctggcttcaggactccatctccagccttatgatctaaaaataatccccaaaccaaaaaattagatattatttcctcaaaattaggtgttttaatcaaaacatcttaacataaatacattattatcacccaata

SEQ ID NO: 404 - DNA, 696 bp, Homo sapiens
cccttcgtcgccgcggctctcgtccgggacacggctttccggagtagagcccttggaggtgttaagtgtgatgcttccataatacatttggatgctgtcagctaagttcacttctgaactaaggggttcctccaaatgttggctgaaattcatcccaaggctggtctgcaaagtctgcaattcataatggagctactgtactggctattggaaggaggagattctgaagataaggaggtaaaacctgtttagaaattaaaaatgagttacgatttaaagaaaattcagatgactcattgtgagtgctagttctcttgtaggatgccactggaaatgttgaaatgaaaaatattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttgacttttttctaaaatgtctttattggattgaatgaatgtttatacctgaaaaaaaaaggttcaaaaaa

SEQ ID NO: 405 - DNA, 2517 bp, Homo sapiens
ttatggtgaagaccaccttttcagatgtgacatggctcacagtaagagcacttttcagttcatgcacagcaaaattcataagtgagaggactcaagggccaggcatttgtgaaggctttccagggtaactacccccttccagcactggagtaccagaataatgagaagctcaaaagagaatgtggaaaggccttcctttctccatcaccagagtactcatggcacagggaagccatgaagaagagctgagtgagaagatgctgccacacagctctaacatcagataacaccgggcaggccatgatagggagaagcccttcaagagcagtggctatgggaagacatgaagacttttgccctcttcaaccacctaagaacccacactgaagagagatctttaaatacttggtatgaagaaagaccctcaagaagaaatcgattcttatctataaccaaaaaattcacagtagagaaaacccctgcatctaaggaatgtgggatggtcttcagtcacctctcctatgtgagaaagctatataaagtacctatgggaaaaaggcattacaaatgcagtgaaaatgggaaagccttcagctatagacacccccttttaagaaaaatcaccagagaattcacaagagagttatgggcaacaaatgtgggaaagccacagctcccagaatcttaggcggcactgtattactgctattgcagaagccatctgtattagttacctattgctgtgtaacaaattactcaaaacctagtggcttaaaacaatagtcactatttcacagtctctataggtcaggaactttggtgcagctagctgactcctctttagggtttctcacaaggctaacatcaagatgtcagctgggggtgtatcatctgaaggcttgactagggaaggctctgcttccaagcaaactcatgtaattggcagcattcagttttttgtgggctgctggactgaggacccgtctgttggtctgagacctcctccagttctctgccacatgggcctctccaaaatggcagcttgtcaatcaaagcttgcaagctgatcatgcagtggagaataccaacaagtcagtcatttgtaacctaataacagaagtgagatcccatcatctttgctaaatttagttagaagcaagtcacttggtccagcccacagtcaaggggagagcattacacaagagcatgaataccagagggcagagatcattggaagccatgtccaaagctgcctgccatactgtctcatctctgccacctggcaagatctcatgatatgtatcagtctccctcactgtgctaagggaaagcagactatactcccttttccattctctagagagaattacataggctttgagtaccttcattttctttcccactgatggctttagattttggtatgacaattcttgctaagatctgagctggtgtcttctggagctttccagaaaaggtttcttggccgggcacagtggctcatgcctataatcccagcactttgggaagctgaggcaggcagatcatgaggtcaggagatcgagaccatcctggctaacatggtgaaaacccacctctactaaaaatacaaaaaattagccaggtgtggtggcgggtgcctgtagtcccagctacttaggaggctgaggcaggagaatggtgtgaacctgggaggcagggtgtgcagtgagccgagatcgtgccactgcactccagcctgggcgacagtgtgagactccatctaaaatagaagaaaaggtttctcttcatggacattgtttgcatctacatgtgacacttaggaatgatctgtttagtctcaatcactcactcctggatctgcctgtctctctctgagataacaaaggccttaatgtttagccacctgcatcagagttggtgaggtggtttgaaacaattcatcctaatataaaaagaacagcttttgtaagggggcactgagtgtctcaaacagccgcatgggcaggaagagtgctcagtccagttttggttgaatttgtcttgttgccctaaggcctcctatgaaagactgacaggcttggactgaatcttgtgatctggacaccaagggtcacctgtgggcccagagctagctctgaagaatggggtagtttctttgagaacctccacagcaaaagtttggtcctctgttcccaatgcatgtcccactttaccagctacatcccccagtacctgcccatggctcatgactcatgaaatataaaactcagtaggcaggcataactggttcagacctgccagggctatgtgggaactatcattggtacaaaaactctaagtgtggagaagactgtggtagacaagaggggacatgtctgttctaaacgcacatcagaaacttccaatgactatggccaagtgagataagggtgtacagaacttctcaggacatgcagacctatgtgtcactcataactgaaattcaaataaatattttgtggatttcctgtggac

SEQ ID NO: 406 - DNA, 425 bp, Homo sapiens
agctgtcattcacatagagctccagctttcataaaaagcttttcttcgttgaagagctctgatgtattgccttgtctcgaatgcataattgatcattatgaaaagaatacaggttgttcctgttgtctgttcttccttcttctctagtaacggaattttgaactaggtaaatggctatctagagtcaagactacatttcctagcttctcttgttgctaggagtgcacctgcttctggccactggggtttgcaactattttaaaccatggagttgaggtccccaagacagagaaacaagatagaaggcacctgcacctttgatatttaatgacaagcgatgaagtaccatgatgaaaacagccccaaacccctaactacactttcatgtttcatgtgacagggaaataaacttctgttttgtgtaa

SEQ ID NO: 407 - DNA, 810 bp, Homo sapiens
cactgtgccacgggaccctggtctttgaaaccttggcgtgcgcgagaatttcccagtgagtttgttaaaatgcagattcctcgggtctgcgtagacagactgtgccccacgcttttctaagtcagttgtttctcgggctaccctttaagagacactgctggatggcctggtgaagaaaatacagaaacagatgggtacaagaactaagaaaacggctaagaaagtgttttggtcctgactactaccatttcgctctgtgatttggggcaattcacattgccctttcttctttgtcaaaagacaaaatcacaacaaacttagttcaaagattttttttttcttaagagacggactctggcaatgttgcccaggctggaaggcagtggctattcacaggtgcggtcatagcaatcatggctatcacaggtgcatcctggaactcctggcctcaagtgatccttctgcctcagcctccggagtagctgggacttaaggtatgacagagccaaaactccaagtcatgtcagtagggcatgcccaatagaaaatgctttgacatctaacaacacccagaaccaatgattcctccctgtggtaccaagaagacctagacatgatcggaacctaaatgctggaactctttcaggagcaaagggtctgttgaccagaaagatccaggggtaaaatccacctcaacatacccgtgtagtcaaatttgacaccctccaatcagaccctgccaagccaaaattcctaatacgtttccttgccatctgtattagtctgttttcacgctgctgacaaagacat

SEQ ID NO: 408 - DNA, 481 bp, Homo sapiens
gccgtgatatatgtctcgctccctttcgcttacagaaaggatttcttccgacagacgtgaccccagaaggctgccgagggagactttaggacaagaggcgttgtttttttagggaaggaagaggagcctgtgcagagttgaactggggtggagaggtgccttgtaaagtatggtttccagagatggtgagacctcgtagctaagcgttgtttcctctgcacgtaacttttcagcgtggccgcatttggaaaaggctgaaggtagaaaactctggaatggagaggctggcgactggagcaggatccaggggctttaaattttaacctgaatgcgatcgaatgcgcgactcccagaagagatagccaggcgtccgcccggccgctcaacccccgccaggactcggaatgccttgcttttggttcttttctacaaggatgtctgcgtggatatccctggacactcgataccccccggggacctg

SEQ ID NO: 409 - DNA, 760 bp, Homo sapiens
aggtgcgctttgcttcctaacccgttgccgggttggagattccacctccgaagttttctttctgacttttgattttacattcctagtacagtggagaagcccaggcggcctagaatccagtgtcgtccgtgagtgcttggctggtgttcaagtgcatcttccagcctgagaccgcgtggactcgctcatcgtgagggcgagaggaggataagcccattgggctgtcggctgagagtgaggtgcgggattgctgatgaaatccttggcatcgtcggagatctcatcgaatgcctcgtcgtcgaagtcccaggtggctgaggtaacgttggccaaggtttcgttatcgttgtctcccatgaagggggaaaggccactgactctggagagacaagagcaggacagcaggtgtggctaggagagggcgcgacgaccagatgagggaattgaggcacagcccaggctcaagtcacctgcccaaagattcacagccagtgagattggaagccaggtatctgcctctagagcctgtcctcttaaatgctatactatcctaacatttctgtaaagatgaagtaaattgcagtgttcagcactggcaccaggcctggtccacagtaaggaggcggtccatgcccggagatctcatgcagttctgctgggttccctccactgccttaccaagctgtgagtgcaggaatgactttgtgaccagcagcttaagccaaataaactttataaggtaaagaatttcaaaacaaaa

SEQ ID NO: 410 - DNA, 4781 bp, Homo sapiens
tcagttacaagattcactccaatttgtgatgttaaaaattctagacctcagaatcaatacaatgaaatgtgtcaagagtgtttattcctctgtcatttggtgcaaggcacttctgttgattctccttttgtccttcaccattctaagacattggttccaatctttgtttttggattcaagtttcctttggaatctggtgaaagttatggacactctagctagaaaaattcacattgcattgacatggtgtgggatacagcctgacagtctcctgaagccattccacagaacctatatattttatgtattcctgataagacgtaagtcccatttgaagagctcaaatgtttcccacttatgctgtttctatggaaaggaaaaacaatctgctatccattttacaaacacaaaattaacctctatgctaaagggtggagctttagggtgaaagaacaaaggagtcaaagttacctcctggccaagctaacagtttcccaacccccactgtcattctcttaggcaaggatcaaattttttaaagttcttaaatttttgaaatgagaaatcctaactatcaaaagcaaaatgaagcaagtgaagctaattgtgtttagagttagtgcttaaccactcagagaaaagaattatttccattgacttccggagcacagtaattttacagtacatccctctaagaacaaaaatagcaactggaaaggaattgtaaactcttttcagtaattatattttcagtttaatattgacattgttatttcaaactataagccttcagcaaagtgttattggagattttcattgcctggatttctgttagttttaaagtagagaaccatggaagatggtcttatgagttggaaaaagagaatgagtgttctaaatctatatccatctcccaaccagctttgtctgtctctaggcaattactccagaacaaacatgctgtatcacaagaattattaattttatcctaaagtaaacagactcatctccaatgataaaagaaattatctacccacatgacttgaccgatatctttttaagaaatatatccttggttttactattgtgtgatcaatctgtccaggcttgcctggtacttgtctgtttttagctggaaatccagtgtcttgagatgagcctcacttcggggcaaacagggatggttgatcactgatatggtttagctgtgtcccgacacaaatctcaaattgtatctcccagaattcccatgtgttgtgggagggacccagggggaggtaatggaatcatgggggctggtctttcctgtaatcttcttgtgatagtgactaagtctcatgagatctgatgggtttatcaggggtttctgcttttgcttcttcctcattttctcttgctgccaccaagtaagaagtgtcttttgcctcccatcatgattctgaggcctccccagacatgtgaaactgtaagtccaattaaacctctttttcttcccagtctcgggtatgtctttatcagcagcatgaaaatggactaatacagtaaattggtaccagtagagtgggccattgctgaaaatatacctgaagatgtggaagcaactttggagctgggtgacaggcagaggttggaatagtttggagggctcagaagaagacaggaaaatatgggaaattttggaacctcctagagacttgttgaatcgctttgcccaaaatgccgatagtgatatgaacaataaggtccaggctgaggtggtctcagatggagatgaggcacttgttgggaacaggagcaaaagtgactcttgttatgttttagcaaagagattggcagcattttgccccaaccttagagatttgtggaactttgaagatgagagagatgatttagggtatctggcagaaaaaatttctaagcagcaaagcattcaaaaggtgacttgggtgctgttaaaggcattacattttaaaagagaaacagagcataaaagttcagaaaattttcagcccgatgatgcagtagaaaagaaaaaaacattttttttaggaaaaattcaagccagctgcagaaatttgcataagtagcaaagagcctaatgttaatccccaagaccatgaggaaaatgtctccaggctatgtcagagatcttcatggcagcccctcccatcacaggcccagaagcccaggagaaaaaagtgattgtgtgggccgggcccagggtccccatgctatgtgcagcctagggacttggtgccctgtgtcccagccatcccaactgtagctgaaagggaccaaggtacagctccggctgtggcttcagagggtggaagccccaagccttggcagcttccatgtggtgttgagcatgcggaggcaccgaagtcaaaaactgaggtttgggaatttctgcctagatttcagaagatgtatggaaatgcctggatgcccaagcaaaagtttgctgcaggggtggggcgcttgtggaaaacctttgctagggcagtgcagatgggaaatgtggggtcggagcccccaaacagggtccttactgtggtaccgcctactggagctgtggaaagaaagccaccgttctccagacctcagaatggtagatccaccgacaacttgcaccgcaccgtgcacctggaaaagccgcagacatgcaacacaagcctgtgaaagcagccaggagggaggctttgtaccctgcaaagtcacagagggagagctgccacgaccatgggaacccacctcttacatcagcaagacctgaatgtgagaactggagtcaaaggagatcattttggagctttaaaattcgactgcactgctggatttcagacttgcatggaccctgtaacccctttgttttggccaatttctcccatttggaatggctgtatctacccaatacctgtgcccccattgtatctaggaagtaactaacttgcttttgattttacaggctcctaggcagaagggacttgccttgtctcagatgagactttggactgtagatttttgggttaatgctgaaatgagttaagactttgggggactgttgggaaggcatgattggttttgatatgtgaggacgtgagatttgggggtggcaagggacaaaatggtatgatttggttttgtcccaccccccgcccccaagatctcaacttgaattttatctcccagaattcccacatgttgtgggaggggcccaggtggaggtaactgaatcatgagggccagtttttcctgtgctattctcgtgatagtgactaagtctcatgagacctgatgggtttatcaggggtttctgcttttgcttcttcctcattttctcttgctgccaccatgtaagatgtgcctttcactgcctgccatgatcctgaggtctccccagccacgtggaactgtaagttcaattaaacctcattttcttcccagtcctgggtatgactttatcagcagcatgaaaatggactaatacagtcaccctatcatgcaaacaatttattcatcttcccctgggctgacactctttttaaagcctcccatattaactgaggatagttcttgccaacccctctggaaaagatggcaccatgccaaaatgcctcttttccaatctttatatttcacttttgatagaaggcatggcagagagttgggaatggggtaggatgggaactttcaatttacccaaccatgtgtgccttccctagtgccttatgttctttacttttcttaaaattatttgccttcccaaataagtcatacctccaagacatattctattggctacatggaaggaaaggaaagaaaatgaacaatttccaaacccagttgagtgagcacctgggacaaagaacataggctctgaaagcatggggttgatacttctgttagtgtatttgagggtggggcaaggcctggaataaagctggaagctggcctcttggggagaaaaaaaaaaaaaaacagggacagcattcaagggcaaaatggaaattaaaaccagacagcttgtccaactaagtcatcaacctgcgggacctggaggaagaggacatgaccagcaaatggaagcaagattggcactaaggagcaagagggttcaaagagaagcttgggaagcaggatgtggagaaattccatggaaagacagtatggccactactgttcttctgtttggttttaaaatttttattaggaaaattacagacatatataagagcagggggaataatataataaaatcctatgtatgcattttcaactttcaacaattattaatcatgatggctcttgtttcattcatatgcccccatttcttcattccagattgctttgagacatattctagatatattatttcatttattatttcagtatttctctctgaaagataaaagtctctttataaaagtgtattaataatattattacgtcaaaaaaatacactagctgacatggtttggttgtgtctccactcaaatctcatcttgaattgtagctctcataattcctacatgtcatgggagggacccagtgggaggtcattgaatcataggggtgagtttttcccatgctgttctcatgacaatgactaagtttcctgagatctgagggttttagcaaagtgagttcccctgcacatactatcttatctgctgccatgtaagacatgacttttctcctcattcaacttcagccatgattgtgaggcctccccagccatggggaactgtgagccaattaaacttctttcttttgtaaat

SEQ ID NO: 411 - DNA, 1207 bp, Homo sapiens
cagggcagcccctggtgagtcagggcctgagtcagcgccctccgccttcccagaggccccgccaggacctgcagccctgggcgccccagcagcccggccctgctcagcgcagctctgggttggaacttgcactttccagtaactcggacctccccccggccgccttcccaggcgccaccgggcccagcagatcgtcaccgtccaggctggagtgcagtggcgcgatctcggctcaccgcaacctccgtctccccggttcaagcgattctcctgcctcagcctcccaagtagctgggattacaggcgtgtgccaccacgcccggcgaatgttgtattttcagtagagacggggtttcagcatgttggtcaagctggtctctaactcttgatctcaagtgaaccaccagcctcagcctcccaaagtgctgggattacaggcgtgagccaccgcgcacggctatcccttccaatatttccgaggccagctgcccagagaaggagggctgggtggagaggaccgtgccagcagcagtaggcctgggccaggagacaggcacgcacctccgcggtctctggcgagtctatgtccacacagcggcaggacctccacccccagccacctgcagcagccccacatctccaccgggtcaccctgctgacatcaagagtgcctcccgcaatgtcccaacccatgagggcttcttggagctgaaccagggcaccggccacttctggaggggggctgctcgtgacttccgacctctgtctcgctagttggcatgagaagactggactccttctgcaggcctcagggcagaggcagatgtcagcccccagggatgtcactgccagaaccccagatgccccaagccatctggactccccctgtgcagtatctctgctacaataaaatgtacccagatctgagtcctctcacctgggcgactgccaatgtcccctgcggccctataccccgcccccaggagcccagaggatctttctttttaaagatattcagacctcacagataagtctgccctgaccagcccctccccagttcccaggccctatcctgacaacggccacaacttcagagcagctgaaacctgctgtgagtgaaaaatgagaagctgttgttttaattttactttctctgattactaatgaggttatttcttctctgcataaaaacttcattcgtgtttaa

SEQ ID NO: 412 - DNA, 1284 bp, Homo sapiens
gtaaaaacagctttttttattttttattttttattttttttgagacggagtctcacactgtcacctgggctggagtgcagtggtgcgatcttggctcactgcagcctccacctcctgggttcaagcaattctcctgcctcagcctcccaagcagctgggattacaggcgctcccccaccacgcccagctaatttttgttgtatttttaggacagacggcgtttcactgttggccagactggtctcaaactcctgacctcgtgatccgcccgcctcggcctcccagagtgctgggattataggtgtgagccaccgaacctggcccaaaacagcatttttggaagctacattctgtgagatgttcacctgtttgccacctcttctcgtgaaaaccatagtgagtgccagtgtgaaaggaagattgcagcgtatatgtcaagtagaaacatgtttgaattttccatttgtctgtggggaagaaggtaataacagtaataacagactgaaggaccaaaggaaaatagggaagacgttgattatggacttggatcagattctagctacatgatttgaaaatgacactgcctctcctattttgccacaagcctgtcatttggagaactggcagatcatttatgttcagatttaattttctgttttagaatcccatggagtacatgtgaacataggaaaatcacactcagcagccaagctatccttttgcgataatgaaatcactttaaaacctataacttgatcttaggttggcaaatcttaaacttaacgatccttgaaatttcctgcctgctgtgactgtgatgcagttggattcaactggtttacactgctcttgggtcggcaagaccaaaaaaggttggactgcactgtagcatgcttatgggttgaggcagtggcagaggcagaggacttggccgtcagccagccagcacaggcgtaagaaaatagcatgagaagtttcacgagcctgaaaccattgagacagtgattacaacctccatattaatcagatgagggtttgtaggtgacatagcattttacccaagtaattctgaacagactgtggcttatgataatacattttaactagcaagtgtgtggactataaaacaaatatctagagttatatatggatgtactatcatttggtgataaaagcatagaaaaagcataagttggagtatactgggtttttttgttgttgttaaattcttttccatcagaagtaagagctgttggcagcaactaataaaatgcaacctagtga

SEQ ID NO: 413 - DNA, 613 bp, Homo sapiens
gaggccgagcggtggtgtgtcgttcccacccccagcgccccctcctccggtcggcgcctcggtgtccgcgcgtgggtcctgagggagctcgtcggtgtggggttcgaggcggttgagtgagacgagacgcgcccctcccacgcggggaagggcgcccgcctggtccggcgagcgcacgtccggtgctcccctctggcggacggaatgaagttgataatagtgagaccttgttggtacaagactatgtaacataacctgcgcttctcaacaaagaattgcttttctgacttctgcactcaatagcaagacaaatctctcctctgccttctccttatcagactactcaacatgaaggcaataagaatgaagacctctatgtataataattgacttccacttaataaataaggttacttggtacactggtcgacaaaaccttgaaatgttgatgtttaagggctgttgattgctggcagcaaagaagtccaactgtgctggtacccgagatagcgtctccacattttcttccaggatcatcacctttgttctaaatagctcccacatagtgtgaacagaagtcatatgttttagattttctgccttggcacccagg

SEQ ID NO: 414 - DNA, 2018 bp, Homo sapiens
atgtgaagaacagtgtttctctcctacagaggatgcagtgtccagggcatcatctatgaatggagacaacctttaccggacaccaaacctaccagcaccatgaccttgaactttccagccttctgaactatggcgtactgctctgttgcccaggttagagtgcagtggcttgatcatagctcactgcagccttgagctcctaggctcaagcagtcctcttgcctcagcctcctgaatagctgggactacaggttctattctgaggtactaaggttaagacctcaacatatgaattctggaggacaaaattcaacccagaagtctaccttgtattgggtcctcacggcaaggctgcaaaacccggggggttggtggcccagtcccacctcccatgagctaatgaatgtggggctcagggaggactgacaggactagagttgacaaccattcatccaacaaacatttactgcacgaggaagagaggtgatcaaggcactgcccttgtccccaggaagctcgccagtgcatgggactgtgcaggtgtcttcacctctgcattaggcattcgatgtcaggccatggctgagcatccatcctctctatgctaattttttccaaaagtcaagagtttggaagaacactaatgtgtttttcttccagcctttcctatacaaatgacaacatcattaccctcagcttttaaagtgcaagtctgtacagagatcccagagtcaaggagggcgcctgagtcatttgaaataattaccttttttttttcctgcctgagtcttgcatatctgtgaatcagcaatgtggaaactgggcttcaaaaaaattaagggaggcttaaagtgagcaaagcagagaagagcattggcaagagctgagcgctgccacagcaggaacatcatgccgatcgtcatctaagggagctcatggtgctgtctgcctcctcttagcaacatccacacaggctggtacagtcagatcattgtgacttggacagggatgaaaatactcagctgacaccaatagctcccagcacagccagggtattctagaggtgtgtggtgtcaggacagcctgtgcggcctcatttatttacctgagtcatctgaacaaagcggtgactggctttgcctggctctggcaaggactcgcaacaaagccaaagcctcttcctccacggcctttgctcctgcagcacagcactggcatctttttagcatcatagacactgtcacgtggcaatcaatgacagatgaactgtcccttccctgggccacaagctcttcaaggcgggagcctcagcccagtttcttccatgtctccagcgcccagcacagggcctggcttctagctggtttctgatgaataaacgaatggctatagagatgtactcttcaaaacacaaggggcttctatagtggcaacatgttcagtagcacagtgctgtattggttctttacagcttgcaggacccaaagaaggaatgatttttgtttcccgggaaaggtgtacctcgtgggggcactgctcaagggaaggtgcccacaagttggggatcaagggaggcacaggttgatcaaagcccctggaattgaaatggaggtgttcatcctgcggaggctccgaacatctgaggcagagcctcgattctccaggaaattgactttgccggagaacaaggctggggaaggcaggctgtcctaggggaggagtcgtatttcagccccactgagaccccaaaggcgcactcccatgctttaccccagctgtccaccagggggcaggcagaggcaagagaagaggaaagcgggcggctggtcaggcccagcacatccagcctggcatcccacacgctgggctgcctgactcagacaaagccaggccgctcctcctgcctgttgtggcctctgtgattttatatggtttggcctgtgacatcagacaccacgcgaccatggtaaccaaagtatacagcctggagtgaatgttaataaacaggaaagaaatga

SEQ ID NO: 415 - DNA, 308 bp, Homo sapiens
gcctctctagggaaatgacatcttaatttatacctatagaatctgcctgttcacaggagtgccttaaacctaatttgagacaggagtggtaatatttggaactctgaaactaattttttttgagacagaatctcactttgttacccaggctggagtgcagtggtgcaatcttggctcactgcaacctctgtctcctgggttaaacggatttccctgcctcagtctcccaagaagctgaggcaggagaatcacttgaaccctccgggaggtagaggttacagtgagctgagatcacatgattacagtcc

SEQ ID NO: 416 - DNA, 1325 bp, Homo sapiens
cgggcgtcggggcttcggcgggcattagcagcagctgagaggcctgtgagaggttctggggcgccaccgcagtcattctgttcagcgggtatagggctcctctaggcccagtgggttgctggatttttaacagccacaagaaaccaacactaatgcagtgtgagcccctcagctggtctgtactgggcactgattaatgcctacttggtatgagacacttccaagccatgagccggctctacccctcttcctggaatgccttcatctaacctctattcctgccattatccttccacattcagctcagatatcccttcctctgggaagctctcccgacttgacagaaataacttctccctcgtgtgctgtgcagatcctgtgcagactccaactgggtccttatgtaattatgcttacggtcggtccacctgcctctacactgtgagggcaggaactgtgtcttgttccttgcgtgtggctttggatgcaaagcaacgtacctggccaaactggcattgaggagatatctgttggattaagtgactcgaggtggagcctccccaaaaggagaagctaggcctctcttccccatcacctgcctcaccatgtctaataagatgtccactttcagccgcaagagattgttctcttcctccaactgctggttccgcctgcgaaggcgctgaacctccctccggtccacaccgccactaacccctgtctctggaggaaggacagaaccagttaaagggggatttcctcctacaatcttgtttgacaaaatggcaggaagtgcagctcacctgctatccactggccattttcaaacttcaggctttgccctgccaggttcatagtcggggatccgtattccaagcccagctccacctcccgggttgatcgatccaactgtgggcgagatgctatgtgacaacttcagcaggcccggaacacgccttcatcccagctcctcttccgccaacaatatgaccccaacaactcatttctctaatcattacttggcacctttaatgatttttttaaagccataaaatcaaatgatgtacaggaaaagtttaattgtgagataaaaaatatactgttttatacattagatgttttccagaaaagctatatatactgaaatttataaattgaattattttatacctacttgacacttaatagtttaagcaatcctactataaactgttaatcaagtgaaaaattctttttaaatgtaatagtcccccaagttatcatttgcttaatatggagctacatatgttgtggaaaagacataaaattctaacaattaggaggaa

SEQ ID NO: 417 - DNA, 884 bp, Homo sapiens
agtaagagtgggtgcaggcagggcctgagtggtcactagaaatgagaaagcacagttggtgccatcacatacattcacctcctgctttattctgaagttcaagtatgagaatacgtgttgacatacaagccagctatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatatttttgc

SEQ ID NO: 418 - DNA, 349 bp, Homo sapiens
tgagtagcatggggcagagttaggtcctcatttttaatggtctcatataagatttctgaactacagaggacattactatatctgggtaggaggaaataaatctttaaatttgaaataataatatacaattttaaatatcattttccaaatttaatttcattttcacctttaatatttcctaaggattcaagaatcagatgcagggattctgtttctctccatttttattgttattgttgttgttgttttacatttaggatttcaatgtggaatctcagatttcttttgtgaactcctttactgtcagacaattaaccagaaataccaaataaatgaagatgggaaaaca

SEQ ID NO: 419 - DNA, 5652 bp, Homo sapiens
acaatgctgggccctcagccagacctgccctgcgtgccacgttctgttctaagatcgggctgccgagctgtggcctggaggaaacctggcaggtgtcaccagagctttggggagggtgaggccctgtcggggaagcccagtgggagtcatgaaggagggaacacgtgtggagcccttgtagggggaggggcagccctgcagagatctaagaaaaaattccagaaaaatgagcagcaacctccaaggccaggcatcggtgcaggggacaaggggtcgtagctggaggggcctaggtgaggctgccgggaagggacgatgtggttggtggagtgcacaggcagggacctcactggactttcctgtctgctcagcatggacaggcagcccaggagaaggcagcacgtggccgggtgcagggacgtaccacccccacttccccaggggagctggggtcagacgagtcccaggcactccatcctctgcagcaagtcaggttgtgatttactagggggtggtgaatataatggagagacttctggggaggaattcctggctcccgcgtggacttgcagagctcaacaggcagccacgtggctgagtgtccagcaaacatcacataaggctttgggtcctgcaggtggggctgccatgagcagcaagctcagtccagaagaacagttcctctccaggatccacttcctgcgcacttttatgtgcagtgtagctggagcagagctccccggaattccacaggcaactgagaacggagagggatgcaggccagccagggatccagcgtcttccccatcgtcactctccatggcctccgtctacacacagtgttcgtctgcacagcttgtcagcgcgttatcatgacttctatttggcaccggcccgtctgtccactgtcctggcttgttccaagcgctgccttctccaactggggtcctggctgcagagctgtctgctccccacgttgggcaactccagccaagattcctacacccaaatgtgaccgtgttgctcacgaagaaggctcagctttgcgtgtgcccagccgtgtgcacagctcgtcccaactcctgcgggtggcacctgcctctcccacctccagtctttcccctgtgatgagcagatgaccaccgccctccagggtcagcgtttggctgtttgtgtgcctgcccacccgcctccctgtgcctgggcctgccctgtgcctgcacacaggagtggctcatggcgtttgccctacacggatgggctgtcctgggagctactggacagtcaccttggtgggaatgccagaggcatgggcattaggtccccccggccagcctccgttgccacatgggctatttttgtccatcgcgtgggacaacctagtattgggggaaaactcagtccactctaaagaagcatcggcgttttggatggacgaatgctgcttcatgcgactccatgtcaatggactattttattcaactcgggtatttatgagtgtctcctctgtgccagccacgtgtgaaagaagaactccaagttactggacaccaggacaaaccaggtagatcactgcatccggttcctcctctttctgccgactctcccgggcaaccgttctgattcctggcatggagttgggggcgagctcatcagtacccagagcgcctggtgtgcagccaaaggcccccattttattagtcggtgtgttcagtatcacgctcaagacaagggccaacctattacttcacacacctcaaatacaaaaagtgcctgggaacgtcgatgaggtattaaaggaaaccactggtcttgtcagtcatgtacacacagaaaaaaaaaccagtcatttttatttttattttttgagacagagtttcgctcttgttgcccaggctggagtgcaatggtgcaatttcagctcactgcaatctctgccacccggattcaagcaattctcctgtctcagcctcccgagtagctggaattgcagacacccatcaccacgcccagctaattttatgtatttttagtagagatggggtttcaccatgttggtcaggctggtcttgaactcctgacctcaggtgatccacccacgtcaggctcccaaagtgctgagattacaggcatgaaccactgtgcccagccgaaaacaaccaagaattttttaacaataaaatgaccagcaagtaaacttgaaacaaaaatggacaaatatctaaaatatttttaaatgtatgtattttaattggcaaataatacttgtatatattgtttacaacttgttttaaagtatgaatacattgtggaatggctaaatcaagttaattaacatgcattaactcacatactttttgttttttggtgtggtgaggacacttaacatctactctcttagcaattttccagtcaccatgtcctactatagatccctagaacatattcctccaatgtaactgaaatgtatcccttgaccaacatcactgcccggccccagccccaggtaaacaccattctaccctctgcttctgtgagttcagcttttctagatttcacctgtgagtgagattgtgcagcatttgtctttctgtgcctgggttttttcacataatgcccttctggttcatctatattgtcatatatggtagcattgtcttcctttgtaaggctgactggtataccattgcgtatatacaccacattgtttacctaaaatattttttaatacaatcgctgaaaactgccacataacttgtataactgctgtaaggcttggttttcagccataagatgggaagagaagtaacatctaccttgcaggatgactgcaagctgtaaaatgccacaaagcgcaggggagcccagaaccgccgcagcaggacaggtcctctggaagcagacagacctgccttgttactttagccatccagagtccagtttagccagtgatgaaatgagtacaaaagaacacctttcttgtaggattgcaaaatgatgtcttcatccattctgtgctgctatagcagactcctgcacactgggtaactgacagcttacagaagcttgttggcttatggttctggaggctgggaagtccaacctcaaggggctgcatctggtgagggctttcttgttgcatcatcacatcgcagaatagcagaagggcaaggagagagagagaaaagagtgctgaacccaccctttgataagaagcccactcccatgataatagcaccagcccattcaggagggcaaagccctcgtggctgcatcgcctctcaaaggttccacctctcaagatcatcacaatgacaatcaaacttcatgaattttggaggggacaattattcaaaccagaacagagggggatggcaaatgttctgaaaacaagcctagaaattgatcttagaaatggtgcaaaagtagatttccccttctgtctttacctgtgatggtctaaccccaaaagcctcccagaacagaacttgtgagcacaagatagaaacaacaaacttgatgcagagctgagctcacaaggaggtcagggatgtgacaggaaccagagacaaacagaaggctgaaaaccaggtcttaaagtgtgagagccaaagggcagcagcccaggagagtgttcgtctggagccccggggtttaagtctccacactcacatgggaaaggagacgaggcctccctggatccacgtgaatcaggaactggaacaagggcactcaaagggctacgccatcaggagagatgtgaatgagtgtgcccacaggaacaggaagacaacaggatggttctgtgtttgcctgcctgttgtggttctgtgagacagaaacagttttgatgacaattgataatcaggactcagagccttgttagacttcaggtattgaatttttttttgagacagggtctagctgtgttgcccaggctggtcttgaactcctgggcccaagtgatcctcctaccttggcctcccaaagtgctgggattacaggcatgagctaccgtgcccagcctaggtatcgaattttcacaggtttcacagtccaggccctaccacccctgcagcaaataacttgatataaaacctgggcccaggctagtaatacccttgaagcccatgacagaagcaggcacagtgatagaagcaaaatcacgtagacattatcaatctagccccctccaattcctacccataaagcccactgaagatgaatttacaatcataaagtacaaaacatgccaagaaagaaccacatgagggaagtcagcagatgtgtgaacagcaggaacggactccgccaccaaaggccttcaaaaggtgaatcaagcaaaaaagagaacattaattaaacatgtttaacatgggtaagaattacaggaataaaagaagtaaatgaacaagaatacgattgcaagggagtggtagaagaataggcagttttgaagaactaaatggaatatctagaatgaaaaaccatgcttgctaaaattaactcaatgagtgagtttaaaaagcaatttagacccagctgagagctgaatttgtggtatatgcagaaattacttctgatgcgaggcagagcatgatgacagaatgaggagatcccaaacatctatgagagttccattctgaatgattagaagaatgaggaagcaacagtatttaaaaagataatcactaagaaagttctatacttgatgaaaaatgtgaatcctaagattcaggaacagtgtgagacttcagctggggaaaaaagatgaaactacacttctacatttaggagtaaaactacagaatacaaaagacaaaaaaattttaaagtgaaaaataaaaccactcagattacatcaaaagcagttatcatgaaagcagcctatcaattacaatgataaaagccaagcaatagtcaaatatcgatttttttcaaagtcacaagataaaataagtagtaacataggattctgtacatagcattatttgttacctattggggcataacaaaattccccaaaactttgcagcttaaaaaacattcagtatttcaccattgccatgagtcaggaatccaggcgtggcttgagtcctctgcatattggcttctcaccagactgcaatcaggacaatagcacagtatctgtggtctcatctgaaggcttgcctgaggaagtctgcatccaagcttactcttcgttggctgttgggcagaggcaccctcagctcccagccatgtaggctttcccatggtgcagcttctatcaacaaagcacgccagacaagaggacaacacacagtcttctaggaagaagaaagccacaatctttttttaaaaagcaaagcaatatttatgtaattgccacttggtttgagaagtagaacactgtgtcaaaaacccctccaaagcccccgccagtaactgccctcctccttctccccagtgcaaccactgccctcacttctgtctttttttcaacttttaaaaattgtggtaaaatgcatataacttaaaattacaaccttaatcattttaagtgtacagtttggtggtggtaaatacactcgtgatgtgcaaccatcaccaccatgcatctgtatagaactctttccatcttgtaaaactgaaactctgtctccattaaac

SEQ ID NO: 420 - DNA, 1534 bp, Homo sapiens
gggttccgcttgactctgcattctcctacttccctgcctgcttactctctgccatcatagttttttgcttcaaccttcaaatgtagccattctttttctaaagcggtacttattctctttattagttaaaattattaattttatgcacttactgttctagctccaattttgcatttccagttccctgctgggaataaattaaattggcagaagctcagtctaagtgcctgcaacagaatttgtcccatatccatacaacttgctcctccacaacaaatgggagaatcatcctcttacctccagcacctgcctcaaacaaagtttctgatccatctaccacgtaactttgacgctgaccaagaattacagcttcaaagaaatcattcgaggatcattaatatcttggtcatgaataacttttatgtgaaaggctctgcagctaatctcaagtgcagtgaactctgtttcattactgtatttccaaatttagagttatttgggttgtatataggtcagataatttacttttttgttttcaacctaatataaagcacctccaaactttctgccatttgctattacttttctccctcagtgagtgccaaattagctcaattttagttaatttgcaaggtctgacaatcaagactatcctcagcagcaagcagaaaaatttctgaatgactagatacaatttcaagggacaagaaatttctctgtccctggctcattggcaatgaggtatcacagccagggtttattcttctgtgatcatgatagtatttgaagaactcaacaaaagaatgttaattctgacaatttataatagtgaaataattaacacagtcttaatgtcaaataatagtgtattatttaaatgatgtagggaacagttgtgcaatacaaaaccatggagatattaaatatggcttattagcatgtttaaaggtagaaaataccatcatacattaagaaaagatacagtttgaaacttgcacacaggatagttccatttctttatatgaagaatatatatcaacagtagtagaagaagtcttagagagatgaaattgtgggaacatttttcttttaactttattttctatatattctataatgacaatgtattaaattataaaaataaaaaatgagttttcttatcattagaaataacagtccaaaaaaaaaaaaagtaatgtccatccctttaaggatagcctttattggtcaaatttaaagttaatataagttaggttattcaacatttatggaaagggtattttaatggactcttgggggaaaagagatacatgtttctgaagacactggaactcagggaaatatagccaccagtggctgggctgatcaaaggaaggggagaatgaaaatattatcttccccacgaataatcttacctagagagaggctggtaccaacaactaaccttaaataaatgtaaaactagaggtctgtattagtccattctcgcactgctgtaaaaacctcctgaaactgaaatttataaagaaaataa

SEQ ID NO: 421 - DNA, 150 bp, Homo sapiens
ggggggctgcacgttacagatgagggagcaacacttgatggccttctcgtcccgaggcaccagccagcccgaccccgcaactgccgcggcgggcgggcgcggaactgcggggaagccgaagagtccaacctgctcaaaaaaaaaaaaaaa

SEQ ID NO: 422 - DNA, 577 bp, Homo sapiens
aaccttttctccctggtggaggaaccacttgcatgagaataagaggttgttccccaggccatcagactccaaacagttatgcaactggagcctcctgaggatgaccccttctgcctgggacccttagatcagcctctagagaagctttgactgctgtttccccaaaacagcaccccctgccatcaggaagcaaaagccatgttggttcaccacatgtatcgcatcctgataatgtgaagtgaaaaagtagagcctggaagcctttgtaagatgactgtgccagaggaggaagataaatatctcgatgctatggaggcctgtcagctctttgaagtatctgggcaatatcaagatttctacttcagatgaaaaaacaaatagttattcattgaccctgttgccgccaagaaagaggtgaaaggtgaacccccaacccacggaaagatccagccaagtaaggaactgcaaaatattgaatgactaattctccaaacaaggagaacaagaagatttatactagccatgcaaggaatctttggaagtctaacagacctgacttgaagagaaggctttaaac

SEQ ID NO: 423 - DNA, 676 bp, Homo sapiens
gattatttggtttttatgttgacagtgtttgagaggtcttttagcaagtagttggtatcagctagactttgggtgccttggcagcattttctagcattttcctgttctgaagacagcagcacctgtatctgttctggaacatctggtggccatttgcacagctactgctggacttccatctttatctctccaggcagacgagtcgaaccttccaataggaaattttgggtaaatgacaaaaacttatgagggttgtcctttgtgagcagactttgaagcagtaggaatgtagcctattgaaaagatggccagaggttcagaaataagcgtgacggataaaaatcagcaagacatttaatacatctgcaaacttgccttctttcaaagaacattgattgaaacagattcgtttgttcataatgtgggtgtgaaaatagttctgaaaagccattctaaacaaacttatgtttttaaaaagagtagatgaaatctgtttgcggaggaaggaaaagatgacattcaggaagcaatgttctggttaattctgtgttcttcaaaagccagctcattttcttgaaaagaatgctggccacaatccacaggtatagagaatatggagagaaagcatctcacgcctgaagagtccaataaaacatttatagataagaatttaaga

SEQ ID NO: 424 - DNA, 723 bp, Homo sapiens
gtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 425 - DNA, 583 bp, Homo sapiens
ccactcttcaatccacatgaagaaaaggatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcat

SEQ ID NO: 426 - DNA, 3152 bp, Homo sapiens
ctccaaccccttagccaagcactgtagtttctggtagacggtggccacagagaaccgaaggtcaagctcccacccactggtgacccctggtatggggtcggcgcaggcgagcagagtggcagcgttcccgagtaaaccctgctcctgtccctttgccctcagagatcctgcctacctctagcctgaattgataccctcctcccttcctccacgattaatgaaactaatcagaagcagcagctgccacgtagggtcagccagaaaattacatcactggagggcaggccaaaccgagccagggtgggctgggacccggcatgactcacctgttcctcttcctccccggggcggcctggcagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtcaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccagggatctgccagcccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgac

SEQ ID NO: 427 - DNA, 3208 bp, Homo sapiens
aggccagccactcaggatggggccctgtgccctgctcacatgggctgtgctggtcttcaaaccggcctgagggtcagcagaacatttgcaggtggagatggaaggagaaacagcatccggtcagcacaaaccgtaaacagcaggtgctcgggtgtggagctggagccatgtgtctctgtggggaggaacaggggtttgaggggaacatggggactggggctcaaggcacctggatttaatcttagagacgaaggggtggggagggagtgcccacgtgggatctgagaggagactcgctggcagagactgggcagatgtgagccctccctgcgatggtcagccctgctcctgatggccatggaaggaacatttttctccaccccactaaggtgggctttgaccacgtggacgctggtggatgtccgcaggccctgcaatgtgttccagggaatcggcttcaggaaaaacatgcctggagctcagcagagtgaggggcacacagagcagacctgacttgagcctcagcctggacccccacctgacactcagagccctggggagagaggccgtggaaccgcccggcagcatcactgcctcagcacctgccaagatggaaatgggcacgttcaggtcagataggaggctggggcacactcctccctcgcccccgaccacccaccctccaagccttagtttagatgttccctcctcagatcagcattctctgccctgagccacggtggcgcctcactccggggcctgcgtgcctcctgcctgtctgagtccaacctcagcttcccagccagcagctcaggaacccacaaggtcgtgcagctgccgagccgaaaaacgaatgagcagctctcgcgtgcaggtcggctgggtgggtgtacggcttcatggcgaggcatctggagtgagggaggcttgcttctcctgcggggcccttgctttgtgtgtctggacaggcgccgtcctcgtggctgcctgggactggggcctctctccatcatcacagtccaggaagaggggtggccagtcctagagcttgagctgagctgcccttggtggctgtggagatgaggaactgatgttgatggtgcagtcgggaagggagatgtgacggatgaaaaggagaccccgatttagcaggaagtgtggaattctgtgatcctgtgctgctggtccctgcagaggttttggcagtccccagacactgctgtcttgagaggaagaggagtccaggcagccacagcagaacgctgacccctcactggtctgctgactcctcactggtctgctgaccacacagcacggccttggtctccaggctggccccctggagtcctcaaccagccccagagggaaaggaggtttgccagagggaccttgcagccacacgtgtggccccaggatggcaaggacaaggcccctggcgaggtggtgctcattccataaggagtggttagagtcactcagcaaatccatcccacgcctgccacgggcttccccctcccctgggcaccaccggccaccctaagctcagagacgtggtggaacccctcccgtgtggcgtggtgccgagactgagggatgtgcaagctgtgaggagcatgtggccacagccaggtctgaaagacagcactccgaaccaagcagatcgtgtgaaactgcaggccgatgtgatacggagaccagggtgcaacttgctctgttttcaagaggagagactttggagaactgttataaaaaatggttgctgtgtctgcaggctcacacgggaactctgctgtaaatatttctgtgccaaggcagcacagtgttgcatgggggcctgagggcctgtgggtttgattcatcctttctaggatgtctgcaacatttcttggatgtgaaagtttgttctgagcacgacagttggaaaatcaccgtccgtgtcctctgagctaggactcacctgctgcagggaaggagctttgcttagcagaccacgtcacactcccaggatgatgaagaggggatctcctgcagggtcctggggacaaaccctgctggcatctggccatgggggaaagagcatccggagtgaaggggacgacaatagtcaccacagtggctggagatgagcccacacggtcgtcttccccagcggagacgttccctcccgtaggagggtgggtcagaggatacagaaggcgccggcagtgaccaggagcaatgtgcagcctcctctcccccagctcctggaagcagattccgtccgggcacaggaagctttcccggtaattggctaacgcgccacatgactgctgtctgccaggctctaggaggtgagaattcctcctcaaattaacctcatacccagaaacccatcatcgccacttaccaggatgggaaagcacagtgtcctctaaagaaacttacattcaagctgatgatcatactcagacagctaattaagagctaattattcaaatgacggatcaaagaaccgtgcatgcacccagctttccccggagactcgggtcccctggcacttgcatcctgagtcggggaagaatcctcagccacataagtgaggacacatgtttgccaagaaacctcaagtctacattcatagcggtgtctactcagaggacacaggaaaacacacacacacacacacacacacacacacacacacacacacccgggagtccttgcaaatggtcccaggcttcatgagaagtccgtgctggtgacagttggaacgtgttactctggggatagcctaatcactacgaaattaattttctgagctcctgagaaacttgccttcctaaaaaccaagatggatgcaaatgaacaaggactgagcagcccgaagcgggtccatgggggtggcagcggcacccctaactctggccgggtgaggggccccgtccaggcagcctcagtccaggctctaagcaaacgccgtggcccacaggtgctgcttctgggatggcgtcgggacactcctgcgggggtagcagagagctcggcccaccgactagccgctctgcccgctgacctgagtgcttctccgacctccgcagtggacgttcacctctaaaccttccttcatgtaaatgtttggttcccatagctgaggcaaatgcccttgaaaatgcttccatcaggaaacattcagacacctaaatatatactttgtatcaagtttaatgaa

SEQ ID NO: 428 - DNA, 1262 bp, Homo sapiens
actggaatcagcaactccctggaactcgggcctctggccccgtccctcttttctccggcagggacgcaggatgccttggtgcactctagagacggggaccggagggtgcagcgcgcctgggtggggcgaagggcgccggtctcctcacgccctctgactttaggataccagacagtgtctcttcaaccccaccccaggcgcaggtttccagaaggcggggtgggtggggcccccgatttccagaaggcgagttacctagcaggtgtgtggggtgggcattgctattcggagaaaaatcaagacgttcccttcagtcctccctcggtgttaacgtctgctccagctcgcagcccgctgctgggaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgagctacctcttgtgtttaagaattaaaggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcactgc

SEQ ID NO: 429 - DNA, 387 bp, Homo sapiens
ttattaatgcttttacgagttagaagagttgggataatttgccatctggagtttctctgccttgctgatctgagctcagacctgccaatttaccagagataattgataacaccctgtaacagctgaattctttcttgcatgagatacaagagtcctcccttggggtctggatcaggacccctttcccataacagtgtgagcagtggttattgtatgggttttggcttccagtgagatgaaaaagaattggtggattttaaggagagaagcaacatgatctttctaatgaaggcaccctgaagataaagacacacccacctgcaaggataaaagaagcatggcggcggggtggggctggtatccagtctgcttcaaaacggaggaggg

SEQ ID NO: 430 - DNA, 1904 bp, Homo sapiens
tgttaaaagggttttaaataagtctctttttcaatggtgtaagtatgagatttgtgaagccctttccagatgcatgtgtgtttgcttatgtttaaaaaatcacttgagtgcaaacatttaaacacattttataaaactggcgggccaggcacggtggctcatgcctgtaatcccagcactttgggaggccgaggcgggtggatcacgaggtcaggagtttgagaccagcctgaccaacatggtgaaaccccgtctctactgggggaaaaaaaaaattagccaggcgtggtggtgggtgcctgtagtcccagctactcaggaggctgaggcaggagaatcacttgaacccaggaggcggaggttgcaatgagccgagatcatgccattgtgctccggcctgggtgacaaagcgagactctttctcaaaaaaacaaaaacaaaaacaaacagacaaacaaacaaaactggcatggcattggacagtgacacataagaagctgatgtcatctttgccacttagagaaggcaaaatatcttgttagataacccctcttaaatgctctgcttggctagtactttttgggcttggtcagtgattagagtttaagttgtaaatggtattcataatttcttgtctctgtctcatcccaaacagattagaaaatctttgatttttgttggtaaggagctagcatcttattaatacaaagccttgtgcataaattatttccagtaattatttagtgcctaatgtggcatgctttgtgctgagtgctgaggataaaagaggaataaggtaagatctttatagtttagcagaggaggatgtgagtgggcagaaaaatgttatgagttctataataggaatatgtataggggaacttggttacagctcagcttaattgagaaagggtgtgaaatgaaaagaccaaacattctttgcagaacagctaaacagttggaattatatactcagatgagttaatgattataaatagccatcatttattatctctccagaactccagaaccaaggttataaaaaatgaatagttctttatttagttcagaagcatttgtgaagtatctatagcatctgtaacatggcaggccctaaggacgctggcatgaatagtgggccgtcatctactgggagagtcagtatagcgtgtacgtgcgttagaggtgaaatgcataaaggggcatccaacatggctggtggctggccatgtgaacaagacatttgcatttgccacagcataaagaaggatatttctgagtcatggagtattttattatgtttatttggccccaatatttccaaataaaaagaggcctttgcttttgtgctacaggcgtttcttatctttaggaagaatgggccgggcgcggtggctcacacctgtaatcccagcactttgggaggtcaaggcaggcggatcacaaggtcaggagttcgagacaagcctgaccaatatggtgaaaccccatctctactaaaaatacaaaaattagctgggcttggtggcacacgcgtgtagtcccagctactcaggaggcgaggcaggagaattgcttgaacctggtaggtggaggttacagtgagccaagatcgtgccattgcactccagcctgggtgacagagtgagactccatctaaaaaaaaaaaaaaaggcacggttttgaatctgcacactcaaaaatggccacagctttcccgctactttaagcactcataatagattaagcatgggtcagatctcaccactcattagctattgggtctgaccactaattatttagtggatctctagatcagttatgtaacatctctaaatcttactttcttctactgtaaattagagataaaaaaagtagccaactcctagtggttttgtgagcat

SEQ ID NO: 431 - DNA, 2630 bp, Homo sapiens
ctcccgcggcgggccgggtctccagggaggacctgagttttcttcacccatggtcagggaagcgccatcgccctggctttgaggctggggcctccggggaggttccggtaggggctttgaagaggccgctgtttttgcaaggccgagacggcgggccctgcgcaggccgccctattccgcgccctcagggcgtcagtatccgcctgaggccggataccccctctgggcccggatgcccccgctggccccggagcatcctcggcgctgccctcccagagccccgcagaggctgaggtggcgcgggggcggccccggctccgcgagaagcggcggcagcgagggctggaggacccgggctacggggctccggggcgtctggcctggttgggactgagcccatccagggactgggactctgggattctggtgtaggtggatccggggcaggctcaggaccaagtccctctccttccaccaaggagcgcccagaggccggcgggagctccaggttcacctcctcctcctccaggaaatctcacttccaactggatgtctggatgaactactgaaagctgctgagtgtcctgcagcaggtgagctgtggccagagcccaaggatgaagggggctccctcactctgtgactgtgaagaggaagcctgaggtgtagcaggcccaggccccagaagtatggaaaaaatgaggccatttccaatccagcggaagaccttctagaagaggtgatgggtgggagagtgctggcatactacgtgaagctactatttggagttggacacgagtgcatgtgaccttgtgccacagcgggaatgtgagctggatgacaaatggagatttggacttgtgataattggcctctgtgtcattgtgtggaagactgactggtccctttatttcctgtagcttgactaccacacaaatgaatccactcaaatgttggcaagtggagcagagtcccaggacagtctgcaatctctacaggtacagaaacacccccagttcaaggatcttcacacctggatttaggcctactcctgcaactaccccaggccagttatccaggcagtgactttcagtgcagctacagtcacctctggaaacctgcggagactttaaaaatttccagaaggtcaggaatttttggagacctttctcatggctacattgcctgcaaaggtgaatcaataagcttctgaactgacttagaaaatgttgcagagactcttgtgaacagatagaccctctcctgccactcagatagacgtatcagggtcacacacacctgatttaacaacatgtcattatctcaggcaccaatttgatcttctactatgttgcagacatctgttctgcaaacaccaaacaaattgagacaatgaccttccgcaggacccaaaccacctcttactgaaggaaagaagatccagtgagatagttagtccacaaatggaatgtaaatccataaacactcttaagtaacagaataaatttagtatgaacgtttttatgtgggagctcttgacatggttgctgctcatatgtcagagacacatgcagtttaagaaaggtagcagttccaatcctggtttggcccaacagtcactgcatttttggtggggaaaagggatgtgggaggagatggtacctcttcatctttttctctgggttttctgtcagaaagggatgttgcttactccagtggcaaaaaatgccagtgtcttctgccagagtgggttactgagggccctggtgcttccaccttgtggctgatacagatagtccctttctgcttttgtttctagccaaaaaagatgtttctggcatctcaggtatgctgatttcagcagctgttttttctatatggctattttttttttctttcactctctctctctctctctctttttttttttttttgttggcttcactgtgttgccatagtttcttaaatggtcccttgaaccctcccagtgctattttggtttgtacataactatctatatattttttttctttgggggagtgtgtagagctaaaggctggtatatgctgctcctgctccccgaaagtgacattattcccctaagctaatatttcaggctttcaatttattcgtggtttcacctgtttaaacataagtagaaattactttttctctccatatttagatttgatctatctactttaattgctaatagtgtcttagtcatagaatagattagttagaaaaaagtgtttttgacattataaatgattctttcaatttgtgtctaaaagtggaaaatactagaaagcttaacatttattattgtattcagaccagtatttcctccagatgacctttattacaacaaagataatttaatgaagatctctctaatggtaaagctgatggctttgtgctattacaatatccttcgaataaagtgacagtctggtggaaagaacaactaaagcaaggattaggaagaaaatagttaataccttcattttggtctcactctgcattaagagttgtcatcgtgttaagggtttattatacattaagtaatttaatgtttatttaataataaatggatcctattaaatatgatttttaaaattataatcaca

SEQ ID NO: 432 - DNA, 479 bp, Homo sapiens
ttgactgtggggctgtggatgggacagtctcaaactccatgttcccccagacccagggcccatcctggcacccagcccacagtgggccctgaggaagcatggacctccggggtagccagaatccattccttcccatgtcaagccctgtgctgggcccacccagcctcttctgtcctggggaaatcaccccagggctggggacctggccccagggccctcatgggatgttgtcaccaggaccaaaagctgggagacccagagccagagaattaggctgagaattgggagacagagccttcttgggacaggtgacctgccttgtaccagctgccgtattccccatagggggcgctgtcccggcgcttatcctggaggaaagaatggtcacaagaaagatgagcagaacagacccttgcacctcaggccacagcccaagacatgtgctaggcctgaatgatgggccaggctccgagggactc

SEQ ID NO: 433 - DNA, 616 bp, Homo sapiens
gaaacaggggcacacgaaggttaagcaacctgctcaaggtcacccagctctcctgctctgaaccacatcctttgctaagaacttcatgggcagtatcccatccaaaccttgcaacaacccagaagggcctcttcttcagggaatggaagcagccgactggaccgggattggagtgtgtctcccacctgggggcgccagagggcacatatactgctgtactcgtttgtgccaccagagggcagcctccgcacatcgatctctactgcttccgagaactgtccaaaccggcgggactgagagagagaaacctggtccagggcagagaaagagaggagcccactgcagtgcgtgcaagcgatcttccacgcgtccatcctgaatgtgttaaaagcagcagttaaagagggagggctctggagttggactgtttgcgtttgaacccagactctgggcaaaagctgctgaacctctctgaatctaatagcctcatctgtgaattggaaggatactagcgaggattaaatgagagtgcataggaagggcctagccccggtgcccagcacagaggctccatatgtgtcaccgttgtcaatttctgactcatgtattcatctat

SEQ ID NO: 434 - DNA, 950 bp, Homo sapiens
gagagctctcattttccccccttgctcgggatggtgccacaggaggctgtgcgggccccgctccgcttcgaatggatacagttaagctaatgatctcgagaggatatcgtcctggataagggtggagcctacgcccaaaaacaagattacctgaaagagaaaagaaagggggaaaacacacagagatacagtcggggaggccacatgaagatggaggcagagacaggagtgatgagcctgcaagccaaggaatgccaagggctgccagcagccatgagaagctgagagacacagagaacgagtcctctgccagagcctccagaaggaactaaccctgtcaataccttgatttcggacttctggactccagaactgtgagagaatatatttctgttgttttaagccattcagtttgtagtaattggttacaatagccatgggaagctaacatagggtccttcaacaatcaaagcaaaaaagaggacctattagcacatggagtgcaaaggaggaaggaatgactgagctgtttgaaagtgcagcgggatgtcatgggcaaccagaactcaggtccaaattctgccagaactctccctctgtgttagtctattctcacactgctaataaagacatacctgagactggctgatttataaaggaaagaggttcaattgactcacagttctgcagggctgcgggggggactcaggaaacttacaatcatgacaaaagtggaagcaaacacatccttcttcacatggcagcaaggagaagtgccgagccaaaggaggaaaagccccttataaaaccatcagatttcatgagaactcactcactatcatgagcacagcagcatggggataactgcccccacgattcaattacctcccaccaggtccctaccaagacacgtggagattatgggaattacaattcaaaatgagatttgg

SEQ ID NO: 435 - DNA, 3463 bp, Homo sapiens
ggtggcttccaaggcgactccgtagtggatgcagcgccggacgccacagccgaaaaacagaatcttggaactggtttagtacaatccaggtcgagttccttgttttttatccgagtggccggcaggcccatgtgctgtcttgtttttaacacatcagctcttgccggaagccgctaagagataaaataggaagtcccacccttcccttagagaaggaaaacggagagccgaaggagtcaatctaaattcgatgagcgcgtcgggctccaaggcaggcgctgtcagcccgggagggctgtctgggatttctagagggtcccagaacgggttcttcccaggccgatcccgcctgcttcctgccccgtctctccacccgcctcccgccctctgtaagggaccccgagggcggcgccggaaacacggagaaggcccagaacggcgcgggacccgagaggcctacgttggcaaacgcagcccgctgcccctttgctcgcttcccccgggcctggagtggctcctgtcgcttctggcgctccgatttcgagaaatgactttcagctgtgcaaggcgagaatgctactttagatgatgagaaaaaatctctcgaatggctcccaaaatgaggtccttgtttaagaggccacaggaagccgctagccgaactctgataccaaagaggaggccaagaagcggactgtggcttggtgacctgtttggtattgccaaattttcagcttttattaaagctgaaacaccttggctgtttaaaacgttcgacaaggacttttttatgaacgttaacggcacagcatacgggttttttggaaaaaaaaaaaggcaggacttcagcccgtccgcccccttgtgcaggtccattcatgaacctcgagttagaggcctttcttctgaaactcagaatctagtagggaagacctgtgtagacgaataaaaataaatacatcacagcttgttaagtgctgtgacaaagaggcagtgaaatcctgcttgaggtcatctgccttgctaaagaggtttgactatgttgtaggcacagggttagggttagactctgtaatgggaagttatgtgatcagatttctgtttaggaagatcactggccaggcggggtggcttacgcctgtaatcccaatactttgggaggccgagtcggtggattgcttgaggctaggattttgagaccagcctggggaaaccgcgtctctactaaaaatttgaaattagccaggcatggtggtgcgagcctgtaattccagctacttggaggctgaggcgggagaatagcttgaacccagtggcggaggctgcagtgagccgagattgcgccactgcactccagcctgggcgacagagcgagattccgtctcaaaaaaatcattccaacgagtggataaagaaaatgtgatatatatgcactatggaatactaagccataagaaggaatgaaataatggcatttgcagcaacctagatggagttggagaccattattctaagtgaagtaactcaagaatggaaaaccaaatattgtatgttctcactcgtaagtgggagctaagctgcgaagatgcaaaggcataagaatgatatagtggactttgaggactcaagggttgaaggatgagactacacattgggtacagtgtgcactgcttgggtgatgagtgcaccaaaatctcagaactcaccactgaagaacttccccatgtaaccaaaaaccacctgttccacagaaactatcgaaataacatttttaaaactttactatttctgaataaaatttacatacatttctcagaaaaaaaaatatttggaattgaggtatctaatagagaactgagttaaattattgccacttaaaaacacaaagtgatatagccactttatgaattaatcagtcagcagtggctaggttatgcttagtggtttataaccaaatcttagtttataacaacaaatgtgtattgttaattcccactacaagtttataacgacattgctggatgctacactccatgtctctttgtgggacccaggctcatgggacttctgttacctgcattagagagagagaagacaacaaaatatgcactggttcttgaagctttggcccagaagtaaaatatgtcttttacctgttcacattgcattgggccagggcaattatcatggctgcaagtaacttcaaaaggatggggaagtgcgatcttggcatgtgtcagaagaaatgaaaacatttggtgaagagcattaatgactgtctttacaggaaaaaagcaatcaaatagacatgattgcttgtttcagtttcatcatttcctactgtgttacctaaactttctgagccccagtttcttattactaaaataaaataaagatgatattcacttcaaggactttgtgttaactagggtaaaaaaattgaaaactagtaagttatgcaaattagaaatgtataatattactgctttgaaagtgatggtgaaatgtagaataattggaaggataacacaaagcacttataccaggaggcttttagctgcagataatagaaatgaacctccactactttaatcaataaaaaagtgtatcagctcacaaatttgtcatccagacataaaggaggcttcagaatttattgactcaggagttgaatgttggtatcaaggacctagatttttctcatcactctgcacttcaattctcaatgccctattgaacatcaggctgtagtaagatggctagagtgattccagggataacatctagagataaaaaagagaactccttttcttatgatttttttcttaagagaaaaggaatttcccaaaagcccccagcaagcatgccttcacatcccatggccagaagtggctcacatgtgtaccctgagctaagcactgcagacaggaatggaatcgcctgtaggcctcagagaccacctggatcttgggaaggtgtcagctctacctgtggcacttggctgagtgggaaagggatggaaacatgaataaagtaagaattaggaaggaaaaggagaaatggatccagggtatgaagccaatagtttagttatctcaacaaatatgattgatttcatctttatgaatgtgatgacctaatttaatacattcaatcaatgaagtaaaaaaaagtgcaaggacaatatgacatctgtcattctctgttgagatttgagaggtaataataccaagaacgtgtggtgacctgggtcctcactgctactgtcttcctgtacctggacacttctagcaagagacttcaacttcagaacaaagaggatcccaacttgtagctgcattatacacaccccagcagcacacataagttgatttctaattattcctctttaagaaattgtttgtggaatatttatctatttataaatggaaaaatagaaaattaaaataacaaaaataagtaa

SEQ ID NO: 436 - DNA, 91667 bp, Homo sapiens
agaacggtcgccgcgtcgcctcagcacggacctccagggagctcctcagcaagatcctgccagggcgcccctcagcgcgattctgccggggtgcctctcagcgtggtcctccccggggctcctcagcacgattctcccggtgcgcccctcagcgcggtcctcctcggtgcgtcagtcatcgtggttctccccggcgcgcccctcggcgcggttctcctcggggctcctcagcgcggcgctcttctgggggctcctcggcgcagttctccccggggactcctcggcgccgttctcctcggggcacccggggcttttcggcgcggttctccccgggggttcttcggcgcggttgtccccgggggttcttcggcgcggttctctccgggggcctctcgccgcggttctgttctccccgggggctcctcagcatggttctcctccgcgcggtcctccctgggcctcctcagcgcggcactctcctgggggctcctcagcgcggcactctccccgggggctcctcagcgcggcactctcccggcggctcctcagtgcggttctcccagactctcctcagcgcggccctccccatctctctgggagggtttgaacacggtcagcacggacctgggcggacggcgcgggacgggtgatcactggcgttgctgaggtgagctgtgtgccccgcggccgtcccagatcacaggcgtcagcagtgcagcctggcctgggcagtgcgctcccatctgcaccttatggacagcgtggccagggtcgaggtccgagttcctggccgcgtcccaaggatcggattccgggtctatagttctcatggtggttcagagtgggctgaattgggattggagtctggaatccgcatcgtggttctgagtccgcgctattgggatggaagttgggaatccatgttgtggttttgagtcaaagcccgaattgggaccggagtcggaaatccacttagtggttctgagtcagggcccgaattaggatcggaggtgggaatccccgttgtggttctgagttaggtatcctagttgggatcagaattcgggtctagggtccacatcctggctgggagtttgcctgagttgggatctgagtagttggggtcccagtcagtccgggtctggagtccgcatggtggttttaggtagggcctcattagggacagaggatcgggagtctgagttggggacctgaatcccggtctggagtctgcatcatggctctgagttgagatccaagggaggtccgagttggcgactggagtcagggtctggagtctgtctttgggtagaggttctgaatggggggctctgagttaagagattgggattggggttagaggtctcagtggggtatgggagtcaggaattgaagtcgaagttctgcctctaggtggggattctgagtcaggaattagggggcgaagtaaaggttgcagtctgagttgggggtggtgatcacctgccaggtgagaggtagtggtagaagtctcttggtcatattggagatgagagttgatcagatgcaggtctcagtctgggtagtaggcttgaagggccaccactatgttcagatcccagtaccccactgtggtccctgagcaggtcaaatagccttttatataaaattgagagtaagagtgccttcccacagcactgttctggttatgaaagagaataattcatccaggtagaatagttctgtcttagattatcacaaagtataaaaactttcctgataatatccacatttgatgtgcatttaccagttctttctttactgtggtgccccttttgctagaccaaaagctcccaacgaggaactctgttttgttttctgctgcctgctctgtacccagccaagagcctgatacacagccttactcagtcagtacttgaaggaaagcaggcaggcaggattaaccagatttctatggtgtctcaaatgatccatttctgcacctgttttccagatactcagtaggagaaaaatttaaggattgagttgcttgattatgggtgtattttaatgtgtttcctaacatgctgaggagaaaagtgggtctgtttcaggatttatgctccagctagagggattttttaaaattgcgaatcagagcatgtccaaattcagatagaaagcacaagaaaactataaagaatttcccttatgaatgtagatgcagaagttccttgtacaatgctagctaactgaatccaataatatgtattaaacaacaattcttaaacaagtgggattgctcttaggaatgcaaagatgatccaatatcagaaactttatccatgtaattcacattaagaggctacaggagaaaaaccatatggttccctcaatagaggcagaaaaaaatgatgtgataaagtttaacgcctatgtgtgattttggggtagtggagtacaccacttagcaagccaggactagagaggaacttcttcaacttgatacaagttataaaccaaaacttaacttttcagtaaacttgatagagaaattaaaagtgtatcattctctttaagataaggagtaggccaaggatgtcatcctggccataccctaatacaagaaaaagaaatggggatgtgaggatcaggtaggaagtgataaaacttagtgtagctcatagggttgatggtctccataaagattctcaaacattttggtgttacgacttgttgtattcttaaaagttattgaaacccccaaagggcttttcttgatagagattctatctgttgatagttaccatcttagaagttaaaactaagaaatgtttaaagcagaactatacaagcacatattccactggggtcatggtgtgctgcctctggaaaactctttatctttgtgagaatgaaagaaaaggcaaataatgtcgagtattattatgaaaatgtttttgacctttcctgaaagggtctggggggctctctggaatccccagactacactttgaaaattactgggctacatggaaaaaaaaaattaaggaacttaacaactaaagagagatttcagatttcagagaggttttggatataagatcagtgtactcaaaacaaaaaacaaaaacaaaccacatttctttatgccaatagcaactgactaaaaaaaagcataatagagattaggacagcaatcagaatagcagcaaaatttataccagtctaggaattaacaaagacgacgacttttatggaaaaaattttaaaactctattggaggatatagagggagatctttccatatgcagagacattttattttcttgaacagggcaacttggcattagaatgacgtcaggattttccaaatctgttaagttcaacaggactccactcaaacttccagttggagggcttgagtaatttaacaaacatattctaaaatgtatgtggaagaaaaatatttgtaaatgccaactgaacttttgaaaaggagagcagaggacttctgctggcagataccagggcacacgccaacttcagcaatcagagcggtgtggtgacagaggcccagaagagagctcagaggtaactccaagtctagaggaaggggacatgtgataaaggtggcaccacatatcagtggggactgttcagaagatgatgttggaaagccagccctaaaatggaggaataggaatatggattcctaactgagcccctaggaaaagtagactccaaatggactaaatatttgaaagcaaaaggtagttgccatttgtttaataggagaaaaaatgaataatctccagggccagggtggccgtggggttcttaaacaggatccagaaagcacaaacctcaagactaaaatgtatgaacttgaatgcattaatgattatggattaaggatttctgttaaataaatccatcatggcaagggtcaagactgttttcataataatactaaggaaacaatttgcgtttttcacttttacactcatgaatgtaactttgccatgactcattacaagatatttgaaacaattaaagctgaggagggaacaacagctaaaatataccagaaagcaccacaaatcattaagaaaaaggtaggaagattgccagtttgcaggagggttaacaaacagatgaaaatttgcccaagctaatcagttatcagagaaatgtaaatgaaagcaacagctattcttcataggagaagcattagaaagtaggataaggccaagtgttggcagaaggcaaggaacaagcctccctgtgtgctgcaggtggggacggagacaggcacagacgttctgaagagctggccaacacttcttcctcaaataaaatattttatacctgtggcccagcagtttccctcctaagtaaacatgctggagcagttctcacccagaacaacgagaggctgtgtgtgtgcatgctcagggcagcatggcccataggggtgggcagttggagctggtcactgtggttaggagcaggggactagatgtacacttcacaagatagagacgcgtggaaacacagtgctgagtgacacaaatgccaaacagaaagagggcctcagtacatgactgtgtatttaaattaaaattacacaccacccagacacgcagtactagggagtgctcgtgagtgcacacacacacacacaatgatataaataaattaccctggagaagctgtttgtgtagggaggagagcaaggatagaggctagagatgaagtggaaaagcatggagaggaagagagcggtgactttatgcagacccttacagggtgacagtgtttcataggctgagggctgtgatcaactctgtgcagagtcccaaaagccaagaaccaacgaatgaatgtgcctccatgactctcctgccagataccctctagtggcttctatttctaggaaataaaattcaaattccatcaggtttttacaagatctgccctgcttacctctctgaccactgtcctccctcactgagctttggctctgccagccttcttcttctttgttaaatctgccaagtatccctcctgccccaaggccttcaccacctctgcctggcttgtcttttctggtgatcttcccttgacaattccttcttcttatttaaatctcacaggaaattttgctctgacctgccatatctgtcatccccttcagtcactcactagctgacgactacctttcgagtctctgcaaagcacaggctacgcttttctagttccttagacatctacttatttgttggctgcctatctcttccaccggaagagaggccccaagagagcatatctgtcttccgtatagggtccgcacatggtgggtgtgtcacagatttctgttgaatggtttcattcatttattgaacgaaggaagaggccaggccaggaaagtgtgcctccattttcacaactcagtgagaaagcaaatagcatgtcaaaatctgaccccttgcaaccagggtttcttagccagccacactggtaatgcttgggacaggatgtatctttgttgtgaggggctgtcatttatattgtaagatgtttagcaccctgcctggtctctacctagttgatattagtaattctcccatagtcatgatagccaaaaatatctccagacattgccatatgtcccctggggggcaccgcagatgacaaccacttccttagaacagctcttgggactgggatggtgtctctgctgtggctctttaaaggcagcaggccctggcttgcatcctgccacatctaacacctatagcctcaccacctcggtgagaaagaccctggcccaggcctggccaatcagagtaccctcttccctggtcagcagtataatttgtttggcaagcacttccagtcccacaacctatgggctgccacccagaggtttagttggaactacgtgtcagctgccgtccctcagccatctatggcatgggcacctgtggcttgaccaagttggaggtggcctagagaggccgggctgggcctgctcaccttctccagttagtgcagactgatgaatgagtggttctcagcggataccggatccaggtttgcagtacactccaggaggaggacgagtagggtttccctcagagcaggcctggatgggagggcaaggggtggcctctaatactgcctttccttccggtgcctttatcagcctgtgccatgctcctctgaactggccggccccagcatgtccaggttactggcaggagcctgtataacccagggttccagtcacaccagccaggaaggcccatgaggctggagcgcacccagtctctggctgctctgtctgcggaactaaaagcctttctcccagagcctttcctacggctgggcgaagctcttgtttgcaatttaaatgtggcctcatttatggaagaatccctgctcctccgaaaagccttgggctcaacctccctagcagcccgggcctcagccaggagaagaaatggatctaaaaggcctttctcctgctaattgtagcaattagcattagagaatggggactcgatggggggccagcgcctggcaaaacaagcttattcccagcttaggcccaggcccagctccacacactgctgcttggccagactcggcccccacccagggtctggttggcttcagggcagggagagagggcccaggcctgtgggtgctaagagcagttgtggagggtgtgcatctgagttgttaagcctggtagctgtacaggtagccctgggctatgacttgtggtcctctcagaaaagggtctgactggaacgcagagccagaccagatattcatgagtggatcacagagtgtagactgagggctatctggtgattgacagaaagtagtcttggggcaaatgactcttaaagagtaaggagccattcccctctatggctaactggatgcctttctctccccctgctccagaaaggacttcctgttccttcactgagcgtgcttgcttatgaggcttctggaaaccaggagagttcagtgggcctcattattgagcgtatgggcaggacaacctgcttgggacataggccatgctacagttgattttagccagcttgctgcatctacacagcacagtgccttcccaggcagtgaattatgtctaacaggcaggggaatgatcattgcctcatgttagggatgcagtcattcaagaaatatttgtcaaacactcagcaggtactagaccctggcccagagggagggatttgataggagcagggacctgcctaccctcccagggttagtggacaaaggggagaaagactaactaatgttgaaggaccgtttgcaccctgaggggagtgctgaggcctgggagcacagcaggtgtatagcaggaacccactggaactagcctggggtctgaaaaactcccttggggaaagtggcaggggcaggccaagggccctctggtggtagggagcctgtgagcacctgggatggaaagaagccaagcatctgaactaccagaaaggcagctgcaggattaagcaagacccacaggtctctaaactttgaaaggatgtctgtccactgagtagataattgattggaatggggcaggggatgtgagaatgccagttaggagatgcctgcagtacagagaaatggtggcctatcaggacagtggcaatagggatggagggaagcagggaacctctagaactatggatgggtgaagtaagcctggcttggtgatgggcttgaggtgatgggcaggtggtgaggaagcgggtgtatcggaaatgaccccagaacttctgacttgtgccactgaaaggatgggtgacactgaaaggacaggggccttcagtagagtgggctataaaatgatggaggctgtggagaggaggtgggggcaggtgactggaatgtgggtctggctgggttggagagacatttggggggtcagggcctcacaggtggtctggaagcccttggtgctgagggaacagcttagggaaatggtttgcatagagaaaggcactggcatttagtggccatgccagaagggaaaacctgccaaggagactgaggatagagccagaaagatggcaagaaagccaggagaactggagggatggaaaagaggacctaggggtcatggtcctggcagaggtcacattggatccagtgcttgtgattctctgattgctggcagtggatggccactggcctgcaaatggccctagtggaatgtcccctgcctgtgtggctccctgtgggctgcctctcccctggacagatggggagagaccccttccccacctggttctctgtttcacccttggaactgtggcggtaaagaggacctccccacagtacgtgcagggaacaagctaggttgactccctcagggaggcctcgtccttgctgaggtatttcataacctcaggatagagaaatccccccaactttaatgcaaagccaagcaagctgaaaaatggccttgaataggctgagatgaaaaaacaaagaggctgtcaacatcagagactcagtgggggcagggagcttcagtggactccccacagacagcagttcctgggcttctatgcccagacccagaggcctgagcccaagatgtcaggatgggtggtcactgtaagtgcagtggattgtagctcaggggtgagacatcgcctttttcttgtcagctctccttcctgattagtggctcaaacagccttccgagactcaaggggttaactgcagatcctctaactcctccacttgctaatttttaaacacagctgagctctgagcacccctcccaaggctgtgagaggccagaggccagcacagactctgcaccaggtctgcacagcctccacccctactgttgtcaggaatctgcaggcatctagaacaaaggtgcctccattatttccctcacccagcatatcctgatacctgagccaagagttcacccagagcttttgcccacttcattgatggtctggtgggcttttgttgacacatacccgtgactcccaaatgaacctttcaggttggcttaaagccgctgggacctacacatgacaaaacccagacggaaacagtggcttacactcctgtgtccctaaaggtacctgttcctaacagtgggagtgccagagcctggaagctggaagccaaggagacagggacctccctcctgctgaccccctgccaggccacatccacctaagggatttgggatcatactccatcttcaaccactgggatcaaatggaaagccctcaggaattctgagagacagcccctatacctatgtgcactgacacacatacactgacaaatacgcattctgacacatatatgaacatgcacatatgtgtgccccactccctgccaggaggtgggttctgtcccatctttgacatgttacttcttgtccttccctaggcccagtggcactttctttgtgataggtgctgagacccccccgactgggcccagtggctgttcccaggacccagtctctgctcttatcttaacccagctctagctcccaggaccccagcctttcgcagggagagagatagctcttttggtctggcacatgttccatgccaagtagtggaaacagcagctgcagggcagcctcagacttgacatcatttaatccttgtgacaatcctacagggaggaagacactacacatatgtgcagatgcagcaaggagcagctcagccacatggaatgacttgcttgaggtcaccaggcacttgacacagcagagtttagcccagtctctggagagaccagccttccacatcctgtcatgctggggagggctgcccgctttttgtccctgctcccccagttctaaccccggaagagcgattgtccctgctgtgccttcagcccagacagaagcaggctaggagaggggaggagaggcagggctggccctcggaaggctcaccttcctcaacagttctctgcttgggcaaaggtcttccaagcagccaggctctgaggctagtcactgtcatcgttgggtgaggcagcctgggagtaccagaagttggagcaggtgggaaccttccccagggatggggctggataggcaggggtgggtgctaagtggcaggccacaaccaggcacctgggagggccaagcaccacactgagaacgcagtgcttcccctcccctcctaggctgctcaggaacccatcagtctcctgtaaacaaatgagactaagtctctggcactctaggcccaggtgcaaaggacagctgcccctgcagctactcactctgccctggccctctcaggaggcttgtgacctctgcacctgctggcttgttttgttcctaaaatacccggatccttgagaatctagaagacaccactgctaacagatttccacatcattcattctgttcttcctgtgcaagcttcatgctgggacagggaccataaaacaaggtgacccaaaaccttcagcagaatgcaggtaggcagagcagaggtctctgggagtgtcattccaaggcagtgtcttcctcctcccctatgctccccatttcccaagagtgggcttcttccaccccactcaagcacctcttcccaaggctgacctaaaggcctcaagctctgcggataggggcagtcctgaggtggcattgagtcttagggttggagtgggagatatctgtgcaaaggctgataggaacgtcctccaagggctgacttcaaagcttggcctaaaccactgcatcaaagtcagcaagctgagctgtttgcacagaaaaggaggaggagcaggcccttgagccacctgtagctctccttagggtctcaggctttcacaccagggcaggccttgggccagactacccaacttccaggccggatgtgccaccggggaggaggaggtaactgcccctcaaaaccctgcagcccagggctccaggattccaacccagggacctgcaggctcccctgctctccagatcagacccctactctcagagccctaggcccagtgggtgacagcctgtgagacaggcctgtgtggggtggccctagccccacctcagcttccaacctgaccttgctgcatgacctctggcccagccctctccacctggagtgccatctctctttgtgggatgggccaggtgggctgtgtgtgggggagggcaagtatataggtgtggtataggtggaaactgccacagtaaccagcagcagctcagagccgggccacccaatttgtatgccagccccagctgggcctaggcacgtggtgtgtggaaatgaacgaagcaggcagccctatgtttaggaggcaggtccagagctcacccaggcacagcacaagatgagtgcctggcctcagtgagcgagcactggctgctatgaggctgtggtgtggaaccttgacactagggccactggcctggctgtgtgacctctacctcatcacccagagcagggcaaccagaggcagagcctcagtgtggtgttctcctgtgaaatagtgatggcacaggcaggggctggggcccagtgcctacacagaggatcagcaaaggatggcagttattgaaacctctacggggaagttccccagacacgagaggaagacccccatggaagctgtgtgtgtgacgtgcttagattttccagagtcttcattttccttgtctaaacagaggtcatggcgcctccctctcagatcaaacagccctgtatgagtggctacaacctttggtgggctcagtgcagcccctcctgcccccttgcttgggagctgtctgcagaggcctagggagctgcgtggggtctctccacctcagcctgtatccccacccccaccaggtcccctgcctgactccagcatacccaggccctagaagcaccaactccatggctgcagctgagtggagtgtgtgcctgcccaagcctagaggggtgctgacccctccctcgcacgaggagacatcaaagggaagcaggaagcagcggcctggctgacccacagcgggtgggagaagtgcagcctcacaactgctggggattttccatcccaccaggatttccgcgggacaccccaagtccagcctttgaggctcctcaggaaccagagtttggcctggagccagttggggcagaggaggggggccaggctgggtggcttaggggtgtggttaggcctgctaaggggctcctcttctcagtctccccatgatttgctggttactggcttgaaatctgggcccagacccattccaacactgaaccctgagctccctgagacctggctggcaaggacaggtcccaatttttacaggggcctgagaggaatggagaagggatctctgccccttcctttctcagtcacacctccttgacagggggtcatcagagtgggctgtggtaggtgcaccagggaagggaccatacagaggaggctggtctcaagtcctagggtgcctgggatggccctattgaaatgctgcagcagctcttgtgcaggcagggatctgtatggacagctgggtggacacaggtgcctactgacctcccagatccttcagcagagctcagccctgagtgacagcccaaggcagacctggctacctcagcctctggctcacagccctcagccagagccctgagaggcctgggatctcaaagctgcaaggtgggaggccagaggagagaagcccggagctggtagtgatgctggctgagtgaaaattgcacatttcccaacagtgtgatgctccctatccagcctgggcttttggcagacttctgtgctttgtggaggaagctggctcagattcctcccctccctgtgcagtttgtgtgtcaaggtgtacttgtcacacccaactcaggatatcttgcatcactttgtgggtccttgtcccccagagctgggactgctgagttttagccctaagctcttgctcccatcttagcaagtcagggcccagtgttgtccttgcctctgcatcaggatggtaagctgggcatgctccgcatcacggagacctgcatggacctggattgggttgcctctatcttcaggctggtcactgggcagacacaaaccagggcctctggccagaggggacagtggctctgagttacttgtgctgctctttaggggtgagcaggggctgcttgtgcatcatagtgtatcacaggggatgcacatttacaattgaaagctactggtcctgggtagaagtggggccgagtaggacttcccagccttgaacatgggtttgtcatccaactgggacccacacttgatccagcggccatgctctgtgcagcctgggcctgagggcagccacgctcatgtgaaaagtgctagtagccaagctgccattctagtcaccacagctgtccttgcaggagcacattgcccagggctgggagctgtcatttccgtgacgggagtgagactcaacactgggtgagggtgggggtatctgttgggaattatttcaaaacaattgtggaaacttggcagtggaggggctctgggcataggtatccacaatatcctagtcaggggttggggtaccctggctctgctgataagcccaagtgagcatactcctcccccagcttggaacaggtgggacgggccaggtgacactagtgtggtctgtggtctggcctcccaagccagtggcagtactggggtggcagacatttgctgtgtgctatcccaaggcctaaaggtcacacagctaggttggagcagggttttgggcaggatgagtaggcattgctgtgctctcagaaaggcgaagcaaaccccagaagcaagggggcgagacagggcaaaggcctacactttgccatcaactcaggcctactcaatgctggccctgtccttcccctgcccctgccccatcagatggtgcgagctggcggggcttagagtgagcccccctgactcttcttggtgtggagtctgaggcccagagtgtacaggcctcatccgtgtgacccagcaggaggatgggagagtgggcccagaacttggtcaggctcatccgtggagaacaagttcttccctagtctagttgtggtctgagtcctgggtgaagcaggaggcagcctgggaaacagcctcgttctagtaggaatcgcattctcaggaacgctgactgtgcagggccctttctcactgccacctgggaggatgcctgcctgctggccatttcggcggactgtcagagcaccctccctggggtcccagaccgaaggcctgaagtccacatgggacccctgaacttctggtacctgtgtgggcttgtcccctcaaccctgagtggaatggcaacagccagctgcaaccctcctagcttcctgtcatgtgctgtatggaagggccaagagctgtagtcatctgcagatcctcccactgcacctgtaggactagcgtctcctgtctggatgtgagcaacttgctggtggcctgtgagatgggagttgcactgggcttctggataagggcttctcgttcaggtgacaattctatgtgaaggagacccatggaaacacatctatcccctgcccatgtaccaggcagagatggtacctgcccatgtaccctccatgacatggctgggtccctgaaacatcagacagatcgatactctgtgtgcatgtttgtgggcaagacacagtggcacgtgtgccctggagtttggtaatgggaggactgaagtagtgcctccgtgtgtgagctgtgccagccatccccacgaagggggcattccatgcagatggggatcctctccaggcagcttcttccacacctgattagctctgaccatcagaccccccgtgccaaaagggccccttccctggaatctgtaattctcacaggctgtcccatacattttaaatccaggaaatgtgctcacccatgagacagggatggcaagaagatatgaatgaaaagcaaccagtccgtaaaattggaagccatttcactccttaccaggtacaaagataacatgctgcatggatcagggacacaaacttacctaccttatgatgtagtgaaagaatctaaaacttttgtctcagcagactccctggaggaagccaataacaggaggccttgactaggagacctcaagccttggaatgtgcccagaccagtggggagggaaggctgggaggcagtcctcccttaccccttttctcccaggcagacctaccctgggttctctccaggcccctccgcctgagcaagtgctcagttggccactagctccctgcacatccaacaagcctttctttcctgttccttcttcaaggaaggcttagcctcaaatccagggccacagacaaaggacagtcactctcctctgccagaaagtcatttatgggacatggagaaagcatcaaatatattgcttttccaacacctaacagtggaataggaggaatagaaggagaactcagccagaaagttctggagcatagtctttttgccaaaagaacacgttttcaaatgaaagaggtggtgctggggcactgaggaatcagggggatggaccccactggagcttgtctcatgctggcagcaagtcccaggcctcaaacacatacctgggccacctcaggagagagactgcagggaagaaatgagttgcaatgctccagcctaaccaactccccttttgttaatccaatcccagaaggtactgggtagggtcagttaacagacagctgcctgtctcctggcagagtctgaccaagccccagtgggcgcttctcttcctaagtcctctggtgtaccccattcttcaagggaaacggtccccttaagaatctatgtgaaagggttctgaaattgctgtaccagttaatgaattatttactctaaacaatgtcttgataaagggggaggatgaagttagctgatgttgactaaggagagacggagttgccaaggaaattcttctaaatgaaaaaaaaaaaaaagtaaaagcagtcagctggttttgtctgactatgaaacgtgtcacagagcatgcacctttggccatcttttgcatttatgatttggaagagagatgtagcagtgagtgtggggccagggaggggaatccaacaaagccattctgcaagctagtggctgggattttggggtatagagtaagagcagccagccttagaggcccatgtcatctgggctgcctcagagctaaagctaggtaaccagagggagtaaggaaaggcctgagtcccaggctaggcttttcacagttgtattgagatgggaaagtaagggatgttccttgcagcagatgcagggcccagttgtctagagcagtatttgaaatgagttggcatttcagggcagtgtttgtgatgccagtcagtaggtaggggcttctacctcttttttagaaatgtttactctgaactaagctctatgctttaacaagttatgttttaataggaaaactgtcattgatggaatcatatgtaattcctacatttttccagttacccattcctggggaaagcttagccattggacaaaccacccagagccccaggaacctgcatttgcagacagcagtggcaggcacagtggcctagtgttgagcgggggaaacctggcctctatgtgtctggttttgcaaactaaaacgccattgcccatactcaggctgacaggttctggaggtgccatggactcctgctctgtatctcacctctagttccatcacaatgcatgagctgtcagtgggagccttttaatgcagatgctaatacccattcctaatgctagcccatccccacaccctcctgagttggtgcgatatatcctgggaacaagaaaatctgaaggctcctggtcctcaggctagcaagagccttgcctgtaagaagtgggagaaggtcacctctctcaggaggcagaactaaggctgcacagcacaagggagatgtctgaatgcacagtctgggtggcagaaggactcctgtcctttcttccacacagacctgagcacctctccaggtgccaccattttctgtctgggaacatctgctatccccaagcctcagtttcctggtctacaaaactgagatggtctcttctatacaaggccccaggaggatcactgcaagtcactgcatttcatggtgcccagatttccctgcatttctagaatgtcaacagagatgagtgggctcaaggggaagagattctttatgactagagatattctggtcaactttggaccccagcttctatggacaatagcatgtggacatgagccctggggaagcagggatgactgagcctgaagaagagctctcaagccttacactctccagaccagccttgggttgcctgaaccccagcatagccttatggaacccctgccagggtcctagcacctggtttgacctgggcacaagtactcactcactcactcactcactcactcactcgtcaaacattcactgagggtccgtgacaggctccatatggattaagcactgaagataaaacactgaatagaaacagccagcctataccctcatgctccttgaatgtgatagaaggagccagccagtaaaccctttaccacaaataaacacacagttacacattaagaatgggaggggaggtatgtgattttttacagcccagtcttaagctttagaaattggctcctctgaggaagggacatttcagctaagaaccacaggataagacagtcctggcctggggaaggggagagaaggtcaggagagagcttgatatgtttaatactgaaagaatatttgatgagctgggacatctcctgcagatccacggctccctagctttgtgaccctgggccctagactcaatccctcaacccttaggagattatctataaaacaggagtgataatattcttgtgttaaaagctgctgtgaggattagtgaaatgatgtctatatttgcctggcaaacaggaagtgtaagtagtagtatcatttgaagattattcttcagcctaaacgtgtgttcattatggccggtgtgttttctccccacctagatggtagtgctgggcctcctttggagtaccttgatgtttggggagcatggatgatatgaccataacctgagaaggcagggactgtacccattctggtcctcccaggtcccagggcccccacagtgccctggtgtgtgatcagtgcccacaatactgaatagaggaacagacacatgggaagcaacggcagcctggtctttaagggtgagggagcaccttctcctgagagagggagagataggttgggggaggttgggtgggggtggggagagcgagtgagcaagcaagctagaaacttcctgaaaagggaagttactctagaaaagggtaagttccttccaggcatcatgggctggcttaacctggaccagtttgactttactaagtcccatttctcatctagggagcctgaggccattaaggttatctggtcccaaaatcccctagagctgtcacagggatccccattctttgcctttagtcaccccagccccaagagccatcctccacatggagtgagcagggagctacaaggaaaagacggtcacagttggagagagacagagaaccaggtgggctggtaggacaggaaggtatagggagaaagtgaagctctctcctggggaggcaggaatactctcctgcttccttctacccactcttcatagaacacaaacactgcaaaaatgactttttccaaaccctcttagcattcagaagtagaattgctatgtaagaattttttcataggtgcttttttggggggcatctatttaaaaaataaccacatcattagtgaaatcttccaaagtctctttttggagcccacatttcactaatgtccacatctgaggaggctttcataataaaagaacacatacctatttcacctatgatggtcagtgcaatcttgaaaacactagtaaatagtgtccatcagctttaaaaatacaaacccaaattgggtcataccaaaatgcaaggatacacacaataacctgggtgaatcttcagggaattgtgctgagtgaaaagagccgatcccaaaaaggtgatttgctatgtggttccatttatataattttcttggaatgataaagaaatgaagaataggttagtagttgtcaggggctaaggacagggtagggtgggagggaattgggggtagctataaaagggggacatgagggattcttgaagagttagaaatgtcctgtagtgagactatcaatgcaatatcctggtcagaatattgtactacagttttgcaagatgttactatcgggggagactaggtaaaggagtatgtaagatttctctgtgttgtttcttagaactgcatgagaaatgtacaattatctcaaaataaaaatttattttaaaaaatgcccaaattaaaaaaaaatcagtagtcctcctaaaaatacccagaaatgaattttagaatgtccaaaatccatacaaagatctaaaaaaatatggaaggatgttgcaatggatttgaacatgtgggtaaactgcttctatttgtggctggaaagactttttttttgaggtggggaaggcaattcttcatcagttaatctaaattgaatgaagtttcaataacaaatgccaatgggatatgaatatacacacagatagacaactttttttttttttttttttttaattaggcaagctgaggccaggtgcattggctcacgcccgtaatcccagcactttaggaggctgaggcgggcagatcacttgaggtcaggagtttgagaccagcctggccaacatggtgaaaccctgtctctaataaaaaaaaaaattagccagtcatggtggcagatgtctgtagtcccagctactagggaggctaaggcaggagaattgcttgaacccaggaggtagaggttgcagtaagccgagactgtgccactgcattcccgcctaggtgacaaagtgagactctgcctcaaaaaaaataaaaataaaaaaaaaattaggcgtgctagttctaagtttatatgaaaaaaatgcatgtcctataaaattcagaagtagcagcagtctggccccttgtgctcctctagccctcaactggcctaacaggccctagtgtgcagcagggactattttcccatcatcactgtccacagcatctggacaagaatacagagaacggctgatttaaaaaaaatctaatctgggatcctatgcatcctaaataatcttatgaggatgcacttgtattttttctgatgctgatactattcattccaactcgcctccccatcagctttgtcaggcactgtgaattgcatggtacacatgattacaatggatggaatggccatcatgaggtatagcaatacatttaagtaacactgtgtcactactataggacaggcacttttctgcatactttatattattaatttgtgtaatcctcctaacaaccctctgaggaaggtactcttatgattcccattttacaaataaagaaactgagactaagtgactcactcaaggtgtagcaggtagaaagtagtggaattaggatatgagttcagactccagaccctgttattagcccctgtctttggctatggattagtaaaggagagcacagccaagggtgggacaggcagctgtagtcctctggaccagcttcacatggatggggctgcattgttacaggtggcctaactcagacatggaaactgagtcgctgctgcccaactcatgccatgaaaccattttggcctgcacagcttataacagcactctagctctagctatgacactttatggtgttagtgggtttttttggtggttggtatggaggaggggctgggctacaagttttagattatgtttcttattgcgggtttttaaaaattcttgaattaggcctatttgctcttttgttctctattgagttagcaaattcagtttttccaagatgccctgaaagtatgatcatacatgtatacgaaatggtccttgggtccagctggcaactcctgtgcacccccgacctggattctgccttccttgaagtgagccttggaagaaacaagtgctcatgctccctgacattattagctgccacgatgaagcctcagtcccaaacaccccagcttcctgtctaactcaagagctaatcctgtgtttaaatcttaagagtgtttagatcttaggccatgccatgaattcccctggttgactgcatttgtgaaaatgagcttcccattattggctcttaagtaatggagatgagggggagtcctgctacacagataagtgcatcataaagttacataattaaaataactgagctctggcctatcaacaggcccatcagcagtccagaatagagtctagaaatggacacaaattaaatgagagtttgaaatatgataaaggtagcagttgaaattagtagagagatgatgatgtactcaaataaatagtgttggacaactggacaaatatatgggaaaccaaattggatttaattactctgtcaaaatcccgataaagcaaggatttaaatgtaaaaaatgaaataaaaaatgatagaagaaaacatggaagaatttattaaaacaatttcaggatgagaggttatttcagaatttaagataaggacctcaaaccataaaagactgacacagctgactatgtgaaattaaaaaaattctgccaccagaaaaatattatagaaaaagccaaaacacctaaggaaaatgaggataaaatattttcaatgaatatgacaaagcaagtttctacaaatcagtaagacaaggtattttacaaagtccaaagggtatgaagaaatagttcacaagaaagaaaaacaaatgattttaagcatttggaaagataaaaacctcatttccaacaaaagaaatgtaaattaaagctccagtgtaccatttctcatctatgaaatgaatgaagataaaaacctgagtatacacttggtaagggtgggggaagaaagtgcatttgtgcagtcaaagtgatgtaaatggtacagcccttatttggcagtatctatcacaacataaatgaacattttaatcctgctggaaatggggggaaagggaggatctcttaaagtaaatccactgaaaacggagaccaaaattttacaatagagatatttgattgggaagttaatttgaaaaataacagtagttaaaatattattttatctcatatgcaataacagttgttagagttacaattatgtacacgttttagaaaaaaacaaatccagaggggattttggtttgtcttttgtaaagcattatatggtaacatctgagggcatcttttatacttggcagaggatgttggcagcacttccacagagaggatcattttttgtagaagtatggcatggtttcactgcttgaccaagaggccacctgcatcaattatcatctcccctgctgtcctctgaaatgcttatctaggcatcgatcttggtttcctcttcaactgattaactaactggtctactctgcccagtctctatttgagaaatcatttgacatcattttctttaacttgatgaaatctcctattttgacaagatttacagttcctctttataagttcctctttactttgtgtgtgctttatattgtctttggttgacaagagacagccaaagaggtcagtcagcagagatacaagtagggataagatggatagggagaaacaacagtgttcaatagggagggatgtttcagggaaactaatttcataagtggtcatttcagtagtgaatatatttgaatggttaatggctgctgttttttagctgccctacatatccatcaacagaggatctgttccataaatcatggcacaatgaaactctgcagctgttaatgaaaaggagatttgctagatgtcttaatacagatccatctccagaacataccagtgtcttccttttaagtggtgcacactggggctgaacacttactaagaaatgaaagggctccccagtcaaagctgacaggtgtcattacaacatgacccctgtggtagatcccagcacaatacactggccatcactccattctcttcaaatgtcctagggttgcttcatacagcagaccatcgtacccaaagccactatgcatatgacttggttatctcctgccaggctgtagtccagttagtgctcccttggaaatactcaagaccttaatgaactatctatctgtgaatctgtgaagctacccatttcttagaggcctctttggagagctggctgttgaatacccagtatgatggtccttagccttcttagacctttcctgtaccactacctctatgccttttgccaagtccaagtgttcaccagaaatggaactgatgccagaaagactacagctaacaatctgagcagaacagtgagcatgtcctatctgggaaaagcccagcccattgggctaaatctctagctgaacacagagactatgctccttccaattatactggaagcccaaccatgagaaaacagcacttcaactacactgttcagagccatcacctgttcacacgtgtgtctgtatacatgtaaacacacattttgcaataaaaatgcttctcagatgtactgcaccataataaatcagcattgtatgtacagctcaaaaagaagtatggcatacctatggaagaagtcaaaggcaaagtgtagaaaaatacatacagtatgctaccatttgtataaaaaggagccgtatctactaagtacatgcacacacagacacacgtatatttgtttatataaaatacgtctggaaagatgcaataggaaagtgttgagtggtaacctttagggaaggaaacttgggaattagggttgggtggggagagtgttatttttcaccccttttgtactctgaattggttttaccatgtgtgtaaagactgttgtatgatttttgtagcacaacccttgaatacataaagcacgattggctccccagaaggcaggtgttggccaggcagtggatgcacggtagggcagtgtgcagccctgcatgcacgtggctggtatgccctgcgggcagcagctccccgcacacagtgctgtgagtctctggttcatgtcactctgtggagcaggggctgctccagcacaaagaggtttttgacagggaaaggcagagccagagtcagggcaggccctgggcgggctcctagagagcccaaccaccctctaataaggggtgctctccaccctatctgaggagcaattgggatctcctaggaagtgaaactgttacgtatgtcttattacagaatttccagtggagtgattctggaagaaatgtgtatggcatgttgtgactgctatgtctcatgaaatatttacgtttttatgtaacttttttccattttcagatcatcttttattttaacgcaaaatgacaatatatttttcaattaatttgcccaatatctgtgtttaaatgttttctaatgcacacacgtgttttaaactcattaaaaaaatatgacttagatcccatcccactttcatgttttatattgccaaaactctgcttttgggagaggtgagttatcttcacttctgaaacagtactgcttgggagctggtttggccctggctattctggggaaatgacacaatattgacctagaggggccctaatctttccccgctagagcactacctctaatagggtgaaggatgggagaaagaggctagtgaacccaccttcaggtctgtccactcaggacatgcccacactagcctctccaggggctctgcccttggcatccccgtcccccacctgggctctggcagagaagtcaggcgggaagaagccggctgagtgcccgccactgtaagaggaaacgaagagaaacagctccagtcagccccagaagcgaggcctggaaaaactctgcagctggagctaacacaaaggacttttcagaccctgcagccaaggtgcccagtgagcttttttttttttttttttttttttttttaaaaaacagctattagggtgacaagcctttccaaaggccagcagttggcgagagtttccaggaagctggtctggcactgggctgggattggagcaactttaacgagttaagttcagaaggaaggagtcatcaggaaaggtttaaggttcaacaaacttttcaaattattttgcaaaaagttctggctttccaattcaaaggcatgtttcgctgtgactgttttaagccagagcctatttaaaaggcaacacaactagcatgcttcagattcactcactcgaggtatttgtctaaatcctccgaatgggctttgcaagtgccatctagtgcctagtaacactggggccatcttacacatctcgacaggcagccctcctccccacgtgcctccccccagcctctgtggtcgtgtgcgcgcgggcgcgcacacacacacgcacgcatgcaccttccctaagcaggaagctgctctttgccaagagcgaatggaattcagatttccagagggtgtccttggcctccagctctacggctgcatgatgaagaaaggtcctagtgtgtgtgccgggggctgggagagaggggcctccagctctgctcacatctatctgggccccaagaaaaacccacaactggctgtgctctccccagccacacccagccttggtcacattccttcccttcctgagcccacactgggtggccccggcaaaccagcttccacacctccctccccaccggcagggagacctagcccaagcccccatggggcagccagcaagtacaaatgaggggctgcaccccaggcccaaagagccagaaagcacggagggccctccccccaccccacccccaatgctgggcatccccttgtggctgctgtcactcatggggaaagagacacactcccttgtctagcacccggtgagctgagctcccatcccttcctgtgcctgctttcaggaagtccctcttcatatccaaccttgactctcctggctgtggtgcttgtgggcctgggattgaagggccatcactgccctttgcaccagagcttcccaacataccagcaagaagggactgtaccccttcccctgtccagtctgggccttccaagccctgagattcagcaacctcaggaattaaacatttataggaaaacacctatgcagacaagggacatgagtcagggtggtcatcagcagtagcaaggtgggtaggctggtcacgtttagcttctctttagcccaagtaatagggtcttccacctgcatggccagggaggggataggctgagagcaatctttctacaggctgtcagcatcaacaagtggttgtgatgagcaggagtctgtatggcttttcaggtgttccggctcaaggaggcccaacaccaagttggaacctccaggcctggtgcctaggcagaaggtgggctaaacaaaggccaaggggagctctgctctgtcacttccctttgtttgctaatgagactgtttccaaaagctggcctggtagcctgtgggattgtttctctcaagatttcttctaggggagaaggtggctgaggctttgcagtctgcatcacccagtccccagaatctacaggggactcagcttgcctagtcacagttcggcttttggccttggctccagggcccattctgatcctcgtgcttgggtcagggatggtcagcacccctgccctgatgctgcctgctggggtctcctgctgagtaccgtgaaggcctactgtggcctgagaagccaacttcactgtcccttttggccagccctagaccctatatttgttcaagtaacacattgattcactggcttctcctttaggcaaggcctgcaggggactcagctggggttcatgattccttgccacctgtggtgggcctgcatggccagcccaaggcctcaagtgccacatactgctcccctgacagtcaggtggctagggtatgacactcaagaaaatgcccaggcagaacccagagttggggtcacttggtccagcccttctgaaggggactggttggatctgttgcggggaggagacaggccatgctggaccagcaaaaaagcatagaacttggagtctggaacctgacatctggccttggctctgccatcagctggctgtgtccactgggcaaggtcctatcatatctggtctcagtgcttccatttacccagagtccttccatcacctgacacctacagggatgctttcccaatcaaaattcaggccatgtggtttgataaggccaccttccaatgtggaagacaggctggtaatggagaggcctgggagcacagagctcctaggcactgccatggaatgtggggaccttagggaaggatatctcaattgaagctcttcagagcccctggggtggactgttctgtactctcatcccctaacccataccagcctgagctcaatcatatcagcctgtgaaggctgccccaccacactgcttctgcacccaccacaccaggcccccttgagctcccacctggagcccacacacccagctggtggggttcgtggggcagttcaaaaagaaaagcagaaaaaagcatttgagtattttggactggaaggaattcaatttaacttaacaaatcaggacatgaacctaaagaaaacactgaaaaacaagcccaactttgaaaggcccaaagagggaggattaggtgggagaagaaaggtcccctgtgggcagaagacagctgctcagtccagaccagggaccaggggaggatactgggcttgagtgcagaccgggccagggtagggagacaagcccaacatacactcgaggacttgaagtcaggggtgctagctgactttttagcccactctttctaccccagatacagagactagctgcctgaggaagcatagcggggcccacaggctggctgcctggtgctgcccacctcctctccagggcttggctccctggggcagaaggctcagacctataaccacagtggggttgcagggatttatttgggggaagaaccctgactgggtcagaatgattatgtgcatgcatgtatgtgtatgtagctccttgttctctgaaaagccttgcctaccaccctacttcccaagtaccctctattgccttgcaaagtcacccctgctctctgcctcagtttccccagcagggcaccacaggacactgctgtggcaaggtttatacttagggtgcagtgcagtctgatcttgtataaatgctcagtgccaaagacttaggagataagtcaggcagagtcaaaattaacctttgaaaaatcccttgaattggccctaaaaataatccctttctcagatctttgtgtatatcccctgctgggttgctcttctgcctgctaaagtgggagaatctctgggtgcacatccagagtaccctgggagaggcatgccaggtgttcctgtacctttttcaggatattcccagtgtcatcttcagagggagcctctgaggctgcagccacacatgggaaaagattacttatggagaagatcagaggctaaggggctggggatggtggggacatcggattttgaggtcagacctggactcctgtctacctctgtctctctaccttttatttttctttccttttctcctaacaaggccctatttctaagatggcacctcaggcctcccatgggaccaaccaggcctgacagactaactgctcagactaactgccagacttcctcctgctagccagtcactaccaaggatgtgtgcctcagatacagcccctgcccaggacacctacgttgtccctaacagggcccacatatctaaagcatgaatgcctagccaggggctctggggcaccataagaaggcatgaagctgggcctgccaatttgcatcctgggagggcaggtcagccttgtccaggcaatccaggaggcttcccagtggcccactggccagtgaggacctttgacctccttggctggtggcaccaggtttatgatgcacatagaggctgaacttgaagaattcttattgcagagggcagccacaagagccactggccagtgcccagataatatctgcagactgttccctcctgctccatgggccacagaatccctttgtcttgttactgctacactgccttcctaccaatcttcagggttcatcctggcctctgccatgcatatccaggctcccccagagattgtgtgtctgggaatgagccctggcttctgctcctatctcccagtgatactggcaagtccctatccttcttgaggcttcaatttccccttctgtgagctgggaggacaggcccactagatgctctctgagggacctaccaaggatgtgggctgtgtgtctcagccaacagcagtatctcctaaccccaacacaagaaatacacatagtaggtgtctggttaatgctcttggaatttcagcctatactaaccatctgaaagccactgagtctgaactctgctaccatatttgagattatctctccattgggcacctatgggttgcctagagacaagctaccatggtcctcttccctcgcccgtcatgtgcagggtcaaaggcaggtgagctacacagctcgccctgctcttcactctgctttaatgtgggtgcttgccttggcagatgggcccgacagtgataagaacaaatgacagatgcatactggggcacctgtgactgccatgagacacagtccactgattctgcctccaaccccctccccagagcagaatagtgagtgctaggtttccgcctgtacctccacgggaccccaacagctcctgaaccccattccgagatttgaggttgtgacttggggacctctagacttcccttccctccacctgactccagactgtcctggagcttgggactctcaggcctctaggcacatcttattaaggacagcagctgacagccatatgttgtgaccccatttgtatcccatggtaactcatgacctggcagtctcaaaagctctcaggccaaataaggaatgtccccacaggatctcccatcacaaagagacattctatgctggctaatattttcaggcatttccccgagtcaggtatgtggctggatgcctaacaccatctcctcaaggccttacactaatactgtgagatatactcccaatgtatacaagaggaaactgaggctgatagagattaggtgactgccccagtgtcctgtgggcaggatgaaatgacccaagctggccagggctccctgacagaccttgtccctggattcagcgaacatacatcaaaccattagctgacaaggaatgaatctgacaagctgttcatgaccaccacactgaaaactacagggcaaggtaaaagatatgaaagtcaacctaaataaacaagggacacatgatgccatgtttcaggagccccaaaactataaggatacccattctcccatgcccatctagaggctgctgcgcctagaggaggctttccatggcaactggcatatgtatggtgaggagaaaccctgcaaagacagcaaagccagtgatggggaaggagaagcagccagagccagcaggaccagctgtcaaaacctgttagcaaactacagtgagaaggaagcaaggtcctggccacaaagaacaacttgaatctgaccagtggcacccaatagggtccagaaacagagccacacgtagccagtgagctgattgtaaagacactgatacggcagggtagttgggagaggacgggccttcccatgccgggtgctgagctagactggatatccaagtaggggaagagtggaccttgacctcggcctcacattggacacaaaaatcaatcccagatggagtgcagatctacatgggaaaggtgagctaataaagctttagaataaaccagaatatctttatgaccttggagtagtcaaagtttcttaaataggacacaaacagccctatccagagaggaaatgtttgattaactggaccacatgaaaattaagaccttctgttcatcaaaagacaccatcaagagaggaagaaggcagcctgcagagggggaggcgatatttgcaatgtgtgtgtctgtgagagagtgtgagtgtgtgtatctctctctctgacaaatgactccagaatatctaaagatatataggaccataaataaacataaaacaggcagaagatgtaggcaatttatacagaatgatgtatctgactaaatgataacatggaaagggactcaacttcattagtcaacaggttactgcaaattaaaatcaccatttgatgctgctagacattcaccatcatggctgaaaaggaaacgacggaaaatgccaagtgttaggatgtggagcagccagaatgctgcctgtgggaatgaaaattggaatgactcctttggtagactgctgggtagtattcactaagagtaaacatatgcccacccaggaccctgcagctccacacataggcatatattccccagaaacgcaacctgatgctcaccaaaagcatgtacagaatattcttaaacagcaacctacaccagaaactgcctgctggccacaggtggtagaatggatgaatgatgtaggccatgcacacaatggagcaccagtcagcaaggagcatgagggagcactctcccttcagccccatagagaggctgccagacatcaaattgagtgagggacattggacacaaaggtgtatgagttgcatcattcccaccgcataaagttcaaatgtgggcaaagctggtccttgctgctagcagttaggcctgtggttaatctcaaggtcagtgacaggaaatgggagcctgagaggctttctgggggttctgttgcttcctccgggtgctgcacacatgggtcccagggactgaagatgcctcaagctgcgcacttgagacctgtgtactaatctgtgtgcatgcacattaccctttaactaaaagtttaacaccaccaccctataccagggtagcccaggtgagcctaattaggtggatagccctggccttcagggccgctaggcccagccccatcccactccctcacttaaggggacacggcttccagacttcctgactaggtcacctccgtgcttcagcctccagaggctctgcagttcaatctcccctttcaggtatcagcagagcacacaagagatctatatgggatgtgccccccgcccaaccccgccccgaccccctgccccaactgccagaagtgtctccatgacaatatcagtgcagttgtgaagtcctttgccctccagccacctctgtggcgtgaatgttctctctgtcacatcctccaacaccatctgcttggctgaggacctgagcagcatcatggctgggagttcacaagtggagagggctgagcctggccagagtgcactggggcagggtgatttggatggcctttcccttgcagaggaaatgagaagcctcactgctttcttctgggccatccacctagacagtgcggccctctccccatagcagcagccctaggccagccgcttcttcctcacgtgctcagacggaggaagtgaagtttggaaaggttagggggccacggggggccgccacagctgggctgatggcaggctggaagccagattgagggcatctgattcccaatcccatctctttcccactgagccattacgcctcggttttaatttaattagaagaacatttaatccccccgtgcatttcagagacgggtttgagcctggctggggctatgtggggctctgacggggatcctatgactcatgcagccctgtacagccctcccgggcgggcccccagagggcttccttggcatctcgtgcagacagaggtggtctggagctttgcagaagacaggacactggtctagaaagacaaaatggtctcatctgttcttgacaagcccctcactcatccttctggacactggttcccagaatgtcctttctgtcctttcccaccaaagtttacagggagagaaatatggtgaggagcttagacactcacagagctgcagtgcctggtaccctggggtctgtgggagtaggtcacagtggacctggatgtctccaaaatgtcccaggccaagctggtcccatcaaaagagctagccccttggtccatgaagccaaatttggggccacccttgtgacgtttgcccttatttccagacagcacagactggccctgtccttgctgacaaatgcagaattcaggagacattagtagtgatgtggatgaaagccaggccacagcggccttgctggaaaagagcaactcgaatgtcttggcgtgagattctgcagggtccaggagaaagttgaagacatggaaattctaattaacgcacacggggctgtttttgctcaaggatttgcgaagctgtcatgtcacaagaggccaggcaagcacatgcttgccagggaggtgctcacagtcacctggtgggggtctctgcagctttccctctgccttctttccaccccctctgcccagcctcgggggtcctggtcctcccccatgcccatctcaatgggccgggtgctccctgagtgtccctctggagagtgggactgagggcggtatctgttaacctcgagctggggcttgcccatctaagatgccaaaacagaagagacaggggcccttcagagaaaccacatgactgggctgggcagagccataggctgcagggcttatgggcctgtcctcttgggccgtctatctcaggtatccatgtgcaaccaatggggcagacgtgtgaattccaggccagtcctggctggcttggcagttggggatgcagtgtgagggaggatttcacaaaaatgatttcagcctcccagggttgcttggagaagctcacccaggccacacctgcacacagcccccaagttcagagccgcagatcctcaggcccctagccctgtgcctcagcactggcacaatgtgtctgcagtccttgcttcatcttaggcagggttgagtgagcagcaatcctagggcttctccatgcctggggctttgggggttctggggaggaagagaccaagagggctatacatgcccttctccctcctggcaccattcgaaaggcttagggaactggtactgagggctttgagagccaaaggaggacacagccgtacagcctaagtgtgtcctggggggtttactgagcagacgttggaaagatgaatggaaatctggtggctgcagatgggtgacaagggcattctagatggcaggttaccacacgcaaggcacagggatgcacacaggcatggcaccgtccccacccactgtcgtgccagtgacccttggtgagcagaggatagtgagtgggtcagaatcccaggaactcatcctggctcttggggtacagggctcctcttgtcatgggggtgctccccaactgcccatgcaggcctacagtctctacttcccacctttctctcagaagccctgtcatatggttctgggtgggagacacaggctcagggagtttgaggctggcagggactctcttgtgccccattcaacctaggaagacagcttctgcctgaaaggtgtgttcgaggctgagtcctggccgcccagagctggttgagggtcctgaggctgagcagtagggcccacctataggctggggtgcagcgacgccactctttatctcctgggtaccccgtgcctcagcttgtcatgactccctagcttgcatcaggcctgctcaccccccaccccacctctggctaacaggccccggaaagaggagcttcgcccagccccagggaccttcccgtaatcaaggctatagtgacctcacctctctggggccctgcgggcggggagagctcgagatggaaacaaaatgtgtctttatttatgtttttaatttgaattctggaactggcccagcatggtaatacatttaacatcagtagaatgctgaagaaaaatggaaatgttttttggtaactgcctcccacccactctgccccctgtgagaccccagcacacatccctgtccctcacacacaccagggcgtgtgcctctcttcccagttcagggtccatggggccaggctgcccacaggagcttcgctgcatccctgagcagctggagccgaatttaattatgggcatcactgggcgggctgtgcaggaggtggaggaatgcagccccaatgcgggcagaagacctgcacggcccccacacccctgccgccaggcggtttgggccctgaggaaacagggtgcccactgctgccagccttctcccccagatggagtggggcctctacccagcctgtatcccagaggagcctgggttcctaggccctgacactgtacgtgcccactctccccttcaggcctctctggagggaccgtaccctgacttctgaggatgcaggaacccagctcccctgaagcctcagccctgagtcttccctgaccagaacacaatgcctcaaggtggcccctttgcagcaacctccttgtttttccctctcccagtcccctcttcagatccctcaccccaagccccatgcctgggctccttcctgccttcccaggctggctcatatctagcagccacttttggaacagcctgctctgagagaggccttggtaagttacagggcagggacctggttgggtaatgactggagtctctgacctgcctgggcccacttatcactggaggccatgggagtgccaacctgaaaaggctgcaggatcttgcagaatggtaatgtgccagacccaaagtgggcagagagcttggggatggatgttcaggtctctcaggccctgtcatcctggagtggaacaagaaacagcccagtgtcctagatgacacagccacactggcttggggtcacccttgggcaggtgggtaacctctggctccagggagcttggcatgtgctgataccagcactggcagccctcacccccatagtggtgatttactgggcagctgcaagtttggctgtgatccacataagtgcctggtctctcaccaccttcacctgcaggggccttgcaagacccaagagttggtaaggcctggctgcccagctagatggactgtgggtgatggccctctcctcccagtaggactttttgcatgtctggatgctggtccgtgaccaagagaaccaaggtgagcgagagctccaacaggagaagcaagcagccagaaggatgagaagggacagtcccctctctgaggggacagccaagaggcaatacaggcactgccacctgtattgcacacaacatgagccactaaactaacactgatcactttggaggtccatcatatccaggacttggtacaggccttggccacagtgtaagccatcattctgccttctggtgctgacctgtacctgggcagcccatctggctaccagcctgctcacacctctgctcctgcctttttacccagccaggaggggcccagaagctcagagccctattctcagggtgtccatgactagtcacccctgctttccagtgatctgctggctcccttggagcctcttcacaccctacccaccatgaggtactgccaacctctctgtgaactgggggggcctggaaagacagtgggcaggtcctgtctgatcataattaccccttaagatagccactccttccctggaggtggcctcattctggctacccaaccctgccagttctctggttacacctgcagcccccagcaccatgggtcccgatttcctcagtgatttgcaaggccaggccttgcacctggctggctgcaaaggcaggaggcccagggcctcactacgacaaagacacacatggctcaggacaacctcctgacccccagagagtccaaagaacaaaacaccctttagaaaaatgttggtagagagaaggagagtttccacaagtgaccctcagaagggccgcgagtgtcactcacagatcttgacacaaagacatttatcaaggggaatccccaacgggttagcagccagaatgggactgtggccagaatggacttgggtgccccactgaccccgctgcacggctgtcaccgctgggcaccccagcggggagtcacatgtcgcaggggaatcacaccgtggccgggcaccggggattggcctggccatgccgtgacggcgggggaggacgggcatgcatcccaggccagctgtgcctcaggggaaggccaactggaaggcgtggaaaatcagccatttcctccacctgaaggagcccctgaggacagcagcagcaactggcagactgcacccggcatctgccccatggctttggccagggttccatggggaaatgctaaaaaacaaagtcgtctcttttttggggggcaggggagggggctgggggagagaaaaacaatctcagactctcaaagcatgaaaacaagtggaaaatgatcagtctggttttccataagtcaaaacaagaggatcatgttcccaggctcagtgggaagtgcccttgctctcctctcttgcctggtgcctccgtgttggggccaggcagacggcaagtggtgggcactaggcgagtagatagcactctggccagagagcaaggcttccccagcaccaagtctgactccttgagctccagtcccctccagcccagcccttcacgcacatgtaggcactcactgtgagatgtgggtgatgggtgtcagcagagtctccccttccaggtccaggtcctcggcgaagctgttggttctcatgaaatggggcatgctcacttccagcagtgttgggctcttccttactgaggagaaagtgtggggacagcacgttaggcctcccacccaacctgccagtgctgtggagccaggcctgtgagctcccagggccaggtgaggagtggagcttgtgcctggaagctccagccctgacaatcagttttatagttgggtgttggggtgggtgggtgtttaagatggccccaaagtgcctgacacctcagtgtctgaggagaataaaggccagtgaatcatcttcggagtggtaactgtgcctggggctgtgctcaggtgtccaagactctccccacctcaggttctgggcctcttcccatgttcacaactgacacttgggtcaagaataaaacagaggtgacaggcacaggcctggtaagggacaacagctcccaccaccatacattgtcacactcatacattgacagagtagtgggtcaggaaagatggggtgataggacctctgacccatgaggaatggcaagcctgggaggtgggggcagccacagaactccttcctcaaaacacgatgctacatcaaccagttgtacccccaatgaggcacaggagtccctccaacagctggcttcacattatgattcctgggcccacctctgcaactttgacacaggagctcaggatactgatccttatcactccccactctctgttgacactatcagtatttgctcttggcttatatttgtcttcatttaaatattttattgcaaaaggattaagtactcatctgtgagaagtggaataattcaaagattcacaatggctttcctcccccaaggtcatcagtgttaactgccaactagatccctagcccaccctctctgctcatccgagcagcagatgccaggtgggagttgcttttatgcacatgggatgtcactgtgactctgttcctgtcactctgtaacataagctcatttcatttttctctaggtatataggcatggatttaattattttagtcattacataatagtccacagtttagattggccacagctaaccattctgtatatcatggacattcaggctcttatagttttaagctgcttaattattcagactatgatgccatattcatctttattcttaaaagctgacatactggagcagggtgagagggtgtgtccttagtaattttaataaatgttgctagattgctttcccaagaagttgtagcaattcaggctcccccagctttcccacatccatgcctgaatgaagtgttgaatgaagcccgaatgaaggttgtcagcaccttttgcagggactatcaagcatggatgaaaactgaggcattgctgttatttccatctgtgttgaataccttttatgggcttggcatctgtttgggtttcctcttgcagaattgcctgttcatgtcctttgctcacttttgcttatcactttgtaggaattttctatacattacagacattaactccttgttatatgaggcatagatagcttccccagtctgttttttcacctgaattatgttgcttttatcctagaaaatgttttatgtttttaaagtgatacatcttttgctttataaaaaaggaaggttttcccacatcagcgtaatacaattctctcttaaatttattcctaatttcactatttgaatgtgttgtatgtatacatatgtatgtgtgtaaaagttttaatgcatttagtatctatgcctgataggacagatgatcaacaattagaaaatgaaaatttaaagggtactacatacaaacttactgaaaaaaaatctaaaataaaacataaaaccataaaatatcttgaagaaaacataagagaaaatctccaggaccttggatttggcagtgaattctgaaatacgaaaccaaaagtttaactcgtaagagaaaaagaatcaacaaattggactttatcaaaattaaaagcttttgctgtgcaacagacactgctaatggaatgaaaagacaaagcacagacttggaaagaatatttgcatatcacctatcaggtcaaggacttgcactcagaatatataaagaatgcttacaacttgacaataaagtgaacaatccaattttaaaaatggattataaataagcacatgaaaagatacataattaacataaatatggaaatgcaaattagaatcacaatgaaattccataaattaaaaaaaaaattcaaaacctgacaataccaaccactcttgaggatgtggaacatgtagaactctcatatgttactggtgggaatgcaaaatggcacagtgactttaggaaatagtttagcaatttcttattaagttaaacatacacataccacatgacctatcggttcctttcccacccaagtgaattgaatttttatgttcgcaaaaacctgtacataaatgtgtatagtaactctgctcataattaccaaatactggaaacaatgaagatgtccttcaacaggtgaatgcataaacaaaatgtatatattcatgcaatggaataccacccagcaataaaaagaaattaactaatgatttatgcaacaacatggatgaatctcaaatgcattttgctaagcagtgaaagaagccagatgcaaaagaatacatattataggatcccatttataggacattctagaaaaacaaaactacagggacataaaacagatcaatagctgccagtggttaggggagaagtacttgacttcaaaagactcaccccagggtatttttaggggtatggaacttctgtgaatgatactggattgtggacacatgactccagacatctgtcaaaacccacagaactgaatctcaaagagtggattttactgtatgcaaatttaaaaaattaacccggatgttggaggaccctacgatgaaaagcagactatgatgagcgtgttacaaacaaatgacatagcagtgaaaggaaaggaggaggaggagctggcatatgttgctttcaaaaacactgttttgactggacactctatggttaaagcaaaagtctgtcctaaacactctaatctagtaggtaaatttgcttcacatagggtactacgtgtacaatagggttacacaaataagtaaatgaactgtaggtaatgggagccaggtttctagctgtcagagaaaaagctataaataagttgtgggggagggggcaaggatgaactctggtcagaaatgtcagtatgaactcatggttagctttatatagatacagatatgtaaagatgtatgtgtactcaggttacatacatacatatatttcctagctctgtccactgagaggagactgaagcaatgataccctagtagccacgagcataccccgtgcctagatccaggttttctattcattctccagggagccagggctctctggatgaatggatgattctagggctagggtagggaaaataaaagatgagcctgaagtattgtcaagtgctagaaaagaaatgcttaaaaataaatgaaaaggatggcggggggcacatcaaaaggacacatgaacccaccagtggccacagcttgaacaatttgagcaacaaaataaataatattggactataactcaaaaaataaatactcccaaatccacactgataaaattaaataaacaattggaggagagggacaaatcttccttataaaggaattccaaataaaaaatgtagaaggaatgaggaaaatagaagtacatcacggtaatatttgctgcaggaaaacgatccatgaatgaatgctgaaattagttagtgaaactcagaaacttcacagtttcttccttgaaatgtattttaattgctgtggtagttttaacatatttgcagattttttttgatactctcctgcaggaggtagagttgaacccctcccttccccaccttgagtgtgggctatacttagtgactcgcttctaaagactaagctatggaaagggaaaaacagctattcacttacagtggaggagcctggccgacaccactttaaacgagtggctcaaggttaatattaccagtgataaaccatgttgatgtcatgttccacaatgaggaaagcatctcacctcactggcctccttcccctaaacctataaccctggtctagtcctgagaaaacaccagacaaatccaaactgagggacaatgacacctgactggtattcttcaaaagtgtcaagttaatgaagaacaagactgagaagcccgtcaccgatcagagatgacaataaatgtaatgatcgatcctagatgggatcttggaacagaaaaaggacattagtagttaaactggggaaatccaaataaatttataactctagcttaatagtgtaccaatgttaattttttagttttggtcaatgtaccatggttatataagatgctaacattaggggaagctggtgaaagggatgtgggtactcggtactatttttgtttctcttctgtaaataaaaaatgtgaggtaacaagagaaaacagaacctgtatacaatagcacaaaagaatattaattatctaactaagtatatgcaagaactctggagaaaattgtaaaactttagtaagagacaatgaagaagatataaatggagaaatatgccttcattccaatgactagaagactcaatactgaaaagattatctcaaaatctgaataaatctctccaaatcttaataaaaatctcaaggcttctgtgtgagaactttggcaagctgattctaactgcgacttggaagtgcaaaaagccaagaattggcaatattcttgaagaagaacaaggtgggagaacttgctgtaccaaacatcagtacttcttccaaggcagtggtcattagggcaatgtggtattgacacagggagagacaaataggccaatgggacaggattgagcattgggaaacagcccacacaaatatggaagcttgctgtgtatcagaggtggcctgcacatcctgggaagagcatggacttttcaatcaaatgttcaggagcagttggatacccacactggaaaaacattaagttggacccttaattacctcacatcatataccaaaaattcattcttgtcattctaggggattgaagacctaactatgaaaagcataactataaaggtcacatgactgaatatagaagaatatcttaatgacatcagcattaggatggttttttttaaaagaagcaataaccatgagagagaagactgagtaatttgacattagagttaagacccaatcatcaaaatacaccttaaagagtgaaaagacagtgcccacaaaatgcaaaggactcctacaaatcaataggaaaaatataaatgacttaatagaaaatgggcaatagacaaagtagcacatcacaaaagaggaatccaaaaggctgatgagcatgtggaaaggtgttgcgcctgactagcaatcagggaaatgtaaataaactcaggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagatttggggctgagattcaagtaccctaggttatataatgcagttgtcaagtgacagagctaaaacttcatccaggattcaattttttttaaaggaaggaagaaagaaaaaacatattttgatgtttgcatcacttgtatgtagaaggaacgatggagcacaggctagaacgtagagttgctttccaaacacccatgatgacaagtgcccatctccaaagcctgagggccaagggtgagccacctgacccctgaggaaggttctgtcctggtgttttaggaaattaaaatgtgcacatcagttggctgcccagagtgggtgggacctgcacctgccagagaggaatgtgtgctttttggtttaatcctgggaacggcatatggggcccctataacaaggggcagagaaggcctccacagatttgtttttccaattcaagaggagaggttattgtctgctggcttgtgtgttggagactgtggggcgtgctttctccaccacagggaggcagtgaccagagctgccacctcttccctgttttcacctgtggtcgtagccaggtcaggcatctaggagagcatggaggggagctgggggtgggtgggtggggattcagctctttccagacacactggtgctgcctctttcaggccagggcttgagggcaagtgctgtgccctaacaggtcttgcttgtcacccccacctctgaagtgggtatttcacagcctgaactcacagctgcagagaaggttgagcccatggtgtacttgaaagggcagttcatctggatatccaggctctgcaggaggtaccggagcaatgccaggtgccctttgctgaactgcctagagtggctggccctggggacaaagagcacagcatcctggtgacaatgaagtcacactttcctaagacagtcctggtttttgatgctttaattctttggctgcctttgctttgtcaaggccaggatctgggcctaaattttcagggcagaacaaaacaattttgttttctaggaaagtgggaggtctgggatggcaaaggcagcctcgggcgtggcgactaccccagctggggacgctggctgccaagtctcaccctctcaagagaacaggaatcaaactcagcacagcatcctcctttctagtcagtggtcctgctcgatagggggatttgaattttatttttttaaaaatacaggcacagaaaaaagactagaaggaaacagatccaaatgttaactttgtctttgggtgattttcatttccttccttattgtgtctgtgttttctattttgcatgatacttttccaagtcaagaaacaataatttgtggaagtctcctgtatctgtgccttgctctctggcccacgaccttgcacatcttatcctagagttgccagaatatgtccctccacctggcctggagctgcccatgaggctacatagagctctcctatcatgaaagtctttgaggctttctgttcccaagaaattctggtctcacttcctctgccttctcatcgagccccagacccctccctgcccagattaggtcagcattcaagccccaagtccagcctatgacaaagctcaaagctccagcccatctctgctgccctctgccctcaagagactctcgccagtgtctgggcccttcctagtaacttcacccaaccactcaccccctgcccttcccctcctgattgattaaaatccggcctaatctcccaggtgtaacccaagccctcttccacaagctttccagggctccggagattgccccctcccctgtacggctgcagggcttatgtgtgcctggcgctcagcacgggaaccttgccttctgcctcacccatgtctccccagggtttggcacaggcgagttccctgagccagcctacttcacaaggatgaacagaagctctccctatcctttgcaagtagaagccccctccctggccccctcaagaaatctccccctctcagtggattcaccaaagccctgcggatcctgcactgtgaaggagaagccctccccaggggcatccggacagctgcagccaggccctgcgtgacattgctgagccgcagccccacagcctgtgccagctgcccatgcccggctcatagaccctgagccagagtggccccgccaccacctgtgtctccactcagaggcgagaagtaagggacatggatggaaagtgtaaaagccattcccacaacagctgccaggaacaaggcgaggaatggagtgaaaatgtatattcacagctggcacccagttccgcttaggaaaataccttgcttgagtggacacctgttgtttttgcctgccagcagccaggcctggcttctgggaacagcttctcaaatcttccttagggggctcttcctttcccactcctagtgtgcagtgtttaggtaccctctggccatccccaaaggggtccctgtggaccttgcctcagccatcggaggtacagctgcaggtccaaggatggcttgtaccccagctgaggccaataagaacctggccttagattctggcaggaatcctggaagagatgacctcgttctgctgggcttcctgagctgttgaatgcaagctggtggccattttgccccttttagaaagtagctgcctaaggatacagccatcccatggggccaatggatagagagcaagggaaagggagaacaaaagagggaacgggaagggagaaggggagtgcaagaggggagagtgagagcaagtgagcaagatcatctcagctctggggtccagctgtgtctgaaacagctgggtccagctgtgtgagccaaaaaatgtcccttttgtgcttaagcttgtttgagttggggttccatcatttgttaccaagagagtcttcaggaatgtgcatgacaaagttgggggtgaggtgtgagcctacggacatgggcctgggggcagtcaaggttacaaaatagctaaactggtctgcactgcccccactagttttcagggcagagggcagggagaaggcttgtgggaaagaagctggcctgaggccaaggccctggccctagccctgcaacagcacagggaactcttggaaagggatttcctaaggtgggacattggctttctactgctgtgatgcaagtcctcatctccccaaaccttcagtgagcctctctccacaccctgctgtatgaggatgtttgatgcaaattatggaacatgttggatctcacattggatcaaaggtgtgcagaatagatttgcctcaagcatgacagtgatgtgacacagtcaaagatgacttccggaatcctgagaagtcccagggaggatgctgggctttccaaaacctaagtttaggatactgaggaccacaccccacaccccaaacacttctccttagaataagtatagcaagcctcagcatacacaaatctcagagtgaacggaaatgtctctgcaggcccaagggtggggtctgagtagcgggggcgctgaggaagacaggcagtgacagagccaggacagggtcaaccctgagcgtgagtgagcccaggaaacggaaagagagcaacacagccacccacacaactaaaatcgacccacccgggtctccatgctgcaggaagtcactgtctaggtctcccaagacacattttcaggggaaggttccaggcagcaagagcagccctaggaaactttaatatacaatggaatctgggttaagcactatcttctccaagagttgagctcacaggacattccccagaaacctctggagaggtggggaggaaagtttctggaggtctttggatggagaaaacaaaaaagtggccttgattttcaagacaaaattacacaggaagaaaaaaatgtttttaatctaattaagagcgatcttttcaccttcatcacaacatcgcggaaatgtgccagttcttaacttcacacaataatcaaagcaattagtgagggagaagccttggaaaccggtgcagatgttctcagaatgtttaatggggaaatgagttgcaggcctcattctcagcatccggctccaggccctggctaccaaatccagacatctgctggggccccacccccaggccccgagggcgcgggcttgagaaacacaggtcccttcccaggccacctcccagccaggccagaactggggccgagaggctccccatagcttctcaaattggagcctggacacagtcagagccaccccagaactggggggaggctcaacatcaaaattatgttaacaactgatgtcaaaagtaatcaactcagcttggctcccccactgctgctggctgcaggagggctgtgagtaggaggagagcaagcggccccagagggaccctcggctatgaccccctcagcctgaacactacttcaagaaaagatgtggtggcatctgtctggtatggtcctgtgggctccattccaatgctaatggactcttaaggggcccaggaatcaaaatggtcaacacttgaggaatttccagtaatcagagaaaacgtatagaaatgaggatgatgcttacttaggaaatggcctattacaggaaacagagggccacgtggctaatgtcagtgagctgtgggagagacagagaccccaggtggggcaggcagatcagcaaatcttggaggacctgctatgtggcaggcactggagacatggaggtaaagaacacaatatccatgttctcagggacacactcatatgcccttagcattcacgttcttcacactgacagcttcttaatgcaagcccaccagatactttcataagcactacctctgacttcaggcacttgctgagctgcacacagggcaggccaaaaggaatggaaagtgagccaccaccggggcagcactcactagtgaaagataaataccccagctctctcagccgcttgtagaactctgaggagtgttctgtgcagcttcccagctgcccaccatgaagctctttctcaataagtgaccagcacagcttaattcctgaattaagctgtgtgtgctgtgagactgacacaagacagggtgacaggaagctgtcggaacatttgagtagggaagcagcaagatccactgtacatttaaagaactcccttgagctgttatgtgaagaatggagtacaggaagcaagagtggaaatcaagagaccagtaatgaggtatggacaacaatgtaggcagagaaatggtggtggttttaaccagggagatagctggagagactaggtgtgggcaaatccagagagttgataagacatactgatagattagaaaggggtactaagaaaaaaggataatttaaaaaagactttcagccaggcttggagaaaaatagcatgctgctcctcatcccctctgactataaatcatctcactcatcctcccctaaaagcataaaatcagtaagtgcaaataaaaccacatgacccatgctgttagcagtattaggagaaagaataccttcaaattgcctgtgggtagcaaagtgagccaaattccaatagcattctagtcccctgcccagcactgcaaaactgcatacagaatcagagaagaggcttaaaatgctttgtcaaaaagtttgaaggtagttagcaacatcagcaaaaatagaggagtaagtacctctaaggagccttcttgccttcacagacatcctaagcaccaagcagcctaagccactgatgaacttgcagataccactgatgtggattatagtctaattaattgtagagacaccacacttctgcactgaaccagaaccaaagccaaagcaccctacccaaatgatactacagacgcgtgtacaggaaaagtccttactaaggctactccataaaattggaagtctctgttattccagatatgcagatatcaacttggggacacaaaaaacttggggggaaaaaaacaagaaaacatgacttgccaaaagaacacaataattctccaataatagactccaaagtaaaggaaatcttaaggaaacccaatgagatacaagagaacacaaatagacaatacaaacatatcaggaaaacaattcattatctaaatgggaaatccagcagagttagatatgaaaaagaaccaaacaaaaatcctggaggtgataaattaaatgaatgaaataaaaaatacaattgaaagcttcaaaagccggctaagtcaagcagaagaaataatttctaaatttgaagacaggtgttttgcaataaaccagacagatttaaaaaataacaataaaaaagaatgaagaatgcctgcgtgacatatgagacactattaagctaacaatatttcacattttgggagttccagaagaagtgttgggataaggaccagaaaatctatttaagaagataatacctgaaaactgccaaagtttgggagagaaagagactaacagataaaggaagctcacaaatccctaaatagattcaaccctaaaagggcctctctgaggcacattttcatcaaactgtcaaaaatcaaagagagaatttaaaaaacaagagagaagcatgaagtcacatataagggaatcaacagcagattaacagatttttcagcagaaaccttctaggccaggaaagaattgaatgccatattaaaagtgctgcaaggtggggaaaagctcacaaaattgctagccacaaatactatacccagcaaagctatccttcagaaatgaagcagaatgagggaagaaattttgcctccctcagacaagcaaaaactgagggaattcattactactaaatcagccccacaagaaatgcttaagggagtactacatctggaagtaggaggatgatatctaccatcatgaaactacaaaagcataaaacactagtagagcagatacacaaatgagaaaggaaaaggaataaaagattatcactacagaaaaccaaaaaattgcaaagaaaaacaatgagaggaaacaaaagtatacaaatcagtcagaaaacaataaaatgacaggagtaagtcctcacctattgataacaatcttgaatgtaggtaatttaaatttcccaaatgaaagatagatactggctaaatgaattaaaaaaataaaacccaattacatgctgcctataagaaactgacttcacctgtaaagacacccatagactgtaagggaatggatagaaaaagatattccacacaaacagacaccaaaagcatgcaggagtagacagacaaaaaatactgagtcaaaaaaaaaaaaaaaaaaaaaaagaaaaagaaaaaagagacaaaggaggtcattatataattataaatggatcaattcagcaagaagatataacaattatatatgcaaccaacaacactggagtacccaggtatattaaacaaatattattagtgctaaagagatagaccccaatacaataatagttagggatggcaacatttcatactcagcattggacaattcatttggatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcagatctaaatgaaatagagataaaaggtaaaaaagacaaaagatcaatgaaatgaggcctcccccccaccccccgagacacggtctcactctgtcacccaggctagagcgcagtggtgtgatcttggctcactgtaacctctgcttcctgggctcaagcaatcctcctgcctcagcttctgagtagatgtgcagcaccacacctcgctaatttttttttttttttttggtagagatgggggtttgccatgttgctcaggctggtctcaaactcctggactcaagcgatcggcctgccttggccttccaaagtactgggtttacaggtgtgagccaacaaacccagccaaaaaactgattttttgaaaagagaaaatcaataaaccattagctagactaaccaagaagacccaataaataaaatcagaaatgaaaaaggagacttacaatggacaccacagaaatacaaaagattattagagaccattatgaacaactatatgtcaacaattagaaaacctagaggaaagagataaattcctggacatatataacctcccaagattgaaccaggaagaaaaaaaatctgaacagagcaataacaaggaatgagattgtatcagtaataaagtctcccagtaaagaaaacctcaggattgcacgggttttctactgaattctaccaaacctttaaagaactaacatgaattcttctcagacaattccaaaagactgaagagaaaggaattctccctaactcattctgtgaggcaagcagtatcttgataccaaaaccagataaggacacaataacagcaaaaaagaaaactacaggccaatctccctgatgaacatagatgcagaatcctcagaaacaaaacacacacacagacacacaaactagcaatctgaatccaatcgcacatcaaaaagataatacaccataatcaagtgggatttatcccagggattcaaggatggttcaacatatacaaatcaataaatgtgatacatcacattaacagaaggaaggacaaaaaaatacatgatcatctcaatagatgcagaaaaagcatctgataaaattcaaaatctcttcatgataaaaaaaaaagctcatcacataatgtctagaaggaacataactcaatgaaggtcatatatgacaaacccacagccacctggggaaaagctaaacaccttctctcttagaactagaacaagacaaggatgcccactttcactattcttattcagcagagtaagaaaagtcctcaccagaacaattaggcaagtaaaagaaaaagggtatccaaattggaaaagagaatgtcatattgtcctttgcagatggcataatcttatacatagaaaaacctaaagattccaccaaaatcttttagaactggtaaaggaattcaataaagttgcaggataaaaaaatcaacaaacaaaaattagtaggtgtggacatgatggctcatgcttgtaatttcagcactttgaaaggatgaggcgggtggattgcttgagcccaggagtttgagactgtcctgggcaacatggcaaaacctcatcagtacaaaaatgagctgggcgtggtggcctgcacctgaagttcagctactcaggaggctgagatgggaggatcacttgaacctcggaggtgaaggttgcagtgagcagaaattgcaccattgcaccccagcctgggcaacagagtgagaccctgtctgcactcccctgcctcccccaaaaaatcagtagcatttctgtgaaacagcaaattagccaaaagagaaatgaagaaagcaatcccatttgcaatagctacaaaaaaaagcaaagcttaaccaaggaggtgaaagatttccacaatgaaaactataaaatactgataacagtaattgaagaggctacaaaattttttgagacatcccatgctcatggattgaaagaaaaatgttaaaatgatcatatttacctatagcaatatacagatgctatgaaatccctatccagatatcagcaggggcttcaagatggctgactagaggcatctggcactcacctcctccacaaaatatagcaagtaggtaaccacagtttatatagatcgcctctgagagaatgctggaattcaactgagaagtaataagaaaaacccaatgcaagggataagaggggagtcaggcagtctgcttctatgggactggctgggatcatgaagagactcctcgatgtgcagaaaggtaagtaagtgagcccctagtggtccacattcccacagcagactcctgaaatcctagtcagagaaccccctgacccatagatgccttgagactaacaagaggctacctacagactgtgaaatggcaatgaacagctcccagagagggagatcaccctgaatcctcaggcaattcacacatcccctgaatcctcaggcaacttcaggaaagtcccattttgatagcccaacccccaccagactgcatctgctgtgggccccacatccctctatctcatccctggagccccatggacatcccttacacaaagctggttgccactcctgactgctccctccaggccaaagcatgagccattggcaatactctgctacctccgaagcaaggctgccatgaggaaaggtgaccctgcccatagtcaccacctggggccgaagcatgcattgcccaactgcctgtttatagctgctgccactgaaagcaatcccactcaacttccccaggagtagggctgcaatagagttgctgctgccccaacatgagcattcagcagggtatacagggatcttcctgtgcctgcctaccacagtcagtacattcttgcattactggagggcctcaggacaggcccacctggcctggtcccaccctcttttctcccagtgccagcgcataccatctctgggcctagggatcaccctgccctatccagtattgttggcacctgagcactcctgggggcttgaggactgccctacccaactgaccattaccaccacaactggcattcacttgaatttgccacctgtgggccttgggacaagctcatccagcttatcccagccatcccaataccagcatggacaccttgggaggcagaagattgttctgccactgctactgccattgcccaagccatatctgctgctcagagctcaaggacctacccaccctgtggcccagctctgtcatcattggcacctgagcaagttgcctggaggcccaaaattggtttccctggacttgctaacactggtaccagcatacactaccattgggcccaaggataagcattcggggccagccactgctgccactggggcctgaggactggcccagctggtgtccctatccccagccagactttaccacagcctccaccaacaactgcatcctaaactacagaggaactcccagacactactggtgctgtttacagctgaaaaaaattccatggagatcacactactgcaggcacccagaatcaaaaccaaagtgccctgcccaaagaacaccatagatatatcttcaggaacaagactctcttaggaaagacagatcaaaaaattggaagaaactactgttacaccagatgtgcagataccagtgtaagcacacaagaaacatgaaaaggcaaaacatgacaactcctaaggaatgcaataattctccaacagattccagtgaaaaagaaattgatgaaaccttgaaaaattcaatataatattaaagaagatctgatagactatacaaagaaatcagaaaaaacaattcggggtatgaatgagaaatttgcccaagagatagatataaaaagaaccaaacagatattctggaattgaataatagattgaatgaaataaaaaacatatttgaaagcttcaataacagaccacaacaagcagaagaaagaatttcacaccttgaagataagtcttttgaaatgactcagacaaaaatatagaaaaaatagaaaagaatgaacaaaggctatgtgactataggatgccataaggtgacaccttcagtgtcccagaaggtgaagagcaaaccaaaagattataaaacctatttaatgaaataatacctgaacacttcccaatctcccaagagatttagatccaaatataggaatctcagaaccctaaatagatacaattcagaaaggtcttttccacagcacattatagcaaattgcccatcccaagacaaagagagaatcataaaaccagcgataaaagaggttgtagacacttacaagggaacaacctgcagactaacagatttttcagcagaaactttacaggccaggaggatgggattatatacgcagagtgctgaaagaaaaaacaaaaccaaaaacctgccagccaggaatactgtacttagcaaagttatattcgtcagaaatgaaggagaaataaagtatttcccttaaaagtaaaagctcagggaattaattgccactacactggcactacaaaaaatgcttaagggagtcttacaggaagaagtgaaaggacaacttcatgaaagcacacaaaataatcagaaatcaattaatgacaggaataagccctcacatatcaacaataaccttgcatataaatagattaaactttctacttaaaagacagactggctgaatggacttaaaaacatgacccatctaaatgctatctacaagaaacgcatctcacctgtaaagacacatagttgaaagaaaggaatgggaaaagatattacatgcaaaaggaaacaaaaaccaaacaggagtagctatactttcatcagataaaacaaaggttaagctaaaaacactaaaaagagacgaagtcattatatagtgacagagggatcaattgaccaagaggatataacaattctaaacatatatgcacccaacaccaaagcacccagatatataaggcaaacatcaaatctgaagggaaaggtagacttcaacacaataatcttgggaacttcaattctccatttccagtattagacagatcatctagacaaaaaattaacaaagaaacattggatttaaactgcactttataccaaatggacctaacagacatttacagaccagttcataaaacagctgcagaatatacactcttctcatcagtacatggaacactctccaggatacattatatgttaggacactaagtatgattttaaatatatatatattttaaattggattcatatcacatatcttctcagaccacaatagcataaaactataaataaataagaggagcattcaaaactgtataaataaatggaaattaacatgttcctgaatgaccaatgggtcaaagaagaaattaaggcagaaataaaaaatttactgaaacaagtgaaaatagaagcacaacattctgaaacttaagggatactgcaaaagcaatgctaagaggaaagtttattgtaataaatgcctccattaaaaaaggtagaaaagatcttaaataatctaatgatacacctgaaggaaccagaaaagcaagaacaaaccatactaaacataaaattagtagaaggaaagaaataacgaagatcagagcagaactaaacaagaaactaaataaatataaaggatcaatgaaatgcaaaatcggtttttgaaaagaaacaaaataaccagtggctaaactatccaagaagaaaagagagaagacctacatgaataaaatcaaaaatgaaaaaggggatattacaactcataccatgaaatacaaaaatcaaaactcttcagtctgatcaataaattgattacagttacaggatttaaaaatcaggcttatttctatataccaataaagaaccagctgagaaagaaatcaagaaggcattatcttttacaaccactacaaaaaatctaggaatgagtttaaccaaagaggtgagaaacctctaacaaggaaaactacaaaagtctgatgaaagaaattgaaaagaacacacaaaaaacatcccattctcatggattgggagaattaacaaaattaaaatgaccatactacccaaagcaatctacagattcaatgcagtctctctcaaaataccaatgccatttttcatggaaatagaaaaaatcctaaaattcagatggaaccaaaaaagagctggaatagccacagcaattctgagcaaaaataacaaagttggatgcatcacactgcctgatttaaaaatataaggctatagcattaaaagcagcatggtattggaataaaaactgatagaccaatggaacagagtagaacctggaagtaaatccatgtatttacagccaactgatttttgacaaagatgccaagaacatacactgggaaaagagcaccctcttcacttaatggagctgggaaaataagatatccatgtgaaaaatgaaaccgtttctatctcttgctatactaaaatcaactcaagatgggttaaagacttaaacatgaggcatgaaactataacatcactattaatgaaggagacattggggaaacactttaggacattggtctagggaaagattttatggataagacctcaaaaacacagacaaaaacaaaaatagacaaatgggactatattaaatgataaagcttgtacacaacaagggaaacaatcaccagagtgaagagacagcctgttgaatgggagaaaatatttgcaaactactcatctgacaaggtactaataccagaatatactaggaactccaataactcaatagtaaacaacaaattaattccaataaaaagtgagcaaaagacatggatagatatttctcaaaagaaaacatacaagtagccaacaggtatatttaaaaaaaaaagcccaacatcagtaattataagggaaatgcaagccaaaaccatagtgagaatggctattttaaaaagacaaaaattaaccaatgctggagaggatgtggagggaactcttatacactgttggtgggaatgtaaattaatactatagaaaacagtttgatttctgaaaaacctaaaaagagaaatatgacataatccagcaatctcactactggatatttatctaaaggaaaagatatcagtatactaaaaatgtacctgcatccccgtgtttattgcagcactattcacaacagcaaagatatggactcaggaacctaagtgtacatcagtggataaatggaaaaagaaaatgaggtaaatatatacaatggaatactaattgaccaaagaagaatgaaatcatgtcctttgcagcaacatgaatggagctggaggtcattattttaagccaggcacagaaagataattatcttatgttattatcatatgtgggagctataaaagttgatctcatggaggtagagagtagaaggatagataccaaaggctgtgaaaggtatgtctggagggtgaagagaggttggttagtgggtaaaaatacacagctagttagaataaataatttataatgtttgataagagttggttgactatatttaacaatataatgtatatttcaaaataaaaaagaggacttgaaatgttcctaactatagagatgataaattgagggtgatggataccctgacttgatcattacacattcgatgcatgtaacaatagcacatgtaccccataagtattatgtatcggtcaaaaaaaaaaaaaaaaggaaatcccagtgctttggggggccaaggcagaaggatcgcttgagcccaggaattcaagaccagcctgggcaacaatgcacgaccctgtctctacaaaaaattaagaagttatccaggcatggtggtgcatgcctgtagtcccagctacttgaggggtcaaggatggagaatgacttgagcctgggagttaaagattgcagtaagtggggtggttccaagatggccgaataggaggagctccagtctatagctcccagcgtgagtgacgcagaagatgggtgatttctgcatttccaactgaggtagtgggttcatctcactggggctcgtcaagacagtgggtacaggacagtgggtgcagcccactgagtgtgagacgaagtagggcgaggcatcgcctcacctgggaagcacaaggggtcagggaattccctttcctagccaacggaaggggtgacagacggcacctggaaaactggatcactcccaccctaatactgtgcttttccaatggtcttagcaaacggcacaccaggagattatatcccgcgcctggctcggagggtcccacgcccatggagcctcgctcattgctagcacagcagtctgagatcgaactgcaaggcggcagcgaggctgggggagcctgccattgctgaggcttgagtaggtaaacaaagtggccaggaagctcgaactgggtggagtccaccacagctcaaggaggcctgcctgcctctgtagactccacctctggggacagagcatagccgaacaaaaggcagcagaaacctctgcagacttaaatgtccctgtctcacagctttgaaaagagtagtggttctcccagcacggagtttgagatctaagaatggatagactgcctcctcaagtgggtccctgacccccgagtagcctaactgggaggcactccccagtaggggcagactgacacctcacacggctgggtactcctctgagacgaagcttccagaggaacaatcaggcagcaacatttggtgttcagcagtattcgctgttctgcagcctctgctgctgatacccaggcaaacagggtctggagtggacctccagcaaactccaacagacctgcagctgagggtcctgactgttagaaggaaaactaacaaacagaaaggacatccacaccaaaactccatctatacgtcaccatcatcaaagaccaaaggtagataaaaccacaaagatggggaaaaaacagcagaaaagcagaaaattctaaaactcagagcacctctccccatccaaaggaacgcagccactcgccagcaatggaacaaagctggacggagaatgactttgacaagttgagagaggaaggcttcagacaatcaaacttctccgagctaaaggaggaagttcgaacccaaagcaaagaagctaaaaaccttgaaaaaagattagacgaatggctaactagaataaccagtgtagagaagtccttaaatgacatgatggagcagaaaaccatggcacaagaactacgtgacaaatgcacaagcttcagtagccgatttgatcaactggaagaaaggatatcggtgattgaagatcaaatgaatgaaatgaagtgagaagagaagttcagagaaaaaagagtaaaaacaaacgaacaaagcctccaagaaatatgggactatgtgaaaagaccaaatctacatctgactggtgtacatgaaaatgacagggagaatggaaccaagttggaaaacactcttcaggatattatccaggagaacttccccaacctagcaaggcaggatattatccaggagaacttccccaacctagcaaggcaggccaacattcaaattcaggaaatacagagaatgccacaaagatactcctcaagaagagcaactccaagacacataattgtcagattcaccaaagttgaaatgaaggaaaaaatgttaagggcagccagagagaaaggttgggttacccacaaagggaaacccatcagactaacggcggatctctcagcagaaactctacaagccagaagagagtgggggccaatattcaacattcttaaagaaaagaattttcaacccagaatttcatatccagccaaactaagcttcataagtgaaggagaaataaaatcctttatagacaagcaaatgctgagagatgttataaccaccaggcctgccctacaagagctcctgaaggaagcactaaacatggaaaggaacaattggtaccagccactgcaaaaacatgacaaattgtaaagaccatagatgctaggaagaaactgcatcaactaacgagcaaaataaccagctaacatcataatggatcaaattcacacataacaatattaaccttaaatgtaaataggctaaaggctccaattaaaagacacagactggcaaattggataaagagtcaagacccatcagtgtgctgtattcaggagacccatctcacgtgcagagacacacataggctcaaaataaagggatggaggaagatctaccaagcaaatggaaaataaaaaaaggcaggggttgcaatcctagtctctgataaaacagactttaaaccaataaagatcaaaagagacaaggtcattacataatggtaaagggatcaattcaacaagaagagctaactatcttaaatatatatgcacccaatacaggagcacccagattcataaagcaagtccttagagatctacaaagagacagactcccacacaataataatgggagactttaacaccccactgttaacattagacaaatcaacaagaccggaagttaacaaggatatccaggaattgaactcagctctgcaccaagtggacctaatagacatctacagaacattccaacccaaatcaacagaatatacattcttctcagcatcacatcgcacttattccaaaattgaccacataattggaagtaaagcactcctcagcaaatgtaaaagaacagaaactataacaaactgtctctcagaccacagtgcaatcaaactagaactcaggattaagaaactcactcaaaaccgctcaacgacatggaaactgaaccacctgctcctgaatgactactgggtacataacgaaatgaaggcagagaaataaagatgttctttgaaaccaatgagaacaaagacacaacataccagaatctctgggacacatttaaagcagtgtgtagagggaaatttatagcactaaatgcccacaagagaaagcaggaaaaatctaaaattgatgccctaacatcacaattaaaagaactagagaagcaagagcaaacacattcaaaagctagcagaaggcaagaaataactaagatcagagaagaattgaaggagatagagacacaaaaaacccttcaaaaaatcaatgaatccaggaggtggtttttttgaaaagatcaacaaaattgataggcctctagcaagactaataaagaagagagaagaatcaaatagatgcaataaaaaatgataaaggggatatcaccaccgatcccacagaaatacaaactaccatcagagaatactataaacacctctatgcaaataaactagaaaatctagaagaaatggataaattcctggagacatacacccttccaagactaaaccaggaagaagttgaatccctgaaaagaccaataacaggctctgaaatttaggcaataattaatagtctaccaaccaaaaaaagtccaggaccagacggattcacagccgaattctaccagaggtacaaggaggagctggtactatgccttctgaaactattccaaacaatagaaaaagagggaatcctccctaactcattttatgaggccagcatcatcctgataccaaagcctggcagagacacaacaaaaaaagagaattttagaccaatatccctgatgaacattgatgcaaaaatcctcaataaaatactggcaaaccgaatccagcagcacatcaaaaagcttatccaccatgatcaagtgggcttcatccctgggatgcaaggctggttcaacatatgcaaatcaataaacattatccagcatataaacagaaccaaagacaaaaaccacatgattatctcaatagatgcagaaaaggcctttgacaaaattcaacagcccttcatgctaaaaactctcaataaattaggtattgatgggatgtatctcaaaataataagagctatttatgacaaacccacagccaatatcatactgaatgagcaaaaactggaagcattccctttgaaaactggcacaagacagggatgccctctctcaccactcctattcaacatagtgttggaagttctggccaaggcaatcaggcgggagaaagaaagaaaggatattcaattaggaaaagaggaagtcaaattgtccctgtttgcagatgacatgattgtatatttagaaaaccccatcatctcagcccaaaatctccttaagctgataagcaacttcaacaaagtctcaggatacaaaatcaatgtgcaaaacatcacaagcattcttatacaccaataacagacaaacagagagccaaatcatgagtgaactcccattcacaattgcttcaaagagaataaaatacctaggaatccaacttacaagggatgtgaaggacctcttcaaggagaagtacaaaccactgctgaacaaaataaaagaggatacaaacaaatggaagaacattccatgctcatggatagggagaatcagtatcatgaaaatggccatactgcccaaggtaatttataaattcaatgccatccccatcaagctaccaatgactttcttcacagaattggaaaaaaactactttaaagttcatatggaaccaaaaaagagcccgcattgccaagacaatcctaagccaaaagaacaaagctggaggcatcacgctacctgacttcaaactatactacaaggctacagtcaccaaaacagcatggtactggtaccaaaacagagatatagaccaatggaacagaacagagccctcagaaataataccacacatctacaatcatctgatctttgacaaagctgacagaaacaagaaatggggaaaggattccctatttaataaatggtgctgggaaaactggctagccatatgtagaaagctgaaactggatcccttccttacaccttatacaaaaattaattcaagatggattaaagacttacatgttagacctaaaaccgtaaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccgtcagagtgaataggcaacctacagaatgggagaaattttttgcaatctactcatctgataaaaggctaatatccagaatctacaaagaactcaaacaaatttacaagaaaaaacaaacaaccctatcaaaaagtgggcaaaggttatgaacagacacttctcaaaagaagacatttatgcagccaaaagacacatgaaaaaatgctcatcatcactggccatcagagaaaggcaaatcaaaaaaccacaatgagataccatctcacaccagttagaatggcaatcattaaaaattcaggaaacaacaggtgctggagaagatgtggagaaataggaacgcttttacactgttggtgggactgtaaactagttcaaccattgtagaagacagtgtggtgattcctcaaggatctagaactagaaataccatttgatccagccatccccttactgggtatatacccaaaggactataagtcatgctgctataaagacacatgcacacgtatgtttattgcagcactattcacgatagcaaagacttggaaccaacccaaatgtccatcaatgatagactggattaagaaaatgtggcacatacacaccatggaatactatgcagccataaaaaaaggatgagttcacgtcctttgtagggacatggatgaagctggaaaccatcattctcagcaaactatagcaagaatgaaaaaccaaacaccgcatgttctcactcgtaggtgggaactgaacaatgagaacacttggacgtaggaaggggaacatcacccaccagggcctgttgtggggtggggggggaggggggaggggggagggaaagcattaggagatatacctaaggtaaatgacaaggtaatcagtgcagcacaccaacatggcacatgtatacatatgtaacaaacctgcacgttgtgcacatgtaccctagaacttaaagtataataaaaaaaagggagagagagagaaaagagaaatctaaaaaaaaaaaaataccaaagacaatcttcaccgaaatagcaaaaacacaatccttaaacttgcatggaaccacaaaagaccacaaataggacaaacaatactgagcaggcagaatgaagctggaggcactacactgcctgacatcaaaatacagtcgactcttcaacaacatagatttgaactgtataggttcatttatacgtggattttccccataatctaacaaggatagaatgcaatattcacaaaagtgaaaactatgtatacagatgactgacattttgtatatgcgcattacacagggctgactctgggacttgaatatacatggcttttggtatatacagggggtctcggaagcaatcccccttgtatacaaaacaatggtaaccaaattagcatgcaatgggcataaaacagacatatagaccaatggaacagaatagagaacccagaagtaaataaatttatttacagacaactggtttttgacaaaggtgccaagaacacactctggggaaaggacaccatgttgaacacatcatgttgggaaaacaggatatcatatgcagaagaatgaaactatactatctctcagcatataaaaaaatcaactcaaaattgattagagacttaaacatgagacctgaagcaaacagtactagaagaaaacagaagggaaacccttcaggatatgggtctagcgaagattttatgggtaagactttataagcacaggcaacaaaaacaaaaatagacaaatgggactgtatcaaactaaaaacctacacataaaaggaaataataaactattaagagatatcctgtagaatgggagaaaatattcatctgacaagggattaatatccggaatatacaaggaattcaaacaattcaacagcaaaaaacaccagattatctgatttagaaatgtgcaaaatagaacaactggccaacaggtatgtgaaaaaatgctcaacatctctcatcacagaaatgcaagtcaaagccacagtgagacattatttcacctcagttagaatggctgttttcaaaaagacaaaacataacaaatgctggcaaggatgcagagaaaagggaaataatacactatttgtgggactataaattagtgagtcattatggaaaatactgtggtgttttgtcaaaaaaactaaaagtagactatcatacagtttgacaatccactaccgggtattgactcaaaggaaaggaaatcagtatataaaaaagatatttgcattctcatgtttattgcagtactgttcacaacagttaagatatggaatcaacttaaatctccatcagcagatgcagagaaagaatgtggtatgtatacacaatggaatattattcagtcataataaagcattaagtcctgtcattcacagcaacatggatgaacttggataatatgttaaatgaaattaggcacagaaagatggaggattttgactgctcacaaaacagagaaatgatatttgagttgatgaatatgctaattaccctgatttgattatgacacattatatacatgtatcacaatatcactgtgtatatcccataaatatctacaattattacatgttgactaaaaataaaaggacaaagaaaaagactcctagaagaaaaacccacaaggagcatcataatggtgaaaagactaagagcttttcctctaagatcaggaataaagcaagatgcgcattttagccattatattaaacatagtagtggctttctagccaaagaatatggaaaagaaataaaggcatcatttagaaaggaagaattaaaattatgtttgttcatagatatgatcatatttgtagaaatccctgaaaactcaccacaaaaactgaataaattaattcagcaaagtagcaggatagtaagtcagtacacaaaattcagttgcatttctttttttttttttttttttttgaggcagagtcttggtctgtcgcccaggctagagtgtagtggcgcgatctcggctcactgcaagctctgcctcccgagttcacgccattctcctgcttcagcctcccaagtagctgggactacaggcacacgctgctatgcctggctaatgtttttgtatttttagtagagatggggtttcaccatgttagccaggatggtctcgatctcctgaccttgtgatctgccctcctcagcctcccaaagtgctgggattacaggcgtgagccactgcgcccagctttcagttgcatttctatacattaatcacaaacaatctgaaagggatattattaacacaactctatttacacgacagcatcaggacactcagccttggccaccaaggacctttgtaatgtttgccactgctgacctcagctgatggagctgcaagaagagtattccattatatcctcatctgggctacagctgctgcaccctacctacttaacactccatcaagtgagcagatttcaattcattgtaacaagaaacagaaaaaccaaggaaacatagcacccacctgagaaatacaataattttcagggactgactcccaagaaattgggatacattaattgccttacagaaaattaaaaacgactgatttaaggaagttcagtgtgctaccagagaacagagagacaacctaatgaaatcattaatacacaaaaggagacattcaataaagaaatagaaatcctaaaaaaaaaacaaacattttggaggtgaagaatatagtgcatgaaatgaaaagtgaaatagaaagcatcagcagcagacttgatcaaatagaaggaggaattcatcaactggaggataaattatttgaaaataaccagtagaggagaaaaataaagaatgaaaaggtaacaagggaagtttacaggatttatgggacaccatcaggagagttaatgttcacacaggatttatagaaggaaagtagagaggtaaagggtagaaagttaattcagagaaataatggctgaaaacttcccatatctggggctcttcccagattgatggacatctaggtacatgaagctcaaagaattacaattagtttccatctaaaagaggtttcacctagatatattgccatcaaaatgtaaaaaatggaagacaagataattttgaaagcggcaagataaataaagttcttacatctgcaggaacctccataaggctatcagtggatttctgagcaaaaactttccaggccaggaaacaataggattatatattcaaagttctgaaagataaaaaactgccatctaagaatactttacacagcaaagctgtccttcagatatgaaacagatacaagacttcctcaggtaaacaaaagttgaaggagtttatcagcaactactcttgccttacaagatatgccagagggagttattcaggcttaaatggaaggatgataattagtaacatgaaaacatatgaaagtacaaaattcactgataaataaatatacgggcaacttaagaatactctaatagtgtaatggtagtatataaatcacataactctagtataaaggttaaaagaaaaataattaaaaattactattgttttcataatttctcaatggatatgcaatattaaaaggtgtaccttggggcatcaaaaataaaatgtagcgggggaagtataagatcaaaatattccccccaaacaaagagggaacaatcccaacttattttacaaggctagcattgccctcatactaaggccagacaaggacaatataagaaaagaaaataactggctgatatttttttatgactatacatttaaaaattttcaacaaaatatgatcaaactgaatttaacagcacattaaaaaaatcatatatcacaaacatgggatttatccttagtacataaggacagttaagtgtacatatacaagaaatgggatactttaataaaatcaaagataaaaatcatacaatcattttgataagtgcaaataatgcagttcacataattcaacatccttccatgataaaaactatgaacaaattaggtatagaaggaatgtactgcaacacaataaaggccatatatgaatagcccacagctaacatcatactcaatgctgaaaagctgaatgcctctcctctaagatgaggaacaagaaaaagatattctcaccacttctattcaacacagtactggaagtcctagccagaggaattgggcaagaaaaataaataaatacactcaaatcagaaagaaggaagtaaaattgtctctgtttgcagatgacatcatatatgtagaaaatgctacagactccacaaaaaaaacctgttagaagtaataatctaactcagtaaagtggcaggatacaaaatcagcattcagaagtcatttgcgtatctatacactaataataaacaacctgaaaaacaaattaagaaaacaatttcatttaaaatagcatcaaaaagaatagagagctcccaaataaatcctttcatatatgaacgcatgatttctgacaagcatgccatgtccattcaatggcaaatggattctcttttcaacaaatggtgccaggaaaactggatatcctcacgtgagagaatgaagtcgagacctttacctaactccatatacaaaaattaactcaaagtggaccacagacctaaatgtaagacctaaaactataaaactcttagaagaaaacatggggcaaaaactgcatgacattggatttggtattgacttcatttggatataatatgaaaggcacagataaaataaaaaatagagaaattggactgcataacatttaggcatacatttaaccaaggagataaaagacctagacactgaaaactatgaaacattgaacaaattctaagatgatacaaataaatggaaagatatctggtgttcatagatcaatagaataaatattgccgaaatagctatactactcaaagtgatctacagattcaaggcaatgcctatcaaatttccagtgactttttttcacagatatagacaaaaaaaatcctaaaatttgaaagaaactacaaaagaccttaaagatctaaagcatacttgagcaataagaacaaagtgaaagatattacacatgcttattttgaattatatttcaaagttatggtactggtatagaaataaaccaatggaacagaatagaaagcatagaaataaacccacacatttatggtcaactaatctttgacaaagacaccaagagtacacaatggggaaagggtactctcttgaataaatggcactgtgaaaccaggatatccacatgcaaaaaaattaaattggaaccttaccctacactgtagagaaaagtgaataagatttaaacatatgacctgaaaccataaaacctataaaacagggaaaagctccttgccattggtttttgtgacaattttttagatgtgacatcaaaagcacaaggaataaaacgcaaaaataaattagaactacatcaaacaaaaaagtgtctgcacaacaaaggaaacaacaaaatgaaaaggcagcacatgtagcgggagaaaatatttccaaccatatatctgataagctattaatatccaatatatataaggaactcatataactagcaaaaaaacttaataacccaattaataacctgttaagatggacaagggactgaatagacatttattcaaagaagacatacagatggtcaacaggtatataaaaaggtgcttaacatcacttatcatcagggaaatgcaaatgaaaaccacactgagatatcacctcataactgttagaatcgctattatcaaaaagtcaaaagatagcaagtgttggtgaggatgtggagaaaaggtgtcccttatacatttttgttaggaatgtaaattgatacagtcattatggaaaacacgatagattttctttaaaaaattaaaattggaactgctatatgatccagcagtctcagttccgggtatatctaaggaaaacaaagtcagtatcttgaagaggtatctgcactcccatgttcattgtagtgttacagtagtcaagaaatgagcaacatagtattcataggcatggtggcttgtacctgtaatcccagtacttgggggtggccaaggtgaaggatagcttgaacacaggagtttgagaccagcctaggaaacatagtgataccctatctctacataaaattttaaaaattagctgggcatgggggtgcatgactgtggtcccagctactcaggaggctgaggcaggaggatcacttgagcccatgaggttgaggctacagtgaactgtgattgtgccactgtactcctgcctggatgacagatggagaccctgtctcaaaaagaaaggaagaaaatagtgtgtgtgtgtgtatcaccaaattcccaaataaacacatcacatacatatacatacagacacacacacacacatatatacacacacacaatgaaatattcatcctttaaaaagcaggaaatcatgcaatttatgacaacatagatgaacctggaggatattatgctaagtgaaatagccagacacagaaagacaaatactgcactatcccagttacatatggaattctaaaaagcttgaactcagagaaacggagagtagaagggtggttactaggggtcagggagtaggggaaataggaaatgttgaagggtacaaacatagagttatcagatgaataagttcttgacataacgtccagattggtgactatagttaatatattctatacttggaatttgctaagagagtatagcttaggtattctgaccacacacacgcacacacatggcaactatgtaaggtatatgttaattggcttgattgtagtaatcatttcacagtaggtcaaatatgttcttaaatatatgcacttttaatttgtcaattatacctcaataaaagctgaaaaaagcatcaagaataacaaacttaggaaccaactttaccaaggaggtgaaagtcttgtacaatgaaaattacaaaacaatgctgaaagaaattaaagtagacataaagggaaaacacctcctatgttcatggattggaaggccaatattgttaaggtgtcagtaccacacaaaacaatctacaaatccaaggtaatcccaataaaaatcctaatgatgttatttgcagaaagaagaaaccccatcctaaaattcacatggaatctcaagggaccttgaatagctaaaacattcttgaaaatgatgaacaacattggaggactcacactttctgatttgaaaacttactacaggccaggtacaatggcctacacctgtaatctcagcacttttgaaggctgaggtgggaggacttctgagtccaggagtttgagaccagcctggggaacacagggagacctcatctctacaaaaaataaaataattggccaggtgtaatggtacacacttctattcccagctactcaagaagccgaggtgggaggattgcttgagcctgggagattgaggtggcagtaagcagtgataatgccactgtactccagcgtgggcaacagagtaagaatgtctgaaaaacaaacaaaaaccccaacttattacgaagctacagtaatcaaaactatgtggtattgacataaagatgtagagaccaatggaattgaatagagagcccaaaaataaacccttgtatacatgatcaaatgattcctgagaagagtgccaagaccattcaatagggaaagtgctgtattttcaacaaatggtgccaggataactgaagttgagacccttacctaataccatacacaaaaattaactcaagagaatgaagttgagatccttacctaaccatgtataaaagagaatgaagttgagacccttacctaacactgtgtacaaaaacttactcaaaatgggtcaaagtcctaaaactatgaagtcttataaggaaacataggggaaaaactttacatcattggcagtgcttcttgtatgcgacaccaaaggcacaggcaataaaagtaaaaatagataaattgtacttgcacaggcaataaaagtaaaactagataaattttaaaaatttacattgtgtgcattaaaataatatcaactaagcaataagacaacctacagaatgggagaaaaatttgcaaatcacatacctgataagggattaatgtccagattatacagagaacttctaaaagtcatcaccaaaaaacaatgcacctgaaaaatgggcaaaagggccaggcacggtggctcacgcctgtaatcccagtactttgggaggctgaggcgggaggatcatgaagtcaggagattgagaccatcctggctaacagggtgaaaccccgtctctactaaaaatacaaaaaattagccaggcgtggtggtgggcgcctgtagtcccagctactcgggaggcaggagaatgatgtgaacccaggaggcagaggttgcagtaagccgagatggcaccactgcactcagcttgggcaacagagtgagactccatctcaaaaaaaaaaaaaaaagggcaaaggacttggacagacgtatctccaaagaagatatacaaatggataatagtacgtgaaaagttgtttaacatctctagtcattaggaaatacaagtcaaaaccacaaccttacatacactcagatgactactattaaaaaaataaacacagcctaggcaacatagtgagacccatctctagtatcagctacgtgggaggttaaggtgggaggatagcctaagcccagaggtctaggttgaggctgcagtgtgccatgatcatgccactgcattccagcctaagtgacagagccagatcttgtctcaaaaaaatcccacataaacagaaaataaccactgctggaagggacatggagaaattggaatccttgtgcactgttagtgggaatgcaaaatggtacagcctctgtgttaaacagtttggtgttccttcaaaaattaaaaacagaattatctgatccatcaactccacctctgtgtatacacccagaaggattaaaagcagtctcaaagatatatttgtatacccacgattgtagtggcattatttacaacagttaaaacatcaatgcaacccaaatgtccatggaagaatggataagcaaaatgtggtatatacatacaatgtaatattattcagctttaaaaaaaatagaaattttgacacatgccacaacatggatgaacctcgaggccattatgttaaatgaaatacagcagtcacaagaagagaagtactgtatgtttccacttatatgaggtatgtagaatagtcaaatcagagacatagaaagtacaaggtggtttccaagagatggcggtggtgggggggttggggaattattgtttaatggatatagagtttcataattacaaatgacaagtgttatggagatggatgatagtgatgattgcacagcattgtgaacgtatctaatacattcactgaattgtacactaaaattggttaggatggtaatttttatgttaagtgtattttgccacaataaaagatttggaaatcaacaacaaatagaaatcccagaagataacataggaagaaatctagatgatctttagtttggtgatggctttttagatatgacaccaaaggcatgattcatgaaagaaataattgataagctagactttgttaaaaataaaagtttctgctctgtaaaacatactgtcaagaggatgaaaggacaggccacagaagggagacaatacttgtaaaagatatacctgataaaggactcatccaaaatatataaagaaccttaaaaacataacaattagaaaacaaacaatctgattacaaaatggactgaagaccttaacagacatctcaccaatgaagatatacagatggcaactaagtatatgaaaagatgccccacatcttacgtcattagggaaatggaaattaaaacaagaaatgtgatatatctacacgcttattagaatggccaaaattcaaaacactgacaataccaaatacttgccaatatgtggggcaacaggaacactcatccattgctggtgggaatgcaaaatggtacagccactttgacatataccattaatgggaatgtaaagtggtgcagccctggtggagaagagtttggtggttcttcaaagaattaaaaatggaattatcataggatccatcaattccacttctgaatgtgtatacatatcccccgaagaatccagagtatatcgaaatcagtggtttcttataaaattaaacatattcttaccatgcagttcagcaatcacatccttggtatttactcaaaggaggtgaagacttatattcacataaaaatctgcacagagatgtttacagaagctttatttgtgattgttgaaattggaagcaaccgagatgtccttccataggtgagtagacagataaactgtagtacatccaggcaatgaaatattattcatcactaaatagaaatgagctatcaagccatgaaaagatatggaggtaattaaaaaacatattactatgtgaaataaggcaatctgaagaaactacatactgtatgattccaatcatattgcattttagaaaaggcaatgctatggaggcagtaaaaagttcagtggttgccaagggttgttggggaagaagggttgaataggcagtgcacagagtacttttagggcagtgaaaatgtacaaatatatgtaaatatacgtatctgtatgatactataatggtagatacatgcatattagtccgttctcacagtgctataaagaactacctgagactgggtaatttgtgagaaaagaggtttaattgactcacagttttgtaggctgtacagtaagcatggctggcaggcctcagaaacttaaaatcatggcggaaggcaaaggagaagcaggcacatctttaccatggcagaacaggagagggaaagaaagtgagatgggaagtgccacacacgtttaaacaaccagatctcatgagaactcactatcatgagaacagcaagggggaagtttgccccccaccaggcccctcccctgacacatggggattacagttcaagatgagatttgggtgggaacacagagccaaaccatatcaacatgttacacatttgtagaaacccacagaatgtacaccccaacagtgagccctaatgttaactagggactttgataataatgtgtaaatgcagattcataagttgtaacaaacgtgccactctggtgggagagttggtaatgggaaaagctctgtatgtatgggtgcagtgggtatacgggaaatctctgtacttacctctcaattttgctggaaccctaaaactgctctaaaaatataaagtctttaaaatacacatacacacatacagacaatcgaatagagaatcataatggtacactatcagaaaatcatcaaacacaaaaaaaggcagtaagggaggaaatgttgtatttaaaaaatgtaaggcaaaagaaaaggcacaaaatgtcagaacttcttttttataagtaagtactttaaatgtaagtcgattaaattctccaaaaagcagaggttggcagaatggatttaaaagaaaaccatcaacctatgctgtatataacaaactcacttttggtctaaagacacaagtagattgaaagtgaaagaatgaaaaatgatatttcatacaaatagtaacctaaagaaagctggaggtaattatactaataaaagaaataaacttgaatttaaaaattgttataggagacaaaggaggacattacatactgagaaaatggaaaattactcaagacttcgcaattggaaacgtatacacaccaaaatatagagccccagaatataagaaaatatactgacagaattggagtgagaaagacagttctacaataatacttagggacttcaataacgtactttcagtaatgggtagagtcaaagaagaaatgaaaacagaaacttaaaaatatcttcagacaaatgacagtgggaacacaacataccaaaagcaaaacatgcagcaaaagcagttctaagagggaagtttacagcaataaatgccttgcctacattaaaaaagaagagatatttcaaatagcccaaaattgtacctcaaggaattagaaaaagaagaacaaactaaagccaaagttaacagaaggaaataataaagatcagaacagagacaagttagaaagaaaaaccataggggaaaaaagtcagtaaaactaagacttcaatttttgaaacaaagaattgatttttgaaaaataaaatcaacaaactcttggactaagaaagaggacaaaatcagaaatgaaaatggagaatatattacaacaggtacttcagaaataaaaaggatcataagggacttttatgaacaattatatcccaacaaattggataacctagaggaaatggacaaattcctagaaaaaaaccaacctgctaagattaaatcaggaatagaaagcctgaacagaccaatagcaaagagatcacagtggtaaactaaagagcttctgcatagcaaaagaaattatcaacagagtaaacagacaacatatagaatgggagaaaaaatatttgcaaactattcatctggcaaaggtcctatgtccagaatccataaggaacttaaaccaatcaacaagcaaaaaacgaataatccaattgaattggcaaaggacaggaacatacatttcttaaaagaaaatacagaagtagccaaacaaaaaaacattctcatgatcactaataatcagaaatgcaaataatgaggccaggcacggtggctcatgcctgtagtcctagcactttgggaggctgaggtgcgtggatcatctggggtcaggtattcgagaccatcctggccaacatggtgaaaccccgtctctactaaaaacacaaaaattagccaggtatggtggcggtcacctgtaatcccagctactcaggagtctgagacaggagaattgcttgaacccaggaggtggaggttgcagtgagccgagattgcgccactgcactccagcctgggagacagagcaagactctttctcaaaaaacaaacaaacaaacaaaaaagcaaaaaacagacaaaaaaaaacaaaacaaaacaacaacaacaaaaaaacaccaaaccataatgggatgccatctcacaccagtcagaatggcaattattaaaaagtcaaaaaaataaaagttgctgggaaggctgcagagaaaagggaacgcttatacactgttggcaggaatacaaattagttcagccactgtgctaagcagtttggagttttctcaaataactgaaaacagaactaccatctgacccagcaatcccattactggatatatattcaaaggaaaataaattgttctatcaaaaagacacatgcatttgtatgttcatcacagcactattcacaacagcaaagacatggaatccacttagatgcccatcagtggtggattggataaagaaaatgtggtacatgtacaccatggaatactatgcagccataaaaatgaatgaattcggccaggtgcggtagctctcacctgtaatcccagcactttgggaggccaaggcgggtggatcacctgaggtcaggagttcgagaccagcctgaccaacatggaaaaaccctgtctctactaaaactacaaaattagctggacgtggtggcgcatgcctctaatcccagctactcaggaggctgaggcaggagaatcacttgaacccggtaggcggaggctgcagtgagccgagatcatgccattgccctccagcctgggcaacaagagcgaaactccgtctaaaaaaaaaataaaaaaaaaaaatatatatatatacatgaatgaacttacgtcctttgcagcaacatggatgcagctagaggccactatcttaagcaaattaatgcaggaacagaaaaccaaatactgcatgttaccacttgcaagtgggacctaaacactgagtaaacatggacataaagatgatcagtagacactggggactacttgggggaggaatggagaggtgggctgaaaacctacctattgggtactatgctcactacctgggtgataggcttatccacactccaaacctcatcatcatgcagtatactccatataccatgcaacatatagacctgtacatataccctctaaatcaaaaataaaagttaaaaaaaccccaaaacctcaaacaaagaaaagcccaggaccagatagcttcatgactgaatactacccaatattcaaagaataccaatacttcttaaactcttccaaaaaaatgcagctatagggaatacttccaaaaaaaaaaaaatgcagctaaagggaatacttcctaacacattttatgaggccagcatcaccttgatacccaggtgagccaaaggcatcacaagaaaaggaaactacaggccaacataacccaagaataccgatgcaaaaatccttaataaaatattggcagactaaatttaacaatacatcaaaaagattatatatcatgtctatgtggaattaatttctggcatgcaaatcttatttaatatacatgtagcaatcaatgtgatactaacagactgaaagatgaaaaccacatgatcatctcaattgacacacaaaaagtatttgatgaagttgaacatcctttgttgataaattctaacagttcaggtatagaaggaacactcctcaatataacgaatgccatttatgaaaagcccacagctaacgttataatcaatgagggaaaacagaagcccttctactatgaaccagtacaaggcaaggatgcccactctagctactactactcaacatagtactggaagtactagtacaaccaaacagacaagaaaaagaaatgaaagacattcaaatcaggaagtaagaagtaatattatctttatatgaagatgacatgatcctacatatagaaaaccccgaagactctgacaaagcaacctgttagaactaataaatgagttcagtaaagttgtaggatataaaatcaatataaaacagtagttgcatttctatacacaaataatgacctggccaaaaaagaaatcaagaaaacaatcccatttatgatagcatcaaaaaaattgcttaggaataaatttagccaaaaagatgaaagacctgtacactgaaaactatgaatcattgatgaaagaaattaaacaagatacaaataaatggaaagatatcccatgctcatgaatctgaataatattgttaaaatgtcaataatatccaaatcaatatacagattgaataaaatccctatcaaaatcccatggaaaatttttttaaattctaaagttcatttggaatagcaagaaccttaagtagccaacgaaattctgaaaattctgttctgaaaaacaaagggagacttcatactttctggtttattttacaaaactattgatcaaacagtatggtcctggcataaaaaacaaacatgtagaccagtggaacagaatagagagcccagaaagaaattcaaagatatatgatcaaccaattttccacaagaacacgaagaaaacaatgcagaaagatagtctctctcataaatgacgttaggaaacccagttctgtggcttgtccaacccatggcccacagaccacatgtaagcccaggatggctttaatgaggcccaacacaaatttgtaaactttgttaaaacattgaatttttttgcatttttttagcccatcagctgttgttattgttagtgtattttatgtgtggcctaagacaattgttcttacagtgtggccccgggaagccaaaagatttgatatcgctgccttacaccatacatagaaataaactcaaaatggataaaagacctaaacataagaccaaaacccacaaccagaagaaaacataggggaaaagctcgacatggctctggcagtgattttttggagatcacaccaaaagctcaggctacaaaaacaaataattggtataccatcaaactaaaaaacttctgcacaggaacggaaacagtcaacaaaaggaaaaggcaacctatggactagaagaaaatatttgccaaccatatatcttataagaggataatatccaaaatttataaggaatgcatacaactcaataacaagaaaatagataacccaattaaaaaatgggcagtggaactgagtagacatttttgcaaagaagttataaaaatggcaaacacatatatgaaaagacatttaacatcactaatcgtcagggaaatgcaaatcaaaattactatgcgatatcacctcacactcatgagaatagctattaagtgttggctagggttagggaactcttgtacagtgttggtgggactgtagattggtgcagtcataatgaaaaacagaatggtggctcctaaagaaattgaaaatatactatcatctgacccactaatccctcttctaggtatattcccaaagaaaatgaaatctccacctcataaagatatctgcgctcctatattcattgtggcattatatgcatgagtcacgatatgaaaacttacgtgtccattgatggatgactaaactgtggtgtgtatgtctacaatggaatattattccgcattaaaaaaggagatcctgccacttgccacatggatgaaactggaagacattgtgctaagttaaataagccatatacaaatgaaaagttttaaataatctcacctatatgtagaatcttaaaaagaaaaaagtcaaatatacagagatagaataaactagtggttaccatgggcaaggtgtgggggaagaaaatggaaagatgtaggtcaaaggataccaagtagcagatatataggatgaacaagtctagagatctcatgtagaacatgagaatagttagtatattgcatttggaatttttgccaattgagtagatcatagcttttctcactcatacacacaaaagaataactgtgagatgatggacatattaatttgcatcactatgttaacgatttaactgtatgttttatacactaaatatgcatatttttaaaattaaaaaaaaaaaacacaacaagataatgtacagccagacagaagcccaataagaaaagagaggacttgaacaataccataaaccaactagacctacaaacatatatggacactccacccaactacacattcttctcaagtgcacatggaacattccctaggagggatgatatgttaggccacaaaagagtctcaataaattttaaaatatagaaatcatacaaaatatcttctctaactacaatatagtgaggccagaaatctgtaacagaagaaaaacctaaaaattaacaaattcagggaaataaaactacacactctttaaaaattattgtgtcaaagaagacatcagaagggaaattataaaatactttcaaaaagtgaaaatgacgacacaacatactcagacttatgggatgtagtgaaagaagtgctcagaggaaaaattatagctgtgaatgcccacactgaaaaagaagaaggatccataacctaatattataccttacgtaaccagagaaagaagaacgaagtaaacctaaagttaaaagagagaatgaaataatatgtatgagtggagataaaactgaattcgagcttaaataaacaacagagataatttaacaaaaccaaaagttgcttgtttttgaaaagatcaaagttgaaaacctttaactagaatgactaataaaaaattagagaagttgcacatatctaaaatcataaacaaaagtaggaacacaacaaaaaaaaacaaaaataagaaaaaaaaacaaaagtgggaacgatataactgatcttacagaaataaaaagtgtgataaaagaatactatgaataactgtataccaacaaattatataacctagataagatggacgaattcacaaaatactaatacagaccaaaacagaaattgaaattatgagcagacccataacaagtagaaagtttgaatcagtaaccaaaaaccttccaatgaagaaaatgctacacagatggcgtcactgttgaattataccaaacacttgaagaattcacaccaatccctctcaaactcttccaaaaaacagaggagaaaaaactttgcaatacattctatgaggccagtattacatggattccaaagccagacaaatataccacaagaaaagacaaactagatactaaaatcttttatttaacaaagtactagtaagccaaattcagcagcatattaaaaaggattatatatcatgaccacatggaatttatctcaagaatacaagggtggttcagtacaagagtatcaatcaatgtaatacaccacattaatacaatgaaggataaaaaatccatgcaatcatttcaattcactcagaacaagcatttgacaaaattctacaacctttcaggataaaaacatggaactttcaaaatgtgttaaagaggatttgtgaaaaatccacaactaatatacttaatgagaaaaaaaactgaaaaatttctcccataacaaagagtaagatatggctgtatgctttacccagtgctattgaacaatgtactgaaagttttaaccatgacaattaggcagataaataaacaaacaggtaaatgaatagcatccaaattggaaaggaagcagtaaaactctttattcaataatgacatcttctatctagaaaatcaaagaatccacaaactagtagagctaataaacaagtccagcaaaattgcagggtacatgttcaacatttattttaagaaaatcatttgtgcctctatataccaggaatgaacagcccaagaaggaagtcaatttttaaaattccacttacaatagcatcaaaaagagtaaaatagctaggaataaattaaaacaagaaggtgaaagacttctgcactaaagactacaaaacactgttgacaaaaattaaagaagacttaaataaatagaactatacatcctgtgttcacagattggaagattaaatattgttaagttggcgatattacccagtgatctacagattcaatgcaacccttatcaaaatcccaagggcctttttatttgcagaaatgtaaaaactgattttaaaatgtaaatggaattttcccagggccccaaacaatctaaaatcatattgaaaaagaacaaagttggaagactcaggcctgccattttcaaaacttttacaaagctgcagtaatcaaaacaatgtggtactgacacaatgtggtctctaggacacaaggatggacatatagaccaatggaatataatagagaatgtagaaataaacactcacatatatgatcaattcattttcaacaaatgtatcaagaattcagtgggaagagtagtcttttaacaaatggtgctggggcaactggatcctcatatatcaaagaatgaagttggacccataactcatagcatataaaaattatctcaaaatgtatcagagaccaaaaaataagagttaaaggcataaatttcttagtagaaaacaggagtaaatctttatgacttgagattggaaataaattcttagaaaagacacaaaaaacacaatattgtaaatgtactaagtgacactgaattgtacattttgaaatggtttctgttacttaaaaaatttaaagggtgcacagaagactaaaaagcagcacagacagaattatcaccagaaaaagaagactctatattaaatgtcaacatggagaacacatgtcagaaataggtagtccagagcagcagctatagtggaggctcttgcaaatgactaagatttgaggtggcaccctcagagaatcacctcttgggggtagattcgatttatggagtagatgtatctcagagacatggtaggaaagccaaagaatggtgagcatagctgccatctagaaaccacctacacatgcaagcataagagattggttgaaaggttatagcacagtcacactaaggaatactatgcaactttagcaatgcaatgagaaagatctctgtgaatggatgttgagtgatttctaggagatgttgttaggtgagaaaagcaaagttcaaaagggcatatacagaatagtacttttttgggaaatgagaaaataatcatgtcttataaagagcaaacacacacaaactataaactagaaaacactgaaactggttacctataatgggtagggggaattaggatggaagagatatgggtgagaggaagatttctctcagtagctccttttgtttagtattgacttttggaagtatgttaatgttatatgtattcaaaaaataaaattaacaagatagggaccacttctgaggtggtggaatgagcaccttgatataaccactccctgaaaagcaatgataaaactggacaaagaaatataaaattgaaaagtgctaattaaagaaaaaatattaagccttcctaagaatagcagggttatgatttaacgtggggctgccatctccccacccaagctcaggggcacggtaggcttgaggaccagcaacaaagaaggctcatctgattttgaattccatagaaaaccctatgcactatgttaagcaacaaggatttcagtggcaaataattggaggcaacccacatcacagcaacctaatgtttcaatactggttgggcaagcgacagattaagaaaaattttaaaaggaattctggagatatggaagttgtacatgcttgcaggagagatcagagaggtttcctgctatctacttatccttggctgactgtgagaccttttgcaagcagacagtaaaatacaggacagagttataaagtgcctgaactttgaatgtcccaacccacacatagatcccctcagcagagggtggaagattcactggctcaagatgtttaaacaaatgtctgactaatcatggcttgaccactaggttatgctgatccaggggtgacaccaatgaagccaggcttacaaaacaaacataagaattaaaacaaacaaaactgagcaaagacaccagtggctgcacactgcaggagaacacagactctgcagaatccatgcagagaaggcatacacaagcgagcaaacaaataaatgagtaacagaaatcatccctggttagggagaagaactagaatccagagtttctacgatatattatctaaagtaagtttttaacaaaaaaaatgagatatgcaaagaaacagaaaattgtgacccttgaacaagaataatgagcaataaataggaattatctctgaagggccccaaatgttagggcgcgatttcaaagtaagtattataactatgttcaaagaaccaaaagaaaccacattaaagaatgcaagtgtgatgacaaagactcatcaaatagataatatcaatatagagatagaaattagaaaccaaatagaaattctgtagttgtgaaatataataacttaggtgaaaaactcactagtgcggctaagcaaatttgacctggcagaagaaagaatcaatgaacttcaacgcagatccataaagatgattcagactgaagaatagaaagaaaaataatgaagaaaaatgaagagatacccattggataccataatatagtggtccccaacctttttggcatgagggaccagttttgtggaagacaatttttccacagccagttgggggaggctttagttagattctcatacggagtgcacaacctagatccctcacatgctcagttcacaataggatttgctctctgtgagaatctaatgccatcactgatcagacaggaggcagagctcaggcagtaatgcttgcttgcctgctgctcacctcctgctgtgtagcccagtttctaataggccacagactggtaccagtccatggccctggggttgggaacccctgtcctaacaggatgtgtaacaatgtatgtgtaattaagttgtaacatatatgtaattaagagtagaaaacatatgtggaattaaggagtaacaacatatgtgttaataagagtactgagaaggagagaatagggcagacaaaaatatttgagtagattattaacctgaagcagattgtttttgcttaagctgcttattgtaacctccagattacactttaaaaatgggggaaataaactaacaaaggaattagaatggtactctagaacatatctattcaacctgcagaaggcagtaaaggaggaagagaggaacaaaagtgatatgagacatatagaaaataaataacaacatggtagatataaatccttccatatcaataattatattacatataagtgaattaaaaactcaataaagagcagagattgccagactgccttaaaagcaggatccaaatatatatggtctataagagtcacattctagattcaaagacatagttgaaagtaaaatgatggaaaaagatgacatgcaaacagtaataagaaagctagagtgactgtactaaaatcagacaaaattggctgggtgcagtggctcacacctgtaatcccagcattttgggaggctgaggcagacagatcactcgaggtcaggagttcaagaccagcctggtcaacatggtgaaactctgtctctactaaaaattagctgggtatggtggcaaatgcctgtagtcccagctacttgggatgctgaggcaagagaacggcttgaatccgggaggcagaggttgcagtgagccaaggtcacgccactgcactccagcctgggcaacagagtgagactccatcccaaaaataaaataaaaataaataaaatcagacaaaatagactttaaaaacaaaccatgttattagagatactgagaagcattttacaatgacaaaagggaaaatttaacaggaagaaatagaaatcataaacagaagtcataaagaaataaaaatttataacagctaaaaacacagccctgaagtatatgaaataaaactgtcagaaatgaagagagaaacagacaactgaacaataatagacaactcaacaataatagtactaactcttgttgattttctgtcttgttgttctatcaattattcagagtgagttattgaactattacccaactactattcttggatgaaatggtgggaggtgaggctatgtggcactctgcttaataccctcccctgttctggtgtcagggagacaaatgtggagctgacttttcgtcagaaacagtggtacccagaaagtagtggggtaacagatcccaagtgctcaaagtaaaaaaaaaaaaaaaaaaaaaaaaaaaaagccaaccaagaatactgtgtccagaaaagtttctttcaaaaagaaggcaaaataaaagcattcccagataaacaaaaacagaattccttgttagcagaccagttttgtaagaactactagaggaagttcttcaggcaaaaaggaagtgctcccaggaagttcacatatatccaaaagcaaagagcaaggaggtaaataggagcaaagctgttctagagtaaggaaataccaccagttggtaactcaaatccataaaaaccaaaaaagtggatcaaatatatgatataaggaggttaataaaacagaaactagaaatatatacttgctctcctttcagcttctttaaagatatatcattatatagtatgatcattataatagcgcataataaagatgtaatatatgtaacaataccacaaaaagtggtaaaactgaataaactcatacaggaataacttctgtatctcaccaggattaatataaatatgaagtaaattttgagacgatacataaggtaagccctagagcaaacactaataacaaatagaatattgaagaatcataaaagaaatgaaaatttatattagaaagtagtcactagatggaaaagaaagcagcaaaggagaaatagaggaacaagaaatagtacatagaaaagaccaaaagtaaaactgtggatataaatctaattatatcaataataatattaaatgtgaatggattaaacaatctaatcaaaggcaggaattatcagaccagatttgaaaaacaggatccatctgtattccatctatatgaggcacactttagatgataaatgccaactgaaagtaaaaggatggaaaaagatatatcatgtaagcagcaaccataagtaacctgaagtgctataataaagtcaaaggagattttaaattaagaatgttactgaagttaaatatgaatatctcataatgataaaatgtcaattcatgagaagatacaatgattataaacatatattcacctaacaatagagaactaaaacataagaagcaaaaactgacagaactgaacagagaaatagccaattcaacaatagtagttggagacttcaacactccactttcaataatgtgtagtacaagaaagaagatcaataaggaaacagaagatatgagcaacaccataaaccaactagactcaaaaggtaattatagagcacttcgcccaacaaccaacattgaatatacagtattttcaagtgcacatgagacattctccaagaaggaccatatgctaagtcacgaaacaaacctgcataaatttaaaaggattgaaataatacaaggtatctttttctgaatataatgaaataaaagtagaactcagtagcaaagaaattagggaaacatacacatgtggaaattaaacaacactacattcttaaataatcaatgggtgaaagaattcacaagggaaatggaacgtactttgagattaatgaaaatgaagatacaacataacagaacttatgggatacatttaaagcagtgtaaagatggaattttatagctatgaatgcctatatcaaaaaataaggcttcaaatcagtaagccaactctccacctcaagaaactagaaaaagaagagcaaactaaacctaaagcaagtagaaaaaacaaaataataaatattagagtagaaataaaatatagaatataaaaataataaagtcaacaaatccaaaatttggttctttgaaattaacaaacctttgatagattggtaagagagagggagagggagaagaaaagaaggggaggaagaaagagggggaggaggaaagacagagagggaagtgcatgaggcaaagggggagagagaaaactcaaattactaaaatcagaaatgaatgacagttttacaaattaaagcaaaaaaacgaggctagctgcagtggctcacacctgtaatcccagcactttgggaggccaaggcaggagaattgcttgtggccaggagttcgagaattgcttgtggccaggagttcaagaatagcatgcacaacaaagcaagaccctatctctacaaaatattttttgaataacagctggtgttgtggtgcacacctgtcataggctaaggggcaaggatcacttgagactaggagatcgaggttacagtgagctatgattacaccactctattccagcctgggcaacagagagagactctgtttctcaaaaagaaaaggaaaaaggaatgaatgagggaagtatactaccaacctgacagaaataaaaaggattatgaaggaacactatgaacaattttgtgccaataaattataaaacttagatgaaattgacaaattcctagaaagatgaaaactatgaaaactgacta

SEQ ID NO: 437 - DNA, 1810 bp, Homo sapiens
agatgtcatcttgatctaatcggaacaatttagtctagttgaggggaaggagccagcacttactaagtgatgactaaggcaggccggggcctacgcttggtgttatacacatttacaagcaacaatatgtttgggcaatctaaaaattatttatgcaacaagcaatcacctctggagggaaaaggaaaaggaacacagtaccctctcttgttttgggccaagtgtggactaaaccagctaatattaacaaatactgaggtgtttgaaaatgattactagaaaaccagaaatttttaacagaaattgttgaaaacccaaggaatgttaagaaagataaatcggacaggaaataaaccggtattttctggctccttttcataacaacagtgatagggtcagctaagttatagcaagaggggatgaatttgatcatccccaccccacctgtatagagagaagaagtctccattcttaatctagaaactcttaaaaggagctgccacccccacatctttccagattgctgggcagggctctctttttccagctttttacccacaaattgtgatggccaaacaccctcaccctcattttttacactcttagcaaagagatatgaatgcaaacagctactcaggtttgagaccaatcttctcaagaaaccatttctacacaagccctaagtgaagagaagaaactcaaccaaagtctacctgctgctttccagttcttctacttgttattttttatgtcaacagtaaataatttaaaatgattaacatggattccttggaatcctgcagccatgtgaacagttaaaagaaaattttaaaggactattagcttacctggaaccaaaccatgactaacctgcagggtatttactatttttggcctgtttataaacttcaagtacttccgtgaacaaagaaaggatggtaaacctgtctcaatcagccacaaacacatttaattccaagtatcagaattgtgtcaataacaattgtgtatgggtcctgggaggacaaaagccacggagaggtaatgtccactcctcagagtttcagagagatggagtggggaggtggcctgttggagttggctgtcaaggctaagatctggggaggtggtaggcagttgtgtcgtgtcctgtttcaagacaaggctctgaaacccccgtaagaagaaatcactgaaaatgcaaacactgagcagccacatcacagtccaggaggtgccgcttccacattttgtgctgctacatgtatgccgtgctctacatgggtcacagggggattctgccttggaagcaaagcaacagtaaagagtgctcaatcaattggtgaatattgatggaaggaggaggcttcgaattcctctggcttatttgaaagccacttgtaacacttccccagcaggagcaaacaataaaacactgagaagtacaaaggtaatacttccctcacaagtcaagatagcaaggaaggcatctggtacagagaagaactacctttacaatgatagggcagtttacgccaagacagtgatggacctaagcatgacctatcagattttgctttaaagaagaggataggttctcctttctccttaaatctatgttaatcactgaataacaaaagataataatatattaaaagctggtgaatgcggttgtccacaaaactttttaataagtaggtgaaggccaatttgtgtctagccacaaatgtacaaaacaagtgaatgcttactggcaactgttaattttttagaaataaaaggctaaaaaataaaaacaaaggaaaaaggg

SEQ ID NO: 438 - DNA, 3507 bp, Homo sapiens
gggcgcaggaggcccactcccccgactgggtcggctgctaccctcaggccagggtgtgcggtggagaaactgaggctctcctccagctgctctgggagaaaggaaagccggggaccccacacactggcgtctgtgtcccagaacacccagcaggggggagagcaatttaagaaataatctggttggcaaagggcgtcatgaaaatcagccatttctagagctgaggggcggtggtgtttagcccagaggacctagctagctttcagggaaaaaacggatgtggcctttcaggcagagcccagaaaaaaagacctgtgattaggagaccctaagaaccagcaaagaacttctaaatattggaggggaggtggtgtagctgcaaagagcccacacccacgctgagttagctctgacagcttctaaaggaaagggagatgcttagattatcctgagaaactggaggatctcctgagtgacctgaaaaggtcatctcactcatccgcctgtggctggagtaaaatatacggagcccatcccaggactcccagtgggagaggatgaacaatcacttctgaaactaagctcaggagaagttgaggagctttctcaagggagaagagctgccaggagaagcaagggtctctctcagtgccacttcctttccataaaccataatgatgggctctgaaattgtccaaggaaggaaacccatggcttctcagagcaaccagtaccaggggttcaagttcgtcagagagcatgttgaagttctattttattttcctccattggtcacctgctggggatgaggcataggcctagtgttgtcacctggaggaaagacatgatgcaattaacaaagctgctaatgcctcctctcaccctgacctctgctcttagcctctgtaccagcccaccctctgcatcctgcacagccagctgggccctgagaggtcctcctggccctcctcccacccgtcctttgcctgtcagatggagggtctttatgctgagatcactggagaaacagagcttcagtgcactctgtcacaccagcaatgagaaaacctttctaaaggggaaagctcacagtaggcagattcctgattattccataaatcctggagaagaaaaatataggttaacataaggattcaagaggatgacactctgtgtgttcaggcataagctaaattcactcattccgttatttagtgattttgttatttagggtgtgcctggcactgagctaggcgccggggctaccacatgaataagacagagatggcccctccctgaaccctgccgcatgcccttccactctgcctcccaggacaggaggctatgatacactttcctctcctgcaccagcatatgtctgtctccttcccagcccacccctagcaggtgttgtccccagccccagctgcttatgtctcgtgtgttctgccaagagctgcttctgtcagaaggcactaactctctggtgattgggtggtggatagaagaggtaacctaaaggcctgtccagaaaatgagatcaaagttggcagcctcctgggcccctcccaaaaaaggatatagccaccaccatttataattaattcaggccccacttcactctgtcccacctgctttctgtctctctctctctctttttttttttaagatctttttctgatatgcctggttgccccaatgcaagtctcctctttctgaagcttcctgtgccaccaggggcctgtccacctcagagacctctcaggtgcagctcagctgcatccacagggggtcctgagtccctaggccctgcacagatgtctacccaggttctcttggtctcttccatagctatgaggcctcctcattgagggtgcccaaacaccacccttaatcacaagtttgccagcctccaccttctaaccctcctagaccacatcagcccctgccttattccagtattttcctgatttcgcctatttccagcttccctcagccattcacaagcacagcctgatgctgtgcataggaagacctggcagtaagcctatggtgaacaaatatttttaatgaacaaacagaaattatggccccaaactgaaaacaccctggaagccacaaactctgttaccttcaaaagaagccagatctggaccgctgaggtttttaaaaaatgcaatgagcgaattagtgaaatcagttcatcacggacactgtgtctttcaggaaatgaagcctccgaagaaaaaagggatcctagcccctgccaaattccattctgtttcaaattagccttccagtaaaatgagggggctgtcctaactggtctttaaggtcctcctagtaccagagctctgaggctctgtatttcccctgaacaacctcttggaactctccacattctcataacagaagaaaatgcatttgtgctctgggctgaagctcagaagtgggctttcacgacagtcatttcaggcctgtttccctttttctcccttccctgaaagggcctctggtctttcccaagctgcctgagtagaaggaaacacacagctcccccagagcagagaggcccgcgagagggaaagctggcccaggcccagggcaggctcgcctctgactctgcagggacattattccctcccagccagcagggaacttctggaacttctaaacagcacatcctcgagccagcccaggcccccacagcatcctgcaccccaggtttacaagctttttaatgatggagttttgctcttacgcccaggctggaatgaagtggcatgatcttggctcactgcaacctctgccccaccaaaattcaagcaattctcctgcctcagcctcccgagtagctgggattacaggaagataactttggcagcagaatgggaagaagattggatgggagagagatcaaaggctgggagattctaagaggctgttgcagtatagtcgaggtttgtctgccagtggagtccatgtttccaccactgtcctacatggcctctcctcacgaatggctccaacctcctgggtgcgatggatgaagccgggtgcagagatggaaagagcagcccaactttcctaactggaggactgaagcgagagctctcactgtcggcctagtgtggattgactcctttccaccacattccccaaccaaggacagtctataccaagctcacagcactgaggcgctgggggagggccagcccacacctagccccgtcaatcttggtggcatggactccctcctaaagctttctcaggaggccccatttcctactgcagcggggcaagaattcaggaggagcccactcaaaggggagacagaggcagtgctccctgtgagcagctcttcctcctcagagctgtcatggacaattggagagaaaaaccgggacattctccccaaccaggatattttgtatgctttgcacttactgctgcgttcccttcatctaaaagctctaaaatttcaaataaaaaggtacaatgaaagca

SEQ ID NO: 439 - DNA, 653 bp, Homo sapiens
aggctatctagctagggagtgatggagcccagatccgaatccagactgtaagctccttcagtgctggagcagtgtcattcatccatttgttcatttacggatcaaatatttaatgcataactaccacatgcatgatgctttgctaagcccttggggaggcaaagatgaagacatattccttgctttcaagcaggtgctgacagctgagccattccacgcaccttcggagcaaagaactgccggaaaccagggccaagttcagagcctgaaatttttttcaaaggctacaaggagaaacctggggggcctgatcacacattacataagccgtatgtgagcagaggatgccactgatgctaggaacccagtgcctgtcggaattgcgcaaggtttacgcagaagcacttaagtgttgcaacatgaccccacatctttaccaaaaatgtgaaacattcacgcagcacacactttaaaaacactaaagcttgtctccgccaggtggctaaggctgcttgatggggctgacaggagaggagctttgcaggggggcctgacttactgtagctcttggcccagggagctgaacacgcagtactttgtaccccaatagccctgggcagcccaagcctctgataaaatgtacttttctgtgt

SEQ ID NO: 440 - DNA, 2128 bp, Homo sapiens
attgctgtctctgaagttggtcagggcaagccactgggatttggggagcagaagtggacctgtcaatgaaagcagcattccagacaaagcaagaatggcaccaccgtttattgctgccagtctatctgaaattcctttgcccagctggtcgctatctataagacactgggaggagaaaagttccctctcattgaacagacatactaccccaaccacaaagagatgctgacactgcccacgttccctgtggtggtgaagattggccacgctcactcaggcatgggcaaggtgaggcagagaggcctgctgtgcttcagggttgaaccaagaagggcagttttcagagcgcccatttgtgaactgctattctccctctgtcactgatgaattctttccaaagagaagatgatttgccacctctaaagccatgagtgtcacccaaccagacctctttcagtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaagggggccctgggcaaccccaaggaatgcagcccccaggcaaggtgctgcctccacgccggctcccccctggaccatcactgccaccttcctcctcttcctcctcttcttcctcctcctcggctcctcagcggccgggcggccccaccacccacggagatgcaccctccagcagcagctccctggcagaggcccagccacccctggctgctccaccacagaagccccagcctcacccacagctcaacaagtcgcagtccctgacaaatgccttcagcttctctgagtcctccttcttccggtcttcagccaatgaggatgaagccaaagcagagaccatccggagcttgaggaagtcctttgccagcctcttttcagattagctcttcagacacacggggcacccagcccaaccgggaaaggcatctaagacattcaccaacaacagtcagccagcttggtggttatgtcccatgaccttgacgtgtgtggtcccttcctctgctctgttgtactaagtgatgttgtgcagcccagaaaggaccatttgacagtctcagggcaggtgcctacccagcaaggggtacctggcatcagagaggaaagagctgcttccctgtagtcatgagagcttccttctgaagtcatcgttcgctgtgagtttagtggccttattgtgacagtgccatcatgtcttattcttccctgtgaaaccaggattaatcgtggactcctggcagcttaacctagctcagttgcagtgctaagcatgccccgcccccattcagtgatacctgtttgggaagtatatacttccccaaaagtactcttggccctaagttttaggaactttccccgacctggatcccttgtcatacctgtgttactgtttaaagcacacccacccaacttacaagatcttaggctgctgtggtggtgaagcaccttgagtctgctgatattcgggagaacaaggatctgcagtttccccttttctcccctctgaagagtggttcttatgtgcaatctgcagtaaccttgaactccagagctgcactatagaggagaatgcatgccactatgacagcagtatgccaagctttgtgttcatctcctaataaacgttaagacctttggtgtaat

SEQ ID NO: 441 - DNA, 666 bp, Homo sapiens
cctaaatgactgacactgaatagccatcctttcaggagagagtccatttcagacccacaggaagtatgaccttagtctcaagacacctttatcaaaatacaacagttctaatagctgcctaagacttattcagatgaatctttttgttatacaaccacataagcatatggagaaagagaatattttgggaagtacctgtttatgcaacatgttttagcctttcagatagttcctgtggtacacatttggcttgtacactcaaaagatggacgtgaataccactctatcagagtaagttcatgaagcagccctgagagagaataaactagaacccatggggcgtagcgtgaaggacagcctggattgttcctttctcttaataggcttgtaccaactggactgcattttctgtctagttttaggtgaagtagatctttcagaacctgtcctggcccaaacctgaaaatggtcctgaagtcacaatgtctccagaatctaggagtgcctctctgaagtgcttggttgagacggaattttaccatgttgaccaggctgatctggaactcctgacctcagcatgaaaatccttacaagatgccagcaccatgctcttggagttcccggcttccagaactgtggaccaaataaaacactattgtttataaa

SEQ ID NO: 442 - DNA, 508 bp, Homo sapiens
atgcctcgccctgcttcggctcgcgcacggtgcgcgcacccactgacctgcgcccactgtctggcactccctagtgagatgaacccggtacctcagatggaaatgcagaaatcaccgtcttctgcgtcgctcacgctgggagctgtagaccggagctgttcctattcggccatcttggctcccagttgtgtggttttaaaactttgaatatatcatctcattccttcctggcccacaaggtttttgctgagaagtctcctgacatccttatgggtctggaaataactgggaaagaaaagccttgtggaaagaagacatctccagttcttgaggctgggaagtccaagatcaagatactggcagttctaatatctgggaaaacatgctgcttcttcaaagactccaatttcagatggcaaaatgcatggaagctgagatggaccttctggagttttcgataaaccactgtagctcagtcagaggtccaattatgatgatacccacacag

SEQ ID NO: 443 - DNA, 2658 bp, Homo sapiens
tttcttttccggaccctgcagtggcgcctaaagtctgagagagggaagtcgcctctgtgctcatcagccaatcagtgtcgccgcggttcctggttctaaagtcctcgccggcccaccgggactcagattctccccagacgccaaggttgcgggtcatggagtcccgaaccctcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggccagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttacacagatgctaattcgtaggggcacttggaatcacatggttgttttgtgtcccatggtcaagcattctatcttatcagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcgccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaa

SEQ ID NO: 444 - DNA, 568 bp, Homo sapiens
agcaaatgtgccacgtcaagactggaaatcacagcccttgagtgtgtctcagtcagcgcagcagaattcaggggggaaagctgaatgcaacccctggtgcaggaagggaggcttttcctgaggaccgggagaggattttaagttttgcacactagggaccaagaagccctcggggacactgctgagaaaagactgccgaagggaagaccagcggggatcatggaatctattccagaggaaactaaccaacagtgagcatcttcaactaaaactacccctggatgtaataagtgttgcatgcatcattcctttaattgagcagagttaactggatcaaattatttatgggagagagaggaaaagttataaagaattatagtaatttttaatttccaccaatatactctttgtaagtgaatcactctataattactttctgttgcactgaatgcagcaacaataacacaatagtattttaaggcactggtttttggcatactctaaccttgtaattatttaaataacagccaagtttactcatgtttttgattctgtcaagaaaaaaaaa

SEQ ID NO: 445 - DNA, 1969 bp, Homo sapiens
actttgtcgtactccttccttgctgactaagaggaacagaacacagagcagcctggcggtgtcctaccaacaagcctccgtttctccttcctgtacactagggctcctgaaactcacctgatgaagtctccgtctgtcacccaggctggagtgtaatggagcaatctcggctcactgcaacctctgcctcccaggttcaagcgattctcttgcctcagcctcccgagtagctggaattataggtgcatgccaccacgctcggctaattttttgtatttttagtaaagacggagtttcaccatgttggtcaggatggtctccgtctcttgacctcgagatcagcccgcctcggcctcccaaagtgctgggattacaggcgtgagccactgtgcccggccttggtttctaaatactattttgaagtatctgtggagaaatggttacttcgagggctggggcaggaatatataagataacattggaacaaattctgacgccagaacatgaagaaatatttgaaaaaggatggggcatattgactgaacacagaagacaaacatgcatgacctcagcctaatcgtgagaaaacatcaaagaaatccaaattgataaacattctgtaaaataattggccatgctcagcaaaagtgtcacaatcacaaaagacaagggaagaataagaaacggtcacagcctggaggaatctaaggacataacaactgagtgcaatgtgagatcctcgattcgatcttggagaagaaagaggacgttaagagaaatattgacaaaattcaaataaggtctgcacattaggtaatggtaagatacgttgacatcaatttcctggttggatacttgtattacatatactattatgtatataattattatattacaattacatatacagttgtatattatatataatacaataaatgtatatatatgattataatacaataaatgtatatatacagttttatatataacaactattatacatataatacaattatatatatagctaacatcaggataggctggttgaggatttatatgaatctttgctaattttgcatgtttaaaattatttcaacataaaaaaattatatgggtcatgtagttttttgtgcagtttaattctaggcaccatagtttctgttttaatgggtgtattttcttctttcaaggaattgggatagtctgttgtattaaaaacctattcatttttgtacattaagattcttctggccaggcgcaatggctcaagcctataatcccagcacttgggaacctgaggcaggcagatcacctgaggtcaggagttcaagaccagcatgtccaacatggtgaaaccccatctctactaaaaatacaaaaaaaattagccaggcatggtggcacatgcctgtaatcccagctacttgggaggctgaggaggagactcactagaactcaggaagcagaggttgcagtgagccaagactgcgccactgcactctggcctaagcaacagagggagactccatctcaaaaaaaaaaaaagattatttctctaacttactggtttatcttttatagcttatttcaggtgatttgttgtgtttgtctatagagtaaaataacatgtctaatgagttataatttaatgtccttccattcaatcactgtatttcaaatttattccaatattttggaataagcttccaatattttaacttaaatagggaaggtcatacttggtattttcctgacctcagctggaatgccttcatagtgttcacatgaacacatttggcctgagagagacttattatgccgagaatgtgtgtaaccctttttacttaggaattgtgggtggagtttttccccccgcccaagaatgattgttaatttccgtccatcattttcctttgattgttcttcatctcgaaaacaaataataaaataataaaataaataaataaaa

SEQ ID NO: 446 - DNA, 920 bp, Homo sapiens
cggataaggggtgtggggtgcggggacaatgggccagagcttctcatgcagcctgcaccagcgccgggtcggagagtcagaggccaccctgagatggaccgagatcttcagttggggaggcgcctccggtgagcttgcggccagatgccccctcagtagtcctccgcaacaggtgccgcgcagccgagtggcgggctagcataccgcctgcccgcaattcggccaggcctcgagcctgctccgccttcccgctgcggtagcgccgccggggaaacgccgccacgggctgcatgggcagcgctcgcgccccgccgctgagccgccggggagccgtccagtcttcgaatcccagaaacacaaagatggtgcagacccaggccctgctttgactgggagaaagatgcattcagttgactaaaacttgaacggtcggctccaccagtgcaaggattgtgcctgtcctcttcccgggctgatcttcccctgtgcctggaacagcacctgctatataaattatgtgctggatacacacactcgaaaagcaagagatcaggctccctgagaaaggcagtttacttctatagaagggtgcaccctcacagatggaccaatgtgtcaggagaattcagtcacacccaaagcaggagatgcgggaggccagatgcgcaagatggacactcggctcctccttcgtccccgcctctcctcgcttccagggtagcagcctcaacaagggaaactattgttccagtggaggctgcgaggatgtcggtgatttacgcgccgagctgtagctgcaaaaggacaagggcaagtgccggcccgacctagggcccaccggtctctggcttgctcttgtgagtaggtgcaccctgcccgcttgtggtggcctcaggggtaagaaatcaggacccacccag

SEQ ID NO: 447 - DNA, 545 bp, Homo sapiens
aatttgtgatcaattttacctgatggtgacagcttggtgtataagttagtgctaatgtatattactgcatttcatttctgtggagcctgtcagctgagcaaaggagggaaactcaggatggagaactcctccccctccatccataagtggcacaccactggcctcctggtgttattaaaggaaaattggaaaagtttccagaagattaagcagaaagcttacaacttgcacaagactctcaattttccagtggctctgacagaaggataaatcttcggctgttttaactaaaatggacggtcaagttggtatccatcgtgaagctaaatgaatatctggacaggagtcagacaaagggaaggagaatccaggggaagatgaagcagctgcaggcctgtctgctaccctatatccggggaagagccagaaagcctcctgggtccagcatccctgtcttcttgtcaacttttcaagtaaagtaatgcatttcattacattttggatgccacaccagtttaatcccattgatagagggctatgcaatc

SEQ ID NO: 448 - DNA, 763 bp, Homo sapiens
caatcatgtaatcgttcagttacttcaaacgtaaagtaggctcagatttattttttcctaacaaactggttctagtccactcaagattctatccaaaaagcagtatttagcacttttcaggctaattccaaacaaacgaagattaacagatcatcagtttagcttcacacatgaaattgaaaaatgaattgctggtcaaaatgctaaaaacacaaatgtgaaatttatatgtgttccttgttcctaaatattgaaaaaatatcaactaatcatcaagtttgccaaagcaaaaaaaaattgaaatataattcctagttaattggtttaccattcattattacttctctttgaattcagtaacttatcaatgattaaagatgtgcttcaacaagttaattctttaagttcaaataactggaaaccattttctcaatggtgcagcatttcttaatgtcagttcaagatgtttggagacatattgctgattttagaagctgatgtgtgctgatttatgaaggaattgtttagcttgtactctgggctctgatcaagggagatacactctcagatacagcctggcatttaagggtacctctttcctagctgattatctgcttcctgagttcagttgtaatagcttgcgagcttctcccatcccatatgactggattctgatttcttattttctgatagcagggtaaactttgttctcccttattactaaacgttgacttgacaaataaatagacctcctgcattttaa

SEQ ID NO: 449 - DNA, 432 bp, Homo sapiens
cacagggcctaggtgtcccaggagcccaggcgctgcagccctaggggacaaaggggaggaggaggcgaaagaagtcgggaatgattctcctatcctaccaacccgtgtgatggaccctggaccacaagaagaggaagcagttaggggcagtggagtcaccctggggttgactgcactcatcatccacaggatgtgcacacttacttcacagacactcttctgcagtctcaaaatctcacccatcaactatgacccctcctacctgctgccccaacaacatatttaatcagcagctaacactatgtagccccagggggttgcagcgcctgggttcttagggggatcccaggtccccaaaaggagtttagaatccaaactgaagagagcagacaagcacatgagaaatgcgaataaaactaaccacatctaagg

SEQ ID NO: 450 - DNA, 287 bp, Homo sapiens
tggacaaacggcaggcaagccccctgtgctcctcgctggattgagcttctagagcctcagagatggaattcgccgttttgccgcgatttggcgttaacttattgacccatggggaggagggtcacttcccgtgaaaagaaggcagagatgttttgctgtgcccagtgtgaggaagcgaaggaaaagaaagatcttttgaaaatgtgtacatctacttgcagcttgaaaattccaagtgccagacatttttcttggaggaaataaatgtcttcaatttattcatctta

SEQ ID NO: 451 - DNA, 202 bp, Homo sapiens
atccagataaaaagtagaaggtttagagatattgatgctttggcaagatccattccgtacataaaggcaaggtccagctctgtcacccacactggacttcggtggtacaatcctagctcactgcggcctcgaacttctgggctcaagtgatcctccagattctgacagaagatacagatggaactcattggtcagagatcac

SEQ ID NO: 452 - DNA, 227 bp, Homo sapiens
ggaaaggagcatgcgctggaagctgtgtgctgttggttttgaggatcttcagtaagctgaaagcggagagtcaggggccttgtgtcctaccatggtatttgctaacgtttagagagtgcttccccttgccgagcactggcaagaaggccctcaccagatgccagcaccttgacattggactttccagcctccagaaatgtgagaaataaatgtctttactttataaa

SEQ ID NO: 453 - DNA, 474 bp, Homo sapiens
ggcttccgttcgcggactttggcccaggcgcgtgggcgctgccgagaggctgggagcccgggaaccggttcctggacttgagcggagcgagaaagagcgcgccgcctgcacgactggactggagcggccgggtgccctggaggcccctgggaattgcagtccttgcgcaggtggagagtgagcccttatgagaaaactcaagactcagaaacaataaaggttacagagatgaaattgacagagcctgaatttcaggttatgattctgtatggtttctttggtgctgcattagacctgagctctgattgaaaattcttccacgctcgctacattccaaaactttatctccaatatgaatttccagatgcctcacaaggtctgagctccatctgaaggctttcccatgcttgtcacattcatagggcttttctccactatgaattctatgatgtcgaataaagtgtgagctctgat

SEQ ID NO: 454 - DNA, 574 bp, Homo sapiens
tttcagggactgagccttgccatcttctaagggttcaaatgtgcctttatagatatttcactgaactaataggaatgagaagatattatctcacatttggcaagttgctatgaagtcataacttaaattaagcacaaggctgatgttctcaccataagacatttttgtacaagactaagaactcggcatgcttttacattggaaatttggtaattaatatcagcatcctgattttccattggggagtaagtcaaccttccttggatagtagcatagggacctttattgtacataagtaacctggacttggacagagtcaatgaatttatccacgaatgggtatctgccttcagtccagtgaaaatcaaccaggtacttctgtacagcccgagggggaatatgtccttttctctgcctgaagttgcccatggtcatgtttgtgattatacggggtaaactgagaataaaataatcacatacaaaagaagaatcaaaaaaatgagatatgatcttgataacctaatttaaactctaagtaattctcataacaggatttagtgaacattctaaccct

SEQ ID NO: 455 - DNA, 311 bp, Homo sapiens
cccagaagctagctgggcctgagctggacatttagtgccagaagattctcaaaggggtccctgattcagaaaaataagaaccactccacagagggactgctgagattctgagcgtcgcaagccttctggagttctaaatggtgctcctggcagtcccctctgtgggtctctatgctgcagaggcaaagccatgtgtcctcatcccgccctgcacctggcagtgtgactgagaggggaagccaggatggggttcctgttggatcccacatgtgtttcctccctggcttgtggaagaaaatgtgttctccaaa

SEQ ID NO: 456 - DNA, 391 bp, Homo sapiens
tgccgtggccaccagcctccacctttcaacagccagagcattgaaactaccttctttcctttaatgtaatcaaattcttgggcagagttgatcgtaatcagtgttgactgtttgttattttaaatagtaattttttttcttatcctggcaaagttcatctccttgtggctccagattttcagtctagttattttatgtcttccaccatttgtgtctgaaaggttaaatgtggtgcctttttttccttaccgcatgcataaatgcatgtattttctgtatttggacgtagaactctgtgtgttgggggctgggataaagaaagaggcaaccatctttggctgatgtgttagagatatgcttactttacaataaacaaaggctctttgtgaaa

SEQ ID NO: 457 - DNA, 762 bp, Homo sapiens
gcggagggtgcggccagcgcggtacccgccccggcgaggcgctggggaggcccgggtggggagaagaaatggggcctgggggacggtaggagcctccgtgcggagaccactgttcaaggccacagacatttatgcagtgtgtgattctttctaaaacaactccctggaagagaggacatttaattcaacaatttattggccacctactgtgcaccaggcagtgaacttggaactggggctactgggttacagcagtgaccaagacagaggtccctgttcttaaggagcaagtgagggcaacagaaaagagcagtcagctgtcatgcgagggcactcaagcagccctgtggaaagctctacgtggtgagaaactgaagcctcctgccaacaccaacaaggaactgagacctacttccaacagccatctgagtgatcgatccatcctggaatcagatcctccagccccagtcaagtcttcagatgactgcagccctgaccagcatctcaactgcaacctcgtgaatgaccctgagccagaaccatgcaactaaactctgcgtggattcatgacccacagaaactgtgagatggtagctgtttgctttgttaagcctctaagtctggaaagaatgtcttaagcagtagcagacaatgaacacaagattattattcagctgttgaattggaagaggaggggaagaaaaaattttcagatcacaaaatattcattgtgtaaaacttcaaaaattctgaaatttaagg

SEQ ID NO: 458 - DNA, 2374 bp, Homo sapiens
tcactgcaagctccgccttccgggttcacgccattctcctgcctcagcctcccgagtagctgggactacaggcgcccgccactgcgcccggctaattttttgtatttttagtagagagggggtttcaccgtggtctcgatctcctgacctcgtgatccgcccgcctcagcctcccaaagtgctgggattacaggcgtgagccaccgcgcccggccagttcaatggattttaaaaattattattctctagaaaaaagaccacgaactttggagtggacatcctgagacctgcctacgaagaccattaggtggcctccagaagacactcccctgattcctacaccgagggaacacacagcagcaagctaggaaagaaggggtgacccagcccaacgctgtaaaccagggcgcgaaccggcgttgagctgtgcagctgcgccctgggctccagtcctgctctgccgcagaccccaccggagccagcacctgcctccccgaccctcgctggggcggctgtgagatgagcccagagccttcctgagccaaccctcgcaaggaaagtctgtctgttcaccccactatccttgtcttgaaggatgaagaaaagagggccccccgggaggtcccaaaaggtggaatggacatctgggatccaagcacagcaatttctttatttttcttaagcctctcactagaggatgaaaatcgttctgcataaaggcctgggctttatgaaaaatatattcacacctcccgtgtccgagctgggataccaaagaagttcctggttgagtactacttatgaatgaaggattcaggggatgcacaggacacagaggaatctgggggatattatggttctgggaatgtggaatgtaacgtctcatcttcagcccatctgtgctactgatcatctcattccagaagccatgccttctctcaggagcagacagcacaagactttcctgccagaggcacagtccccagtgggagtagcatccacataagacaggatgcagagatgtcttcaagcagcttcaaacaaaacttcaagaaagaaagtgcaagtgaaaaaggaaattcatccttccagtcacttaacacagcactgtcacggacaccttgtgcctccttaaaattcgtatactgaagttctaagccccagtaccccagaatgtgaccttctttggaaatagggtcattgcagatatgattagttaagaggagatcatactggagtgggctttaatccaatatgactggtgtccttatgtaaaggggaaatttggacacagacacacacaaggagaacaccatgtgaactgaagtcaaagatttgggtgatgcttctacaagccaagaaatgccaaagatgaccagcaaagcaccggcagctggtggaggagcctggaccagattcttcctcacagccctcaaaaggaaccaatcttgccaaagctttgacttagacttctagccccctgtgatggttaatgttaagtggcagcttgactgggttaagggatgcccagatagctggtaagacagtatgtctgtgtgcatctctcagagtgtttctggacaagatcagcatttgaatccttagagtaaagaagatctgccctcacccacgtgcatcaccctatctctggagagcgcgaacaaacaggaggaagggcacatatgctccttctgttccagctggcacatccatcttctcctgccccctgacttcagagctcctggttctcgggcctcaggattccagcacttacatgagagcgtgcttccccctccctactccacccctaggttctccgccctttggcctctgactgaattccaccaccagcttttcagggtctccagcttgcagacggcagatcgtgggacttcttggcctccataattatgtaagccaattcccataataaatctcctatctatctatctatctatccatctatcaatcatctatctagtctatctatctatctatctctatcctattgattctgtgtctctgaggaaccctaatacacctccagaactgtgagatgatacatttctgtggtttaagccactcagaaggtggtactttgtttcaccaggcctagcaaactaatacaagtgcatggaaggtgactactcatgactgcaacttagagaacaagggttataataaaaataaaagtgttatacaaaggtggcaagataaatgacaataaatgaaaatattaacatgtgaattaaaaagtaaagatatttttcctagcattctcccagaaagtagagacgcgtctctcttgtttgccatcatatccagcaatggcaagataagttctaggcacttcataaaaatttgttgaatgaaa

SEQ ID NO: 459 - DNA, 596 bp, Homo sapiens
ctgcaactgtcccatctgtctgacctaacatagtgggactgagatgaaagcaactgaacgtacagatgccgcttccagaccagaaccacctgagcacaggaggaaacaaacacatggactggcaagggaggagaatgggtttcctggctgggcactgggcaagtggacagctgcggcctgcccctctgacttggtgatcatctgccctgcactagccagaggaacctcgacctcccaggaattcttctgcttgcctgtaagagaggaggactaggtttgtgttcacaaaccaggctggggcctcctttggatggggaggcagtgggtctgaggtgggacctgctcccagacatgtcgtactgatgatactggtgcaggagggatggtgtctgctggcgcctctggttttaagtattaatagctataattttacaggggctgaagggaaaaagataaaagaatgccaaagaaattatgtctataattctcaacatctattgtgaatatacactagttttttaatgaactgcagttactctgaataccaaaaagcactaaaaatactttaaattaaaacttgttatcacatccacaca

SEQ ID NO: 460 - DNA, 2103 bp, Homo sapiens
gtgcactgtctggtcaagagcagtgtccatgtgcgtttctgtggcagcagtgcacgtggggtgggtggggggtgcgtacggtggggcttgtaggttaagatgtctctgcggtggtgtggggctggaggccgagccaggcacggcagctggccctctccaggcgcatggaggaattctccctttgccgttccaaggatgccgccgcctcctaccggggctcccgggggggtcagccaacactacaaagggcagcgagtcctcagggcgcccgggagccaccagtctgctctcgggctctactcagactagcgccaacagtctccgcggacagactcgcatcagccgccctggggctcggcctcctcccataggctcctcttcctctctttcattcaagtcttcaaactttgaaaaaaatatgagcttttgccaaataagacgggatagtttatggagttttctgaggcgcattgaactctggtcagcccctcgagcgtgggctcggccatcagcaggcccggtgggttggccgggctggccctcccaggctgcctttctctctggtcgcggcctggcccgccccggcctccaccgccgcaattcatgctggtgccgcgcccgcagccccactcctggtatgcctgagattctccaggggccaagccggtcctccttcccggcccactcttccagggccaggacgctcccgcggagccagcccatcgtggctgggggtcccaggggctggaggcctgcctggttagcctctgtttcccagacattgactcgaggcgcctccagtcctctcaaccccctgactttcaagtcctttcaagtccttgtgccctgaccaagttatgaggaaaagagggctgagggcctggaggtgggctcgcaccccctcgaacccacctagatgtctcctcctccccagcctatgagttcagacttggggggctccatctgtccctccctgaggtccctcatcttgtccctgctctgattctgtcagcagatcctgaacactccttggtggggacccatgcctccaaggctgcccccaatgccagctgtcctggggaaactccccagaactctcggggaaaggcccgagaaccttcggaggaagcctccgggactcctcgccacctgctctgtttctctcccggccccactgccttcaggtatcaggaagagggcaggcccctgtgccccctctccccttcccagggcggccaacaatactccaccatggggcgcttcctttcttctctggaaactaagacattggactgaaggaactggcctgaggggggctgaccgggggcccgtgctgctgggagctctacgcacaagaggccgccggggtcacggacaggaacctcagcccagggtgctggcctttctccttcgcaggagtcccccaaaatccacacagcgactcgagcagccttccactcagccagaggagggtcgggctcccccgcctgctctcggtggtggcgtctggcccttcctgccgtttccaaggcctccggaagcaccaacccagttctcagttacctcctctggccggaaggcctcacgttgtcctccagagctgctctgggcccagggctggctccgtgaccacctgatggacgtgctgggcagcatgggctcccaaggcagcatccccagctgctctcccaccccaccccagctgcccggcggctgggcccacgagggctctggggacacttccataggaaaggggcctggcactttgtgattgccacgtgtttcctgttaagccgcctgcccccagtgcaaatctctgtgttttgctctctcctgaacaaaaatgtaaaccgacgccggaaagcaaatggtatcgaatacctttcttgcccataagggtttttacaaagaacgtgtctcactaggaactaggacactcatcggcccgagaccaactcctggataaaaggaataaggagaatcgtgtttgtaacgagttacaggattgtttctttcctggattttaaacttttgttaaattgtgaaattatggaggagttttatagaaaaaaaaagtgaaataaagtcagatgggaaagcaga

SEQ ID NO: 461 - DNA, 861 bp, Homo sapiens
cgcctcccgggttcaagcgattctcttgcctcagcctcccgagcagctgggactacaggtgtgtgccaccacaccggcctaattttcttttcttttcttttcttttctttttattttttgagacggagtttcactctttcgcccaggctggagtgcagtggcgtgatctcagctcactgcaaactccgcctctcgggttcaggccattctcctgcctcagcctcctgagtagctgggaccacaggcgcctgccaccacgcccagctaatttttttttttgtattttttagtagagacggggtttcaccctgttagccaggatggtctcgatctcctgacctcatgatccgcccgcctcagcctcccaaagtgctgggataacaggcgtgaaccaccatgcccagccacgcccagctaattttctgtattttagtagagatgggatttcaccatgttgcccaggctggtcttgaactcctgggtccaggcagtctgcccaccttggcctcccaaagtactgagattacaggcatgagccaccgggcctggccccacggtgtgactttgacctcctcatgggaggaaaaagcaggatgaagcggggatgatgtctgtcggtcctcagcaggagcatctgccaacgtctccacattgtggacctgagattgttctccggaagctgcagtcggagcatcgccaggcccagccctgggtcctccacccgggccactgcctctcaggcggcctctccctgcccccgcccctccggggccccacagggcggccagtgcagacctgggtgtgcaacggccccatcagcgtttgtttcatgaacaaataaatgtctaaattcaggaccca

SEQ ID NO: 462 - DNA, 866 bp, Homo sapiens
tgaggatgaggaacatggtgttgcagttcaaaccagttccagccaaaatggactctagtcacaaacaaatagtaataacaatccaaacttgtggctgaatagagttctgaagttttgagaaagaggtgattcagctcaaaagttttgtttagaatctacttcctagtacccaccagcttaggctgagtttcccagaatcagatctgtgttggagatttgtgtgtatgatgtttattggggagcttccccagaaacaacacctttaagtacaggaaacaattgaacagggacaaaaatcctacagtgataaaattataacagaagtcgtaggtaatcctttggggctctctggagctaaaacagcttttccaaattgtctataaattgatgcaagaggaacacatcttcatacttcacgttaaacagtcactgggcacaggctaccctaggagaaagcttgtaaacttggatgaagtaggttcctttgacagaaagcaattccagaagagagatgtacctatgagataacagtagccagcactcccagaagctcacaagtgactgcctttgtcctgacagaggtatctgaacagtgcactatgccatccactacaacccatttctacgtttatctgtttattttaagacaataattagaataagctccaagagaacagagaccttgtctatctcatacattgatatccccagaatttacaacagctcagtatttactcaataagtatttgttgactaagtgattgaactgaatgagtaattaaagtatatttataggtgccacattttgtaaactatcacttggcatatcacagagaatactaataaatgaaaacacagattgggaa

SEQ ID NO: 463 - DNA, 388 bp, Homo sapiens
catagagtcccccttgatacggctgttcagcagaccaactttgttgtaaatatttagataaaaatgggctttagagcagccacatctgaagacccacaaggctgaatgttacacaggcaatcagaatctgattgaagataaactcatcctatttggatcagagcattagaagaaagaaagaactgacacttctcaaccttctctagttgaagacttctctttgctataactacttgaagagttcagcagaaaaattttactgaagaatccctgatcctcctttaagtagctgtagagaatattcactaagtgtaatgggacacgtctctctcatgcccacttcttttctcttatccctgcaagaaaatgaagttttgttggagtcaga

SEQ ID NO: 464 - DNA, 1992 bp, Homo sapiens
caggtacctgggtttctgtactaatattgcaccctgaattttgagaaatatttataagcacctactaacttcatgaggaaaatacctttgtccaagtgatcaactgttaaatttatatccctctacctatcaatgatatattaatctgttttttaaaaaaaggcagaaaaagacaaaaaatggaaaagtaaaatgggcaagagatttcttactttttccttcgcactttctggtatttcccagtttttctaaaactagcatatactattttaaaattataggtcaataataatacatgaatgtgctttccttgtaagaaattaagacattccagataaggctaaaaagtccctgttgacctctaatcctggattcctccctcatacctagagaaaatgtctgttaaatattggtatgcttttttttttctagatctttttcaatgcagagttatttgtggtttatatctatggcatcatgtgtgtcttgtcctaaaactttttaaagctcaatattgtatctttcactattttttatcttggtatgtgcaaaactactttatcagcttattctttttacctgcttcagagttttccatgagaatggacattccacagtttatacagcctttcctctatgatggccattaggcatctttcctttttttttttggcaattagtagtcttctttcattgagaagaattggtatgtcatttaaaaatttaattctagcttcctaaactaaaaaaactccagaaagctcatgcctcattctaatctcagaaagcactgtctaggcttggagatctccccagctgtctaagtagaaagcagaatgaggacttcagtgagcctaatccctgctctgtgttccccatccttccccgacccctagcccccaaggactgggatcaatattggaaacctgtgctttagttcttccacctctgctgctgctatgctgtgtgacctcagtgatacatgtgagtgaccacccagacggtgcctgaggaagtggtcctttccttgcggcccccatcaatagtctgcctctggattctgaacaggggaagctgaattgatggtctctgagtcacagttcctcatgaaaagaggtgcttaacaggagacactcggggactgaggcttcagggacccacccccccccgccaccccgccccacctccactgttctggtgcccctgaggccttcagaagttgttcctatttatccctacgacttctgagggctacgttgctatagcaacctgggtctgctgatctgtgtaaaaaacttatcaattagctgtctggagagtccatttaaggggtaacagagaagcaattactccttatagaggaagcgcaaacagtccccatttcagagcctctcagggagagtctgagaatggcaggtccaagtcactcattttagggacgggggcactgagggatgaaatgaactggttcatcccaagtcacaaagacaattagaggcaaggcatcctttctggctctgattcagaagctccattatctctctacctttgttccaggcttctcctttcccctcccgtctattctccaagcacctattgcctccaagatgggctctagactgtaagagccttgtccttcactctcccagtagcccccaggcctttgaaaacagccaggcagaccccctcacctgctgctcacatggcatcctgtggtggcccacgaagccccagtgacctgctgcctggctgcctccctccacggctctaacctctgtccccttggcaccagctcactatgaggtcctccctattccttaagaccaagctccagcctcttcaaaaacagcacatctctctctgacacagccactctccctttatcctgtgtattccttcacagctcccctccccatctgcaaccacactctgattgttacgactttgctcgttcccctctctggaataaaaatggtaaaactctgtctctta

SEQ ID NO: 465 - DNA, 754 bp, Homo sapiens
cctgcggagttggcggaggcggcggaggctcctccagggactggggcaccgatctgcgtagaaacgggtggcggggaagagaggggaggagagctctgagtgggaagcggaaccgggggcctgggacccgtcgcgtcagagccaggcaagtgaaccggagcaaacgacttccgatccagtctgcgctgttgcggctcccgtttgggatttgatttgcagcatctttgagcctctacgacaaaaaaccgcgaagcacgcccagccctcccccggcaccccgaaaagcacccactccctcccggggacacagctgggcgcgtccacacccccgcagccccacaccatgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggcctcagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaag

SEQ ID NO: 466 - DNA, 451 bp, Homo sapiens
agttatttaatatagcagttcataatttaggccatggatcatctctgcagagaatcctaccatgctgcattcttgctttaaacctttcgccctctaaaacaatgcccaagagccaatgttagtcatggtcttcctgtatttgctctaggtaagctgtttcatagccttccaggacaacacttgcacaggttatctttaagcaccaacaaaagaaatggagaaatttgagccatgtatcctgagctctgaaaggcagcaatcatcttgaccccaagcatacaccatgttcagcttcctccccttggccaggtaccacagctacttctatcccagtgatcagcaggccctccagcatgaagacctttgagaaggatctatagctgtcaactcctaatatgatttgtgcactatcaccttgaagtaaaccagactagttattttcatgctaaga

SEQ ID NO: 467 - DNA, 529 bp, Homo sapiens
cctggtcgcgctgtgccgggtgtgacactacggagagcagattacattatcaaaagcaccaagttgaaacatttgcaaggtgtgcatcatttcacaattattggcaatggttcaatggtttcatctgctttgaacggtttcttctctatcattaagaggtgaggaaactgagcactaagacactaaataacttgcccagggtcatacgacagacatgagaggtttatatcaggcagtctccacccctgttccgaagtcaagaggctgactcgggttgctacttcttgacagaccggaccccagatcgccgaagaccatttggacacacttctatcaaatcctggcggtctccttctaacaggtatgcagttttctctgtagacccttaatacacagataagacttgaaggaatttatctgcattccctgattggtgtggcaatggaagtcccgccctgcatcccgacactgagcacagctgcagctttcgcttgttcattcattcagtagatattattttcatgcctac

SEQ ID NO: 468 - DNA, 1744 bp, Homo sapiens
actgggcagaccttgctggccacggcctccacgtgcagtgaccgttctcttggcagcgtctcaggctgtctggaccagctgtcacagtctcgctgtgggtgagtcacctgaggcactgtatggcggatagaaggattcattgccctgggaggttttgcctggcattctgcagaagcattgctgtatcttaccagacaggaatacagatgaagacccccaggcccagggaattcgatcactggctgagaactcacagctaaggagggggagcctgggattccttcctggtgctcacacccgagacccttttgtcactgtgttcaaaggcactgctgcacagacgtgattcttctttcaacgaacatctccaggacttcctccggggtctgtgacctcatctataattaaagggaaagagatcttcctgagattagcccatttaacttgtttaactagatgcatgctgcaaaaactgttttcaagaaatgaacaattgactatttaaaaagagccaagccttaaaagaagaccaggttttaatagggaaaacattcagtaaaatattattctgcagtaacttgtggaatgactgctgtacacacagctctgggctgggtacctggaagctcacgagcttgtttggcctcccctcctggacacaggaggtgtcaaggctgtggtcagcagaatctacccagctggacactgagtggacgccctgtggggtggctgtgaaatgggtccactttgtagtggcagcatccctgatagtacttctgaaagggacaagatagaaaagcaaaccaaactgaaactgagaagtcgtggatgataccaggggcgcacagtggctgacaggaagagactgcctggggggtctcggagccagtggctggagtggagttagtttgaccgagtcctggactagggaggggacccccaaagcatgcccagcatggcgctagtggggcccaggcaccccatgtcccaacgactagaaccaataatcaggttaacactcattaaataagaagtgtctgtgcctcctgggataaaaatcctttataacgatctgggacgcgagctcaagtccctgttcccttgtcctccacagcagtgtgcagcgtggaactcggcggttcggggtccctgagtccctgagccactgtctaccccctgctccatcccaaatgcagagacccctgagcactcatgtggacatgccccaccatgccctggctgctccttcaggatggcgcagggccaccgctatgggaggactctaaagggtgggtctcaagccctcctctgcttaccctaaatcaggagagcaaaccgaatgcactgccctcttccttcactcctgcatcccatcccccgctatggcctcactatcaggtctgctgtgtgccaaaatattttaccatgccctaaaagtgagatgttggaagtggacaaggaggaaatatttatgaatatttgagtctgttattctttatgttaagcattttggcttctgttgtactcctaaatcactactgagagcagagaaagagctctttgtagaaatgagatgtgttcctgtgtgctgcctgtgacgcatcccgttgtcaccggagtgccgtggccctaaggaatgacagcattaaggcatggacgttaaagatggacaaaagaattgttcacggtgttgtattttaaaatgactatgtgtatgacaattaaactattgtgtcttcgttta

SEQ ID NO: 469 - DNA, 1602 bp, Homo sapiens
agtgaggtcggcgcccgccagtaacaaacatggctccctgaagccgctcaggctcaagagcaacatggaggtctgcacttaatcgctcctctccgggggcggccataccgaggaggcgtctcttccgtgcaggcaggctctcctggggacctcagagattctctccagcggcagcggaaaacggacaatgggtggattcgggtccagattctggtaggagggagtttgggatcgagatctggaaaaaagcactagactggaagaggacgcgatggagtcggagccgctggcggggacaaaaaccagaggccggggaaggcgccggtgggaggcaaggcacggatggactttacctgcgcacgcgtcgcagccatctccgcgcacagtggtggccaccgcgactggtgctgaagtgttggcgcgtgccgggcgctccgctgggacccgggttgctggccctgagtctcagctttctcatctgtacggttgggacaagtacagtaaccctcgcccgtcaagacgggccagggctgtggcgagggtccacgccttagagcaggtacctatcttgtgcagggccctgagatggggtctgactcagttcctgcggggaacttcaccagtgacccagtcagtgcccttcagttaaagaccaccaggagcacacttgcaggagtagggctgattggagccattgtacagtgtcgggaacataccaggacactgagaatagtgtcatgtcataaggacccagagcagatggaccctgctgtgatgcacaaagaggaccacgcaagatatgataaagatctacatcactgaattttggttccatttttgtatctcagcttccaggaaataaaaaagaattctaacattcatactttcagtattttatgtgagaggttttgttgtcaaaatcaagtctgagagcaatgtttgttggggcctttaattggagtcaccaagcgataaaggggacattgtcctcaacaataaccctataataaacacgttttggacaataaatatatgacaatttcttaaaagcaatttcttgggcaatcaagacagtatggcttgagtatggagttatacgatggtttggattaatccagtattaaatctttggttattacagaaatcaatggagcctattcttccaaataatccttaaatattacttatctcaactgagattttggtgaaaatttagctttagagcttttattgacctgccaatgacctgaagttaagattattcttttctactgaatgaagacaaactaccttataaaaattaacccagaaggctgtagagggatgaaatgggattttgttggcaccaagacctgattgctttgccagttaccctcacccctggctcacaaggaaagtgtatggaggagattctcgaggaaccacatgagttttaatatcataagcttctgccctgaattgaaagcctacatcatcctgtgcatttcacaaaatcctaatgaaaactacacgaagctcaaagtatagataaacatatcagtgttgacaaccgtgaaaccacgctatccaaaggctacgagctctgaggaattcctgttagct

SEQ ID NO: 470 - DNA, 558 bp, Homo sapiens
cacagggctgaaatccctaatgttgaagcttcctgaccaggaaaacgagcagagggcccagagagcttagccattacagaatggcttggttcgtcacttggcctggctcagccctgctttgggatgtgttgatagtgcctttcttggactaaaatccttgctctctgcctgtcgtgctccatgtcacttcagaatgccagagccagaaaaggcctcagagctcggaggccttgtgctgtggctttgtctttctgcttgcacctgtcacggctcgcttcagggaacagcgcagacccgcatgctcagctctcagtccggctccctgctacccctgtgaccaggagcaccttcatgtctgctcgccctgtgatttggagagtgtgtttgatgcgcttggcttctgctgatggcctatcctcccagttctggccagaggcagatgcggtgggggcctcttctccactgcccccctgcctgcacctccagcaggtggcccagtcctatatttccattgctttgctctttcttgctttaaaataaacaacaaaggcaacagac

SEQ ID NO: 471 - DNA, 686 bp, Homo sapiens
tataaatgcccgttaaagcaagagctcttgtgtttctgttcctgtggagtgcagctgaaatgaccgctactgctccttcacagtatatttacatgagcttcctgtggacatcagcaccatttaaaattaaggctggaacacagatgtggggctggaagtggagcagccccttttagccatgaggcccaaagccacatgctaaggatggtgaagcaggggatagaaagagcctgtgtctttgctgacttccttaagccacggcaccagcctgggcctgccctactctggacatctaaatgtcaggagctaagaatcaagtcagtctagaggtgttcgttgccatgtggagagatccttcccaagaagaaagatgctacaaagtgtcctggaaatcctctttgcccatccagatccaccctccctagcctgctctgtacctcaggaagctgcttttcatggttcacataaaccaggctcctgtaccctccagataggtccatcctatgggtggtaccagcaggagaccagagagatgaaggagggaaaaaaagaacattaggggttgaattgtatcaccccaaaattcatatggtgaagtataaccccttcggaatgtaaccttattggaaatgtcagaggcacgtgaaccagagcaactccatcttgaataggggctgggtaaaatg

SEQ ID NO: 472 - DNA, 584 bp, Homo sapiens
gtagatttctgcagatcgcaacaagcctcgactgcttattggcacagtctgcaaagggcctcctccgttccaaagttgctcatcctaaaacctgaaaaaaaaaatgactcagaagtggttcccatctcaagaactacccacgagtctcagtggacacatgtgagtatgagattccccgatgcagccttccaatccagcagaggttccaaccaacttccaaacaggtgcaacttgatggcacctcatttttggctgtaccagatgccttctatctctggactcctgccctcagacttctccgacacctgaagaaagcttctgggacagctgacatgcacaacctgggagctaaaacatgtgggaccagctgtgaccaatgaacaatgatggacaggagacgataaccccattagttccttacagtgctgagataaatttcatgagtctcctagaagatctgatgggattgaacatcagttgtacctagcatggccgctgtactggctttccttccttccctatttcatcccccctcgtccctcctactccttgggatcacattgacaaataagtctcttgcatgc

SEQ ID NO: 473 - DNA, 480 bp, Homo sapiens
ggtgaccacgtcctccggctggcgcagcagcaggaagagcaggaagtcggagatgagcgcgtgggcttcggggtgctgccgcagatagctggcgtggccgagccggagctcctcctggcaggggacagagcccgagcctcagccggacgggacccccgcgccccaggagcccccagccgctcgctccaaggagagctaaggggcgctggagccttctagcccctacgggtgtgcatttcaatcaggtgcctggagtgcaacacaacatgtgagagtgagaatcttcccagaccgcctgctatggactgaattgtctctctaacccccagtgtggtggtatttggagaaaggccatgtgaggacacattgagaaggcacttgtctgcaagctaggaagacagccctcaccagaaaccaaccctgatggcaccatgatcttggacttcctgccttccagcaaatatatttctcttgaagcca

SEQ ID NO: 474 - DNA, 961 bp, Homo sapiens
ggaggaagcggcgagggcgagccgcggggtctcggcgcctctgtatgcttgcacttaacgagaacccagagcgaacacgacccacatttctctttttgttttaagaggaaatataggagttacagcatagaattacaatatctggacattagaaataacaggtcccggtcacggtatggcaccgcgcgacacacttggtccctgaggcctggatgccgctcagcaaacgttcgcggaatagggttgggtttactgtcccccaccgagccggttgctcattcattcagcataattgaatacctcctgtgtgccaggcactgaatcaagtgtcggagacaatgtcctgccctcaagctcctggccggttacttgacaaccttccgggacctcaacgctatgtgcctactgtgtgaaagcaaagtgccaggtggaggacacaaagatggcgagcgacacaggatagtccttaacaattaagcgtgactaattttaataacaaatgagaatatgatgtgacatccgttccaaatcctgtcgttccaagtaacttcttaagcatctttcacgatacagcctctgcttgaaaggaattaaaacaggtacaagcatggaaggagacgttgctatcatatttcaagaataagaaaatgctgttttgtgtggttgtgcagcaggcaatgaaatgagcttacattcaagcttccgtgttttactgaaacaacagtcacagatgcagtagatgttaaaggttgaaagacgagtgcagtaaaagcattatgaggacaagaagaaaacgtaaatatttgtgttgtttcattctttgttgtggtggcagaaacagccccctctttctaaggtaactccaatataatgatctctcccagctttgaaatactccatgtctgtttcattttccagaaatatggaaaaatgaatatataataaaaaaccctatttctca

SEQ ID NO: 475 - DNA, 2010 bp, Homo sapiens
gcgcccaaggtcacacagctgggatgtggcagagctggggttccagctcctgttcccattgctggacagctgccacatctggcacccaatttaggaccccgcggggaggcccaagccccgggggtggcgggggatcctagaggaaagtggcaaggccaggaccctggagcagagccagagtagaaaactgaggctctgagagatgaagctacttgccaaggtcacgcagcacagtcacatcctactgaacatcatcctgttctctgggtggaatgtcaccatcgcccaggtggggatttttgtgtgttttgttcactgctgtacacccagcccccagcacagcgcctgtccaggacaagtgcccagtaaacacttgggaagcaatgcaagcgtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgtgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggaacacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccagtgccatcccagtgcctggcagatggtaagtgctcgacacacattggctgactgcctgaatgaacaactctatgagccgatggcagataaggacactgaggtcctctggggtaggtgaccagcccaaggccacacagctggtctgagattaggccaggagaggagcccgggttggtcacatcctggagttggcgtcttggaaactgcatcaggagaataacaaagatgagacgcaggctctaacaagtggataccagtgactctcgccccgccagccccagccctgcagccttgggcccttccaggagtcatggtctgcctgcctggggcattccaggcttcgacccaggtcctgcactttctattttgagcctcttagtcctgaggactgtgtgttcccagcaggcggcgcgggccagaggctgagcctgggtgtggctgtcaccctatctggggccagagacccagattcccgggcccttaacctgttggctgctgagggctctggcataagccctgttccctgcttgattgtctccccttcaagcccctgccctggtatcgtatcggcccatctcaccttggattatatccctgtttggccccatttgaatcctggctctgcccctttccagcaatgtgaccttgggcaagtcacttcatctctctgggtctcagtttcttcatctgggaaatggggacaataagagtacctgtctctggccatgtgtggtgactcatgcctgtaaccccagcgctttgggaagccgaggcgagagaattgcttgagaccaggagtttgagatcagccctgggcaacatagtgagacccctgtctctacaaaattctaaaaaaattagccgggtgtggtggtgtgtgcctgtagtcccagctattctagaggctgaggcgggaggattgcttgagcccaggagtttgaggctgcagtgagctatgattatgcccctgcacatcagcctgggtgatagattgaggccccatctctaaaaataacaatactaataataaataaaaatgaaaatgagtacctgt

SEQ ID NO: 476 - DNA, 1870 bp, Homo sapiens
tttacacgaacgcccttccaggactctgtctgcttttggggtggaagtgccctgccaaaaactccagctctccatgctggctgtgtggccagcatacctcctgccttttcaacgattcctctgccctggatagagagcggtgtctcataacagtttggaaactacaaaagtttccctggcaggatgaatgattgactcggcaacatgttcttgccttttggagttgccctccaatttttccaggcttgattctgtaaatcatttcatcttgtaaaaatactgggctgtgagcacggatgatctcaaagatgaggaaacagaagctgggatatgtgagtaaacatttccaaggtcctgcagctaatcaatggttgacaacttctttcctctgcctatgttgccatccatgtcatggtttgtgtcaagactctaggagaagtctaccatcagcaccacagctactgtgcacaaatccagaatgccagactgaagtcagaaggaaagatcctttatatattgaaagaagaaagtagaaccatttctgggtcccagctgtgggaagagctcctgtggctgtgaattctgacttctgggtcttggcacaaggtgtggccagcaagctaagctgtcctgagggtgtgcagggccaggggctgaagacagtgttggagcatccacagactggtttgtctcaagaagcatgttactaaatatgaaatagcaaaatctgcaagtgggtttacttttcccccatagattagaatggattcaatattatctctttattagcgtcacttttaatcacttgtataacaagtaggacagaaaggtggcttgaaagtcaatcatgtgagaattccagataaattgactttgctcacaacaatctgttattcatgtgactatcaactgtcatgtgtgctggggcaaaaaaagaagataaggattcactggtatcagatagttccaggaggggaaacccaggattgaactttttcagccttctatggtaaaatttcctgctctgtcggtgcgccaaagcttttttcagtttcctaaactcccatattcaagaagataagctattttctcttctttctcatccttccttgacaaagcaaagcatattttcattgtctactctgtgtcatccatgcttggttcctgtcctcaaagagcttatagttcaaataaaggagagggagcattttacaagggaattaaaggtaaaagattctgaaagccagtttaaaaagtcgtgagggaggggtctgggagaagctgagcaggggtgaaagggtacgaaacattatggaaggagaacaggggagcaccctgactactgggtggaaacaccaatcagtgggtagaaaccacacagtggtaacactgatcagtgggtagaaaacaatgacagcaggtatatgaggcatggaacacttggcttattgtaaagttttcaaaatatgcagtcctttctatccaccaggggttgggagttgtctttgtatatcaaccgtggaagggctgttttggttcatcattctgtggtctacctgggtagacctgatgcagccgtgtttctgaggaaaggaagaacagcttttgttttgtgatatgtaatggtagatgtagtgccatggaatgatgcagatttcattcagatattcttggatcttggccccaggactcactcattcttccctatatgagcattggtagttacaggttttatccttcctttaattgtaagtcttttgaagccaaaaactgtatccaatttgtcactgtctcctaacagtacttagcagtgtctgatgcatcatagggagtttgtaaatgtttggataaataaagggaaaacaaaaac

SEQ ID NO: 477 - DNA, 4218 bp, Homo sapiens
tgaatgaatggtatatgaagttgtttgttgttttttcatctttttggctagctcagagtgtaacttatttacccaaagtcacacaactattccttcacttattcagtcaacagatgtgtttcctatatgtcaggaactttctgtgttctggagataatggtgatctttcctcctatattgttgctaaggcacagacaagcacaggcaggtaatagacataaaaaaacgtgattttatgtgtggtaagtggtattcaagaaaataagaggaatggtatagaatgtggtggaagtaggggatacaaggacactggctaatttagaatgggaaaatccctctgagatgaggatattagagccgtgacctgaatgacctccatttgaagatcagcgaaaaatctatacgagagaaagcagtaagtacaaagtccccagtttgggaaatgcttggcacacctgaggagcagaaagaagggctggtgtggctggagcctaatgaaatttaaattgagaggaggatgtgtctaggccagtttatgtcatgcttgatagaccagggtaagaaatttgagttgtatttgagttgcaatggacagcattggaaggctttaaacaaggaagagacttttttttaaagaccgctggctacgatatagagaaaagactataatgatgcagagacaagttaagttttatctaagtagttatactgatttgttctgagggaaataaagtaatgcatattgtccttttaggttcaatctgagcgaattagagaaggaatggaaaaagttaccaaatagccactaacaatggcctaagattgtgaatgtggtggtcttgttttcctccttacttgtggcattaacaaagtgtatgagcttcctatttgaaatctgtggaatatgtatattgaaatctttagatttttttggtttaaatgcttttcagaattgacaaactgtttttcagttaatttcacatctaaattaaatgaaaacaatctcaaataagtacaattgctactgaaattgtcaaaggaattttgctgaggcaaagcagtgaaaacatttcccttctataaagaagttatgatgcttgaacttaatggctatgaaggttaaaaattttaaatacagattaatctctgtgctagtgtttagagagagatgacatataagaattttttggctcttcatgttattttaaatgctcatgagtaataccagaaacaggctttatttggaaatagatatactatttaagacaaaatttgaagagatttattttaaagtgttccatttctctttgagaaatattttttttctttgcctagatacctggcacagtgatgaacttaatagaagattctgtcctcactatgcatatggtctgtgttgtgggttcttccacataagcaaacaggtgaagattaagccaggccacccatgtgggggatctagcccactgccaagggtgactttttagggtgcttgggcctcatccatccttttataatcaagattattaaaacaatgggagatgctgtatgctgatctccagaagaacaaagaattagttgggtgttaaaccaagaacactaaaaatgcagcagtagccaaaattgctgtgaccaggtataggacagtaaaaggaaggctgtaaaaagaacctctgaggacccaggtgactctagctgttaatgtctgtctgtccttggatattgggaactgaagcagatgtctaagctgtagagctagagttgacatgagatagctctgtctcttcttgggtctgtggaagttgcagtctttatcgagtggcagtgattagaccactctaagacccaaggcttatgaggctggggagcttccagggtgaggaagaagcaaagtactagctactacctcctagaaaagatgcgagaatttgggagtggtgggaggaactgagagaccctgtgatttccagcaacttaaagagacaagcaagaccaggtgtccacctgggaagccatttttacatattttagaatcttggcttattgaacaagctcaggtctattgcttactaagcttctcttcttgctaagtttccaattagtaatttaagtcgtgctgtgaaggattgtatgcagtttgaaactccacagtccagattcatttgagttaacacctctgtatcccatatatgtattctcttaatacatcacctaatatttccaaagcccccccccccagtcactgtcatctggtcatcctctatcttctcacaatactttttcctcatagcactaaatagtacctgtcctcatattaagtgtctgtttattatctgcctccttccctggaatgtaagcttcatgagggcaggagtgcagttttgtttattactgtaacctcagagtagagaagcctggccacatagtagatgctagtattcgtttcctagggctgctgtaacagataccatacatgagttacttaaaacaacagaaatttattctttcacagtttaggtggccagaagtcccaaaccaagatataacaaattatatctgcaaagcctttatttccacagaaccacattctgaggttctgggtggacattaatttggcagggagtagtggggggacactaacctactacagtgctcagtaaatatttattgggtgaatgaaaattcagagtgtattctaagctgtaaaccccttggatgttttcatcacagtcttctcttaataactgctacagaacataaggattagtttgtggtcccagattttttaggctccaattctgcttctaccactttctacttgtgagctcttaggcaagctatttaactttgtaagcctcagtttcttctgtaaaatggtgacaataagaaataacagtaagtgcccaataagttttaactattattatgtgtctatagctattttaaagcactttctatatgtaatcctcataacaaccgtattaggtgagcctattacacttctcattttatgacaaaggaaactagatttgtttcaagaatgaaaaacctagaaaattatatgtcactttatgaagtgcctggcacatagtacatagaatagcttagctacaataatatagatatgtgactttacctcataactttaagacatctcaaattgattcacaaatcagaaaaaaaatctgaggcatcagatgtgaggtgaggtgaggtgaggcatctcagtttttgcacatatggttactgttattgagggagctccatgtcattgagggagctccacgtcattgagggaggactgggtgggatgctggccaaaggtaggggcatatttaggcagtgaaattgcagttatgggacccctctatagcactagatgtgtgagaggactaaaaataaaattcctttgaaatttcttacagggtcatatattacctccttcccaatgactactgtggtatattagagtaggggattgatgtcccagaaatattatgtacatcaaacagaagatctacacaaattgttttatcagatactgaatatatcaatgggctagagtgtattatagtacatatgggtatgttgttttcccccttttgactaaataaactctcccctctctgcaacaggtaaatttccagtttacctttttcttgctgtttttaattttttttattttgaaggctttgtatctttatatctcagctgaaaatattacattctaactccccaaagctattctcacattatttgcaagtattttttcatagtttacatgtttgtgtatttgtttaatacattccacaagactgaaagtcttggtgagggcaggaactctgtctaggttgttcatctggcagccagcaaacccaaaataagtattagttgaatgaatagctaaatagatgagccatggggtagcatatctgttttagctactgcttgcctgttatcatcctgggatgctgcttgcttctccgtgatctcttcttgttcttaaattgtcttcagttgtagtactaagtactaatttgatctgtaatgtgatatgtggctgaagtttgctctgtaaaatcaccgtttcctgaggtatattcaatatctttaatttttccataaatctcttcaaggtttgtgtgtgttttcttttaaattatctaactagttggatgtatgcttgaagtgctagacaataaaagtttcaataggcta

SEQ ID NO: 478 - DNA, 185 bp, Homo sapiens
cctttttggagacagattcgcagtggtcgcttcttctccttggatttgttaaggattccaagtaactcttatttggtgagtaaatctgctaattgttttttgcttatcagctctttgtcaatgatttctgtaatggaaataggattgaagagacttttattctagttggtcaggatttacctctg

SEQ ID NO: 479 - DNA, 1610 bp, Homo sapiens
ctgggaatcaatgtgtgaggtggtgctatgtagcaggaacccctcttgctttgcaaatagttttttgtttgttttcctttttgcccaatagagccctgctctactgacccttcaatgtgcccgtgtgcctaaatattcctggtcgtgtgaaaagaacccaggtattagctgaactaaggagcacaattctgcaacattttggcacccaaacacggggcttgagaaatgaatgcaattggagaaactggttgttttaccaggcgttgattggaaatgtgtgcttccctttaagcagtcaagctcaacttgcagaactgatgggaaccccttgggaaaactggcctcaaatgtttgtctacacagtccacatacagggttcttaacctgcggaaacactttctgaaaatgtcagaactcttgaaaacatggatgaggaaaagcataagtactgctttatgcttttcttatgaattttaaaagatgtaatttaaaggtactttaaagtgatatttgtgcccttgtaactgattcaaagtagactgctaaggacaataagtaataagagtctacaaatatcagtaaattatgagaaaaaacggtctaatggtacttaaaattgcattgtgatttattaaataacattgaacagctccacctgtaacattaagattccatttgagcatatagaaaatatatttatcgcaacctgaagtgatttggaaagtatgctgggaagaaaatatatttacaaattagtctcagagggtaggtatcctgtagccagatggaataagaagagagggaagggagattttgttcaaagggggagcataagctaaggaataaagccacaaacaatgattaaattaggtaaagtgcaattagctgaatattgcataagcatacatatgggaagaagtggaaaaaggagtgacaatatgaagctaaagggtttgaagtgttcaagataatactaggcttcctagcctattccgagacatcttgttttagagtgcaatagataagaactctaaggatgaaagtaggagacatgcattctagtctacgttttggttaatggactgaaagtgaaagatggactgaaattgggggatggaataaaaatgtgatagaatagaaaatagaaaaagcaattagcctaatgtcattgatacttagagaaaatatggaaaatagtaaattagtgatatatatcttttctaattcaccagggtgagtgaacaaaggaaatcggatttaaaagtattcatgacatagatgcaataaggtttctcagtcagacatagcaaattgagggaagggaagatttagaggattggaaaatgtcttgcttgtagactaataggatatcaataagccatatgagcaataatttgaaatagtttttgtaaagtatcatgaaggtaaaccctgtttagaacaaattagatttgaagtacttgtgacaaatgcaattgacaatgcctttatgcagctggaaaattgttgcttagcagaaaagcttgtgctggacaaatagatgtccaaattgaatagatgttttcttaagctgaactaattgagacaaatatccttattaaatcaaaaaa

SEQ ID NO: 480 - DNA, 444 bp, Homo sapiens
gagagagctctctggggtctctttttgtcaggatgctaatcccatcctgggggcctcaccgtcatgacctcctctaaccctaatcacctcccaaaggccccgcctcctaatactatcccacggaggggttagggcatcaacataagaatttggagggggccacagttcagtccacagcaggatgtgtgtgtgtggagtgaagcagactgaccgggcctcaacatcacctgggaatcctggaaggaaacaggttcctgggccttgctccaacctaaggaacccgaatctgcatagctcacatggcgccgtatttccaacgttcagagcacattggaaagttgggaggaaggatgaggcttgtgttttcactcacaaactccctccagaagatgataatgaaagtgtctgacgcataaggaaataaataagatggttatgtgccca

SEQ ID NO: 481 - DNA, 4083 bp, Homo sapiens
tacacataacctagcctatttatttgtatctaaaattccctagccgcaccatcaccgtaaacaccaagggaaaaaattaaggaggttcctggtgggaaaagggcgagttggggggacagggtgtctgcgaggtgacgggatacagaaaactagggtgtcaaaagggagcaagaacctgttttgggggcaacttaaggatccaagtgtcacggggtctgggcaatgcaggacgggaggggctgcgtgagtgagtacagaagggaaatgagtgagggggcatgggatctcagagaaaatcagggccctctgagcaaagtggaaaggacgaccgccgcagctcctcgggccgtagctcgaccccgccttcccttttgcgcagaatcctcgccttggctgcagcagcgcgctgcccccactggccggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagccccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggaccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggagatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacctaaa

SEQ ID NO: 482 - DNA, 328 bp, Homo sapiens
accctccccccacctccccttcttggccttcgccagtgtgggagcctcgtctcactggagagtccgttcaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctggggctgcaagctttccagccaaacttatgtgaagcaaagtagttgcagtttgacaaagaatggcgtttcaataaatgacatagtaatttt

SEQ ID NO: 483 - DNA, 2272 bp, Homo sapiens
ctgctcaccatttctgagccgatgaggactcacctgggctcctcactggtcagggaactgtggcccagccgcagagtgattgctttgtcaagaagggaaacatttacctttccttcttccctctgctctctcctaattaacaattaaatggaaggagttgaaaagacatgtcagagacttcaatctcctcccggcctgaggatgaagggggctcgaacctgaatgttctcttcgctgtggccagaacctagggggctggggttgctgccagctcgactggaggcctgcttccagccccaggctgtggtgaggggcctcacagatttcacaaacaggagggcggctgaccaagcgccaaactatttagacaaacacacaccctcccttcccgccagagtttgggctgatttctcccaatgctaatgaacagctcataagtattaatagactccttggcacctaggagtcaggcagagtaacttccagtgtgaattttggccaaggaccctgatgcagcctcaggatcttccaagcccctgttgagtccagggggcatgagacacacagggaggctggggctgctcccaggaagcaggctcacaagagccagacaggctcccacagacagcttttaggtcacagaaacctctgcctgccaggtaggcatgaacacagaaaccctcccaaatcctcagactgtggagcacactccaggtgagccaggatcaatccctggtctcagagaacacttagatgggggtgaaaagcaggaactgagagcttcccacccagcacctgtccctgctaccagctaaacctgtgtcggtcagtgcaggaattgtacaggtgatgctctgagcctgtgctgaggccatgtatggactgaggaaacctcactgtgtgtatgtaaagttaattcaaacctatttccctgagtgcttacatattttcataaggaaagttctgttaggagagctgcctgaaacaacacctctgcctgtgctcccactttctcccgctggtgtggggaggagaggctgacatcgctgggtccacgttcctctgccctgggtggggtattaatgctgccattcccacgctgcctgctgtttcccctcatcctcaggagggctggtctctgtgctgcaggcagctccaccaggcctgggagcatgacaccgtctgccaatgccttgcccaggtccactggcctcacccttccgcaggcctgcgccttctgtgactctctgcctcagcaatttctctggatttctttgtcctcaggaatgtgctggggccacaggcaggtcaggccaggctttctggggagtgaatgctctctgccagtggcggatggaactggtagacacgtcccccggattcctcgcctgcaagtgggatggtgccaggaaagttctacaccatccttcccaggtcccaggaggacaagcacagttgtccacaagggaaccaagaggatgttgaaaaatcctggttggatctgaacttggaaacaaatttgaggaatctattttacttaatcctactgaaaaattccctaatgagttaaagaagaacaaagtaaaagaagataaaaaagcagttggtacttgaaatgaagatcaaatcatcaagtcctatatgtcacccacagatctgagatcactgactcccagagacacccagtttctcagtgtcagtacacactgcctgggttagtaagcacaggctgagacctgggaggaattgatgaaccaaatgtgtctgggcttttcacttcctcggcatgagtcagccaagaaagcccacctctcctccccagcagcgtgcagggcctctgcagataaatgtgcaggatagcagacctgggtgtggtgctgcctggcactgagccagcccccagattctttggctgcagagtggcctggccaactcacacaggtagcgcccttttattcttggaaaaggaagcaccaggtggaaagggaggttaaaggagggaacacaacttttttccagacccctctgcccaggatgttaaaggttgctggaaaatgcctttggtggctttaaatgtcacagatgacatattccaggatggatccagcctccactggacttggcccctctattttgattcctgcctttccccagcctcagccctgagcggcataatatctacacggggttagctgcaggtggaactcagaacacagctcctagacaagtagagtgaggcctatggcttcatcatcaaaatgtaaaatttaaa

SEQ ID NO: 484 - DNA, 287 bp, Homo sapiens
taataaatacaattccggatttattaaaaatcagggctcccctgctgtgccctcctggcactaaggaaataaataaccagagggggcacagctaggtaaagggggaaaaaatcagatctcaagacagactctttgaactaccctttctccctccccaattcccacccccttatggctcttgggacatagcacctgagcaggcacctcagtccgtgtagagtgtgaccggcaccaaggcatgtctgccctacccaagaagggagacagggctgaagcaccaattggag

SEQ ID NO: 485 - DNA, 9557 bp, Homo sapiens
ccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaaaaaaattagccgggcgtggcgatgcatgcctgtaatcccagctactcgggaggctgagccaggagaattgcttgaacccgggaggcggaggttgcagtgagccaagatcgcgccactacactccagtccgggcgacagagcaagagtccattcccccaccaccaaaaaaaaaaaaaaaagaaagaaagatgatgtgatacatatcacatatttcctaacacccccaaccaaacacatttatgcatatgcataaagcagacgaggaaagattctaaataggctctgaatctcagttttctcatctctacaatggggcagtgatggcatgcacctcccagggctgttctgagaatctgatgcctcccattgcactggtgagcctggcacaggcacaggtcccaccccaggccctttgaactggctgttcctttggcctggaacattcctccccagatacctcctgagagggctccctcacttccttcaaggcactgctcaaatgctacctcttcacagaggctttccctgaccaccccgtctctttcctcttcctgcatagcctctgtcacctgacattttatgtcataaattactcatttattaatttcctgctctcccacagtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcaggtacgatggtgattattattgttactggtggcgctctattattgttattagtgtctgttgaaaaagaccctgagctataccagcccttggttctccagcctgtgaaatgggcatcctgggcactgaggcactagccttgggaagctgatagggggtccctgcaggagagacaaagaacactgcccacccccccgggggagcctgcgcccctcaccggaaagagaagcaggggggagcagagggagcttgcagccccacacgcagggctgccagaaggccatacataattcattgccaaatggggctgcgggcggctctccgcggcgtgcgctgggggctcactctgcgcctggcacttcgctgactgcgcctcacacgttgcctcattgcatcttcatggatttgcagggtgtgacccttccccctgttttacccagggggatcctgaggctcagaggatggggccaccgtgctagtcacacagcctctctgtggccaagctgggcctcgggccagcagattcggcccccagcggcccccattcactgcctctctgctgagggaaaagacgggcctggggagcgggtgggaggcacaaaggagaccccgctctgagacaggctgcagaagagggagctgggtctcagcagggctggggaaggctctggccccagccctccgcccaaccccctgccctcctctcctggaggagatgctccccaaattagccatcatgagcgctggctctgggggttgggcgttggggagcagtttgctcagctgtaaaatgggaataacagaagccgtccctgggactatgagatcaaggtgctcaagaaaagtggtgtctgctgaggggaaaagccagtcccaaaaggttgcatactctcattctgtttatttgtttttgtttttgagacagggtctcgccctgtcacccaggctggagtacagtggcgcaatatgggctcactgcaacctccacctcctgggctcaagtgatcctcccatctcagaccctcaaggagctggggctacaggcacgtgccaccgtgtccggctaatttttgtattttttgtagagacagggtttcaccatgttgcccaggctggtctcaaactcctgagctcaggtgatccgcctgccttggcctgcgataaaattgcacagaagtaaatacacacacgtgaggatacggaaaaccggggaaacctgagcaagagcagtcagaccccggctgtgatggcgcccagtagttctgcgagatgttaccattggggaaactgagtgaaggcgggtacctgggatccctctgttttcttttttgttgttgttgttattttgagatgaagtttccctcttgttgcccaggctgggtgatccacctgcctcggcctcccaaagtgctgggattacacgcgtgagccactgtgcccagcctctctgttttatttcttctttttttttttttttttttggagacgctctgtcgcccaggctggagtgcagtggcacgatattggctcactgcaagctccgcctcctgggttcacaccattctcctgcctcagcctcccgagtagctgggactacaggcgcccgccacctcgcccgtctaattttttgtatttttagtagaggcggggcttcaccgtgttagccaggatggtctcaatctcctgacctcgtcatccgcccgtctcggcctcccatagtgctgggattacaggcatgagccaccacgcccggctgttttatttcttataactgtacaggaatctacaatgattgtaacaaaaatttcaattaaggccactctaggcacatggcctgtggggtagccctgctcaacaagaagccgtcaaaaaaatgttttttaattaaaaaatttcttcaattaaaaagcgttatcttcctctgcccggaaagggttaagtgagtcactgcagttagctccccttcccccacaaccacctagaccaggccagggaccagcgggcaattgcctggcagctggagttttcctccactgtggactgtacttcttgcgtcactctgaatgtctccagtctttattccagaatgttctggtcctctcccacttttccaaggacaggaattccctagtggggctccagaagaggctctggaggagaacaagaaaggcccttgtcatccattggcctcaggctgggaaatctcggttccactcccagcccagcctcaatattaggttgtcagtctggagtctgagagccatgcccccacccccttagtccttcacctccaggagagttggggatactggaaagaatgttgagtgtcagagcccctctcagtggctcacgcctgaaatcccagccctttgggaggctgaggcaggtggattgcttgaggccaagagttcaagaccagcctggccaacgcgacgaaaccctgactctactaaaaatacaaaaattagctgggcgtggtggcacacacctgtaatcccagcagctcgggaggctgaggcaggagaattgtttgaacctgagaggtggaggttgcagtgagctgagatcacaacactgcactcaaaaagtagttaattaatttagtttaattaaaaaagaatattgagtgtcaggcaatctgggtagaacccattgtgtttctacaggatagaatctgctgtgttctctagcggaacttccggatcaccttcaccgtatgactctagacaatccctgtccactcttcagttttagatgccccattcaaagaatgaaagaattgtcctagatgatcctttagggtcttccaggctgatgacaagggggacctggcccctctgctgctggccaaagaggactttacttcccattccgtgtggttgaacaagaattgctgggctccagtcctgcctttggcccttccctacatgtgaccttgggccctctttgcctttcagaatcaatacagtgagagagttaacacaagctcaggttagtaagtcattcaacaaacatttactgagcgcttatcaaatactgcatgctggagtggacactggagaaaaaggtgaggagaaggccgggcgcagtggctcgtgactgtaattccagcactttgaggggcagaggcaggtggattacctgaggtcaggagtttgagaccagcctggccaacatggcaaaaccccgtctctactaaaaatacaaatattagccaggcatggtggtgcatatctgtagtcccagctactcaggaggctgagcaggagaatcacttgaactcaggaggtggagcgtgcagtgggccgagattgcacctctgcactccagcctgggcaacatagtgagactctgtctcaaataaataaataaagtgaggagaaaaaaataccatctctgtcttcacagaacttatagtttgagaggggagaatcccacaagtaaattataaatctcagctgagattatgcaaagaagcaaaggccggacgtggtggctcacgcctgtaatcccagcactttgggaggccgagacgggcggatcatgaggtcaggagattgagaccatcctggctaacacggtgaaaccctgtctctactaaaaatacaaaaaaattagctgggcgtggtggcgggcgtctgtagttccagctactcgggaggctgaggcaggaggatggcgtgaacccaggagcacaggttgcagtgagccgagatggcgccactgcactccagcctgggcgacagagcgagactctgtctcaaaaaaaaaaaaaaaaaaggaagcaaagtgcccagctgggatggtggtttcagaggccacagtgggagcttcccagagaagggatgattgagctaagtctaagcaaaaggggtggtcagggcagcagctgctccaaaacaggggctgggggcttatgtggagagagaagacatggagagaccatgcccagaaggaggcggcggcttcagtgaacagtgcaggggagcaggtccgaggaggccgcctaccaggggaaggagtctcatctccatcctagacaaaaaaaggatcttttgagatgcattaagcaggggagtcacagattggatttgtgttttgagaatctcctgcttacctagagaagaagggcatctcctgggccctcactgttgccttaaatgatttttattgtgtattacttaaacatgtgcaagcataaaatgagatataaactccttgtagctcttatacaagcatcagaccaagacaaattgacccatcacgtacaaaatcgattcaaatcagattaattttatgtgacatgttattatgccttttgtctgaaaccctgccaccacccacagtgcaattatggcccaaccactgtggtgttctgaatttgtgggacagagaatattggccttttaaacacgtgcatgcatgcatttgcgtgtgcgcacacacacacatcccaaatgattttttcccactatatatgaagaactcctacaaaccaaaaagaaaaaggcagacaattcaagagaaaaatgggggagggcttgcattaaagtacttcataacaagagtacttaggaggccaacaaatacacgaaaagctgctagcttcatgactcatgggggtggcttggtcagttcaggatactgtaacaaaataccttagactgggaaatttataaacaacggaatttattgctcacagttctggaggctgggaagtccaagatcaaggcagcagtagatccggtgcctgagcccgttccctgcttcaaacatggcaccttcttgctgtatcctcacatggtggaagggggaagacagttctctggggcctcttttataagggcagttatccaattcacaaggatagagccctcatgacctaatcacctttcaaagatccccatcttctaacaccttctaacaccatcaccttggtgattaggtctttttgttgttgttgttgttgagatggactctcactctgttgcctaggctggagtgcagtggcgtaatcttggttcactgcaacctctgcctcccgggctgaagtgattatcctgtctcagcctcccaagtggctgggattacaggcgtgtgccaccatgcccggctaattttcatatttttagtagagacagggtttcaccatgttggtcaggctggtctcgaactcctgacctcatgatccgcccacttcgtcctcccaaaatgctgggattacaggcatgagccactgcacccagccgattaagtcttaacgtatgagtttttgggagaaactcaaacattcggacaatagcaaggagaatacaaaaccacagtgagctaccgcttcagacaccagagaagtttaagtgaaaaagactggcaataccaagtgctgatgaggatatggagcaaccagaactctcagacattgctgatgggaatctaaattagtataaccaccacgaaagcatccgtaaggtttaattgtgttgaacacaccctgccctctgaccaagcatttccactcctgggcatacaggcaaaagaaatgcatccacgtgttcatcaaaagatgtaacctgtgccaggtgaggtggttcatgcctgtaatcccagcacatcgggaggccaaggagggaggattgcttgagcccagaagttcgagagcagcctaggcaacaaggcaaaacctcgtctctactaaaaagtagccaggcatgatggtatatgcctgtagtcccagctactcaggaggccaaggcatgcagattgattgaacccggaaggtggaggctacagtgaattgtgatctcgccactgcactccagcctgggtgacagagcaagatcttgtctcaattaaaaaaaaaggaagaaagaaagacataacctggaatattcacaccaacactattcaggatagccctaaactggaaagaatctgaatatcctccggctttagaacagagagaaattatagactattcattcatacaggggatgattgatcagctttaagaataaacaaaccgtacacaacaatatagatgaatctacaaccttaatgtgcaaaatagttcacatatataaaggacaaaaacaggcaaaactactccatggtgttagaaataggggtagaggttaccctcatgcggcaggagggttagtgataggggatttggaagaggaggagcccaatggactgaacagctgagctggaaacagcaatttgttccttaaagttctgaacccaactgttatccagcatggagtctgtctggagaggccagatgtggggcctctcacaggggaatgagaagtgcctctcagggtcccacccatgatccccctttccttgcccacacaaccaccaactggcaagtagtaacccaggacctgtagcccccactggcttgacacagagcataatgcaagcttttcctgctccaggtcctggacaccactttgccctttgccccacacgtacagccccctgaccaaaagctgggtactctggcttgactagagggagctagactccaggaataagtaaggagctgggcttccacgctagagaacaagagcttctctggggaaaggggcttcccatgaagccctggggcactgggagattaatgggcagacctctggcctcagcttccagggaaggggagggtgtgggccaacatgcggtggctacactgaccacaagccgatgaccccagccagcctcaggatgtctcagctctaggcatggtttttcgttttgttttgtcgtgttttgtttttgagatggaacctcgctctgtcgcctaggctggagtgaagtggcaccatctcgtctccctgcaacctccacctcctgggttcaagcgattctcctgcctcagcctcctgagtagctgagattacatgtgcgtgccaccttgcccagctaatttttgtatttttagtagagatagggtttcatcatgttagctaggctggtctcaaactcctgacctcaagtgatctgcctgcctcagcctcccaaagtgcaaggattacaggcatgagccaccatgcccggcataggcatggttttgacaatctgtctctttgtgccctggctccttctccaactcctctttggaggaggcacaggaggaggggtcatttcactgttcctgaaaagtagacatataacctacatgcaactgccaggtgataagggccccatctgtctggcatgacgttggaggtccacaaaggctgattagatgaatgctcagctctggggcctccccacagagctcacagacaggcgtgaaggaaagcaggactcttattagaatatgttcagagttttcactgaagaagcctcctgtgtgggccaggcactgtgctcagtgctttgattcacagtctcatttaattctcaccatttacagacaagaattcagctaagatccttttcaatcaagtctggcaatatctgcctttcaatggcagtgcctagtcctttcatatgtaatatacttatcattatgggtgggtttaagttttatcatcttgctatttgttatctatttgtcccccctcttttgttcctcctttactgccttctatttggttgagacttaataaaatattttattccatcttctcta

SEQ ID NO: 486 - DNA, 744 bp, Homo sapiens
gaggaacctacagcagagccgttagatcattggcaagtcctccaggcgacctcgcccaagttgggcaagagcggctccccggctggccaccaaaaatcgggcctgatctgatttggtttttttttttttttgagttttgctattgttgcccaggctggagtgcaattgcgcgatctcggatctcggttcaccgcaacctcggcctcctgggttcaagcgattctcctacctcagcctcccgagtagctgggattacaggcatgcgccaccacgcccggctaattttgttttttttttgttgttgttgttgttttagtagaggcggtgtttcaccatgttggccaggctggtcttgagctcccgacctcaggtgatccgcccgcctcggcctcccaaagtgctgggattacaggcgtgagccaccgcgctaggccaagaaggatgtattttaagaaagcttcctgttcaatgttcccctgctctgtgcgcttctctgggcggtggtgttaaaggaagccccttcccttgaagtatcctggtgttcaaagaatctttcctctatttacaaattataaaaccccgttgggaagaaataattagatgtcattattggctggtcctggtggcttacccctataatcatcctagcatgctttgggaggccaaggcaggggaggatcgcttgagcccaggagtttgagagcagcctgggcagcatagtgagaccgccatctcttaaaaaag

SEQ ID NO: 487 - DNA, 1715 bp, Homo sapiens
ggcttgcaaagcggtagggagacgatcgggccgctggccgctgtctcggcgttcagcaatagaggccttcccggatctcccgagaggcggggagcgagcctgggtccagcagccttctccctcccgagaacagcagaaaggggggactcgacagaatgacctctgtttccccaaggaagtgcactctgacgataacctcgggagggacgagaagggccgctctttcggagagcggccgccgcccctggagtaggggactcagtggccacgaaggccttccctgctcgcgacctttccacgggaaggcacgaagcttccgatgggggccccggggcgctcctgacttttctacggcgcgagggctctgactctgcggttcaggtttgaaagtcctttggaagctcgcaagtggtggtctcccaccacctcctcggtcatcgcaggaagaaggcgcagtgagggcgggagtctggatgagcggagagtagccaccgcggagaagagtgcgggcttgcaggagccgacgaagataactcgaaatgtgggcaggcaggtgttggtgggtcttgaaagtgggaaagcacgagaaaagaacaatgttcgcgtccgcttagaatacggaaacaagtgagctttaaaggaaaatactcattctcattacccctgtccaggaagaagagtgctgatctgctgcttccagtccgctgggctggagagcagaaagaggctacttgatcccagccaagccagtgtctgtcccccagcaagcacttctgccttggtgtgatccccattccttttctaaaaatacaaaataataagaagtcctggaaggaaatacactaaaatgttcccagtggttaatcatgcgtacagtagtagattatatgcagctttcattttctgctttagacttttgtctattttccacaacttttctaaagtttctacaaaggccatatatttccaccataagcagaaaaaatgaaaacgtaagcatttaaatggcacatacaatataatctcaatagtataaacatgcatacaaaagacaggaaggagatatgaagaactgctaacagtatgttatttttcacaactaggatatagtctcctgtcctgctttacctttcaggtattttcatctgataaatagagaaacagtttaaaataaattcagtcatcctgttcaatagccaagaggttccaaaatgagataatgaatttaaaagccttcgggaactataaagaaaagtaatgcattagtattattttgaagataagtttacaatatttcttactgtaaattatcaaatcacttttgggtgcattgtcagtctttctgtacatggattcgtttcactgtggcaaaggcaacttgcagataagctgataaagattccagaactacaaatcaaactaggccctggagtagcagtaaaattccaaacccaaaggcccatccagtctgtccactacattcctatattgatgagagcagaacagacactcatgagagacatgacttctgcttcccccataactaagaagagagattaccatactgatgatctccctggaggtttcatagcaaggtttgacttgatgaattaattaataaagctaaatatcctgaagatttggtggaaatatgctttgacatttacatctaagtgttcatccgtgaaaatcaataaaatattttttcatgcaga

SEQ ID NO: 488 - DNA, 283 bp, Homo sapiens
ggtattttaaaatatttggtagtcacttaaaatgcataatgacagacaatagggtgtcataatatggtttattaatcttttttcattttccactagatgtggcaactacatagttggaagaaatgtggcggccgggggcagtggctcacgcctgtaatcctagcactttgggaggctgaggcaggagagtcgcttgaacctgcgagtcagaggttgcagtgagccaagatcgctccacttcactccagcctggtcaaaagagtgagactctgtctcaaaaaaa

SEQ ID NO: 489 - DNA, 414 bp, Homo sapiens
tcccggggacaactttgcaaggccatgtgctcgtcctccttaggaaggaagagggagaaatccctgcggctcggttttgttccaatggtctgctcagcgagtgattcccgtttccccaaaggctgcccctcattagcatgaacgggggtgggggtgtggagaaggggttgggggagagaaagcaagcaaaagaccaggctcacttttagagcctgggaaccctgtctgcaaaaatgacagctagagctttctggctcctctgtttgatcgtcggatcatcccccgaagcaccggtggcggagagaaaaacctcgccgccgcacagcagaaagccggactcccgcggctgcccgagcgcggaggagacaccggggccccgcgcgcagccactccttgaggccccgcagcggccgc

SEQ ID NO: 490 - DNA, 526 bp, Homo sapiens
atcacctggtgcccggctcgcgcggtcagccctgcgcggcgcttctctctttttattcttttgcctgcgacgggcagtgggagtcgcggggtgaagactcctttgaggctggagggttcggggcgtccctgccctttggtaggacactgcggctcctgcctgggactcggcgccggcgagcccgtgcttgggccgcgggtctcaggcgtcttttgggcagccacattgggtcataagagaatgagctcaagcgactgggtccctgagcgcctttggacgttgtgtcctgccgaggaggcttaggctttcccgtgggtcgagggtcctggtgacctccgaggccctccaaagaatttcatcatggtgctttggatgatcagtaacaagaaaaatgaaattctggattgaggatgagcagtccaggaatgacctctctacaactagagaaagaagaatgcatgcaatgtgttccctgtagtccaagaaccagggtagccctgctggagctctacagagccatgtgcca

SEQ ID NO: 491 - DNA, 1260 bp, Homo sapiens
ttttctcccgccttttctcctagatgtgccttgtttgcaaaatcatgtctatcatgtccacgactcgcctcaattttttttcttttgtttttgtggcactttcattctctctcaattcttcaaattcacatggaaaccaaggaaaacaagctccgttttgctttcaatattgatgcatttctgctctaaggctttgacaccaccctgggtggctgtgtcaagagatgaaagacaaaatgaaagaggccgcggaagcacagactggcagaattccaaaacccgaaaaacaagcaaggcaccaaattaacaagcccaatcacattggttacatttcccagtattatcgaagatcaagcaagaaagaaaaagacagaaaacaaatgcgaaaccacagcttccttggctctttttgcccatatgccgaagagccgagcattgccgccaagcattggcaccggccatgcggagactagcgaaagctttgcaattcctctacttctcagtgatgactcgggctttctccttacattcttgatgggcatgaccggtcctgtcagctgggtggccaatttctgttcttcagcagaactgtctcccttcttgggggccgagggctttctggggaagaggatgagtttggagcaatactcattcagacgctgcacattggcctgcagggaatcggtggacttgttctgcctcctcggatccacagagatgccagtggtccgggtcaccttcttgtgaatgcccgccaccctgagctccaggctgaagcctctgccggcgcgcaccttgatgtgataacgcacagcagggcacagcacaatgggccagatgggtcccgactctccgggcgcggggcgatgcagcgccctttggcttgccgggccttgattctgcggatcttctggttgaaccacgtggccacacgctgctgccagtccttgtggaagtggggcttcaacatcatgccattcctgctgggcgccatggctgcctacggccctcctacgaaggaaacactttatagatttctatagcagtgttacatagtaaggttttatggcgagttttgtagcatggatcatactaccttaggactgatggtaaagttttagtctaaggaaagctctgaaaatttgaaaatgtgtaaccacccaatgagttcagcttgcccactgcctagacagaaccatttatcaagacgggcatgcaaagccggctgtgtgggagacccgttttattattattcaaatc

SEQ ID NO: 492 - DNA, 1937 bp, Homo sapiens
attacagatgggccatgggagtttttccactacagatatttacgtttataaatcacgttgtcttcttagaaaagtcagaaggaggttaaaacagtcaagccacagacctgtagaaaatatagtatcaacaactctcaaatctgaaaacaaacacccagtaacaaaatgggcaaaatatttgaacagacatttcaccaaaggaactatacagatgaacattaaaagatgctaaacattgtagttattagggaagtgtaaatcaaatccacaatggaacacttttacatacttattacaatggctataaaaccctgacaatatcaagtatggcaaggtatgcaaagcaactggaagtctcatgcattgctgatgagaatgcaaaatgacagcctttttggaaagaagtgataaggacagaaggcagggctttactgggtagaagagggtggttcactggcaaaggtcccaccctcaagccttgaaaccgaagccctaaatgagaacagttatccctgttatcctgcccaaatgttactctttagcctgtccagcccccctatcccgtgcccatataaaccccagacctcagctggcagacagacaagcggctgaacatcaagaggagaagaagcaactgagtgtcagagatgtggcttaacttcaggtggcatgacttcagggaggagcccggccagagacagcagacttcagggaaaggtcactttcttcctgcaccatcccctttgcagctccccttccactgagagccacttccaccatttaataaaatcgtccacatccatcaactttcaaaccattcatgcaacctgattcttcctggatgctgaacaagaacctgggtaccaacagggcagggtgtaaaaggctgccaccctgactctccattgagtgggttaacacttagctgtccacggatggcaactgctaaaagagcatgaattgtaacacatccctaaatgctgctgttgggctggagcccaaaagtgctcatcgaagccctggcacccgcttgcctgcgtgctcccgctcccacagagagtttgagcatggtggtggccaagtaagtaggccacacccctgtcgcaagtcccgagaaggggtcaagggaactctcccatctcagaagtatggcaatttcttataaaattgaacatagggttactgtacaacctggcaatttcactcctaggcatttagccaagtgaaacttatgtcctctaagactgtgtgtacaaatttttatatgtgctttactcataatagccgaaataccctggaaatagcccaactgatcttcattgagtgaattgctaaataagctctgtgttatattacatccacacaacagaatcctgaccatcattgaaaaggagtggactattaatacatgcaataacttggatcaatctcaaatgcattacactaagtgaaagagaccagacttaaagcctaccttctgtgacattagagataaggtgaaaccacaggaacagaaaacatattagtgttgccaggagcaaaaggtgggggaggtgttgactttcaaagcacaggaggaaattttttgttgttgttctttatcttgattgtgttagtgcccacatgactgtatgcatttctcataattcacagaactgtatactaataagggtgcacttcactgcacataaatgaatctcaacagacaaaaggttaaaaaagaaagaaatctcgggacaggaatcatggatttttgtattatccttgtatttgatggttgtttccagtttggtcactcatctgtttgttcattcctttaacaagtatgtgtcgagtgcctactatgtgctgggcactgtaggttcaatggtaagaaaagcagatacaggactgctcttgtgaagttccttgaaagaaataaaacaaagtgcaaaata

SEQ ID NO: 493 - DNA, 1569 bp, Homo sapiens
ataccgggtctcacactgtcaccgaggctggagtacagtggcacaacctctgctcactgcagcctccacctgccaggctcaagcaattctcctgcctcagcctcccgagtagctgggattacaggaagtgagctcacaatgactcaagctgccacatactgttgattgtgaaatgccagttgaagcatatgtcctgcgagcttaggggtgctacaagttgaccactgcagcagtaaagatgactctgaagaatggcgtgggatggttcctttcaaatgcacttgagcagcggtctccaaccacagggccacagagctggagctggatctaccatgaaagacttgtgaatccaggaagagagactgactgggcaacatgttattcagaatctccctgtgccatccaggctggagtgcagtgatgtgatcatagctcactatagctttggccttctgagatcaagcaatcctcccatctcaacctcccaagtagctaggactacacatgcatgtcacccatgcccagatcatttttgtagagtcagagtttcaccgtggtggccaggttggccatgttggccagatggggtcttcttttgttgcccaggctggccacaaattcctgggctcaagttatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcgaaacgtgagtaagcatgga

SEQ ID NO: 494 - DNA, 648 bp, Homo sapiens
gctgctcgtcttttacggcccttcaacgcccaccacgacccactcctcttggagaccccgggcgacggtggggctcttgggcattctgagactgcgcttggtggagaccccgggcgacggtggagctcttgggcattctgagactgcgcttggtggagccccctactggccagactggatttctcagcctgcgactcagccccaggctacacgaaagaagccagacctggcttttactgcctcctgaggccttcgtcttgttcacactgagtgtccagtccctccaaatccggctacactctactggcaaggagcacctgggccatgttttagagatcatccgaggactaaccccaaaagtttatgaagagaaagcagaggccgagctgaagagatggacccgggtcacacccaggtaaaggcaggatctaaactgaaactggtgtcagatctggttgccttgcacccctgatatcaggtgaagcaacactgggcaggatagagcagagtgaggtcagagtgtgaagatccagcctgatgcccaaactgacgcctcttcattctcccctgctccatctgtaaacgtcacggttaatccatctactttattgcattatatagagaaataaatgaaatgtcatagctgta

SEQ ID NO: 495 - DNA, 1207 bp, Homo sapiens
aaaagaataaaagcaggctgcccgagccggcagtggcaagctgctgggcttcccttccacattgtggaagctttgttcttttgctctttgcgataaatcttgcccctgctcactctttgggtccacactgcctttatgagctgtaacgccacgaaggtctgcagcttcacgaacccatcgggaggaacgaacaattccagacgcgctgccttaagagctgtaacactcaccgcgaaggtccgcagcttcgctcctgagccagcgagaccacgaacccaccagaaggaagaaactccgaacacatcccaacatcagaagaaacaaactccaaacacatccgaacatcagaaggaacaaactccagacgcgccaccttaagagctgtaacaccgcgagggtccgcggctttattcttgaagtcagtgagaccaagaacccaccagttccggacacaatacttttcacactgcatgatgaagaaatttagctttattgttagggaattcctgaagattctgaaattgtgaactgacaagcccatggatgtctacaaagagtgaactgatcactgtgggctggcctttgaggcatcagtgagctccagtgcctgggacaatgcctgacacttagcagacagtcagtgaatgtgttatataaatgaatgaatacttggagcgtgagaatcagagcggcaaaaatatttgtccataatatgcctaaagataaaaacggaagcctcagaactagataagtgcattgtaattgaatgctgaattcacagagataacatctgagatttattaagcatcaagtcatgtcttaaaaattttatatacattttaggatttaactcttataaaaatcctgtgggcattgtggctctggagacctggaagcactgctaactgttctctcgattttctgacgctcggccacatcaacctgtcatactagttgtgaggagaagtcaaggacagtgacacagccagccagtctgaggcattttccatcatcctgaaggagttgccctatcctgcttttcactggagggggcatggatgggggctcctgacacactgacctctgtcagttccttcagcacaccaggctaatccccagtcttgcgcctttggaccagaggttttctttgctcagaatactgtttcaacagatctttgcatagctggctctcgctatttgactaaaa

SEQ ID NO: 496 - DNA, 131 bp, Homo sapiens
ctccatgtatctttgggacctgtcagccgtggcagtctcccttcctagccatggaagagcatatccttgtttattggcaaagctgtcaccatttaattggtatcagattctgacttgcacaagtaacattc

SEQ ID NO: 497 - DNA, 766 bp, Homo sapiens
ggttaagggagaagtgatggaggcgattcgaagctgtctttcctaccctcttcagtacctcttccagtgatgtgaagttaaaaccagagatggagtctccctgtgttgcccagtctggtcttgagagcttcagttttaaataataaattgttctcgtctttctaaatttcaatcaaaacacaggatgtattttaaaagggaaaaactgtgaggtaaaagaatagggtgaggggaggaaagaaataacttcatagagaaaaattcaatgaacccttggaagaaaatatatggaagtatggttactgacttgggaaagaagagaaaggtacaatgtaactgcacatagaagccagtcctgaaaagaagcaagccggctgaagttatctgcaactcagaagcacttggtaccacccaaggggagataagaggagatctcatcagaggtgcctgaaaagcacctcagccgaaggcctcacatagagagacctaagaatgaaggcacctggactaggaatgtgaatatgtgaaagaacatgaccggccaggggccctgagttattgaatgcaacccccttcagacactgcaacacacaggctgtgcaccaagcctagtatgggaaggacagcttttcttcatgaggcctgccaggtaaagccagctatgaaacaggaagttgaccttcaccagacactgaacctactggcaccttgatcttggacttcccagccttacaaactgtaagaaataaatgtctgttgttcataa

SEQ ID NO: 498 - DNA, 547 bp, Homo sapiens
tttctcagcctggagactgaaagctctctttggctgttggccctcccaggcagagtccactggctgttagggtgaaatggggctgatgcttcctggaatccaccagaagtatgcaaattgcaccatctctttcagctgcctgcgcctgcattccatcgaggattccggctcgtcccccagtggcaacaactagagaggaggtgaggatccccggcgctgccatctgataggctgtctccctagctcctcttgcactggcaatcctttcatcacacaggccttgttttgaagggacctattccacccacagtcgtttctcacctctaggaggccaaaaagctgtagtcattgctgtggtatcaggaactcgagttcctctcagaggtgttgtgaagagcttcccttccaacagtacatggcctaaataccagggaggaagtttctgactttttccatcttcagtaaaacagaacctctgttgtggatgcagtggctttgcaaggagagtggcattgtctcttggtgaatgtagttgttcaagtcatgg

SEQ ID NO: 499 - DNA, 672 bp, Homo sapiens
ggaatagcgtcatcagttctataagagagcgtgtgccgaaggcctcggcctttcacattcgggaagcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaaccgtcagtttgagccagatggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggcta

SEQ ID NO: 500 - DNA, 618 bp, Homo sapiens
gggaggagtgctcggccagggaggagtctgttgtcagagagcctgtgtcgtggctgtggatgaggctttctggagctgggagcaggtgtttgtataagcaatgggaaaggctctggggattatgcaggcgtgaagaccccacaccatcggggggcggaaggctgagtgatgctgagctggtgccactgcctggtgagaaagtggctcggttcaaaggtaccacggaaggagggcacggaggagaagcttctggtgtggtttgtctgtgtgtctgtgaagcatttacctccaacacactggcagatggtgccgataccctggggataatataatcaaactaaccgtctctgcgcagcctggataaaaccatgcaaaacgaaaggtatcagcttgttttcaaacatcacaaaaccattctgaagaagcaaaccaggttggatgagtccaatgactgatatgtgttcctatgacttctcctacacctgcttcctggcgtgcccatcctgggacactggcgagtctgctcactgacactggcacgggcctgtctgtacagtcacagacggattttgctccctccgaccttcctggactcctgaacccgatcaagatgcatct

SEQ ID NO: 501 - DNA, 1799 bp, Homo sapiens
ctcctcctcctcctcctccccgccggggtgaaactcgagcgccccacccgcgcctgacctccccgagcccctccccgggccccgccccttcccggtacaggacccccaccttcgctcctgggagccccgctgcaccccaggagttccattccagcctccccagtgcgagtgcggccgagcgctgacttttgggggctccctcccccgtctcactgggtccctctgcggctcccccgcccgctgtcccggttcagacgtggctgcaccccggaggggggcgccggccgagacctgagacgtggcgctccctctctgccggcctcggcttcagtgcttgaatttcagccacatccctaagctgccatctcagaccagaggaacagggaggggggctttctggaaagaacatcacctggaagaaatcaggacatgactgtgggccatgagtgaccttcaaaggaaagccgggtatctgtggtctttaagatgtgatccatgacatttaaaaactgaagaaatggaaagatcatctgatcaggcccatcagtctttttcctaatgctaaacattggtacaaagacgtgaagtttgatgtctcactaagattgcctagggctgctttattgctcacctacttcaaagtattgggaaaacatgattatgggtacaggtgatgctgtgttgcccccagacaggtttcttttgtcaggttcttttgatggattaggaacctacaagtggggagattttagggaaatagcccctccacttggatttcaccaaaacgtctttagggttctcttaccccaagaaacacgcattcctctttagtgtggcagcccactctattggcaaagttaagcagaccagttttactaaaaaggagccacccagaaacttagacagaaaatacttgaggcacagatgagaatgagcacaaatgtgcatagcaagtgcagtttcctggcccttaaactgaagggccaggtcagtctgctcctccaggcacagcctgggaccccatcatgtgccccactctgcagtctgagcttccactcaagtccaccagggcctgcctcacatatatatacaagacccaatgtcagagtctgcctctgcccatgtctggtcagagggttgcactttgccactgctacatgttcccagaggttggcacagcatgacctggacctcacctaacccaggcaaactctgctcatcttcgagctctctggaacccatttctcaagggagaaccacattcccccacctcacagccaagttcaaggaagcagcctggctaaagcaatgactcaaggataccagaagcagagcacgcatttaagaagatgcgctgactcgcaggagcagctgactcttcttaagaagagtttactgattcttctttcagtacgggccttttaataagatattgtattttacttcagctatgggtgcagacaattaaaggattctagaaatctgaaagtgttttgccttgtcctcttggttaaatttctggatatattgtctagcaactcaatttgcttaaacaaaattgttgtgtcaaaaaagcccaagtcatcttttataagtgtggtctggggagaagaaaaaaatgctaagtttaaaagatttttggaatatctgaagaaaatacagatagcttgtaatggagatgaagcctctggatggtttccagggtgttattttccgacattgagtcttgtatatatcttgaatgtctataagcaaagaatggctatactgtttttaaaaagatatgttttatacttatt

SEQ ID NO: 502 - DNA, 631 bp, Homo sapiens
cttattgcctgcaaagctgcctgaaaaagtagtttctcaagaaaagcagtttctcaagaaacatttcagtaataaatgaatgagtgaaatggtgtgtaagccataaccatcttagaaacagctgtgaaatcaagcatgctggctgggagatgtggctcctctccgcggcacagtgtctatatcactgatcaggtggacagatagtcccagaaggaggccctcaccaacccatttccccagacacagtcagaactggggtcagctgcagagatgggaaccgcaagaggaaggagacccttaacaaggaccaggaaagtggtgtatgcataaagaaaggaagctgttcttgaaatgtgccagtgacctcatccctgtccctgaggccagcatgagtgcttgcagtgcaagtgacccatctgccagggtgacctcaggcctcggactaacagcaaataaagccatgaacacactgttctctggacacttttgcaatttttcctttccagggcctacagctctagacttgagacctgcaactcttcccctttgttcactatgactctaacaaatttaaaacatgtcagttctctccaaccccaagaaatgtgaataaatgtttccgaaaaccaga

SEQ ID NO: 503 - DNA, 2424 bp, Homo sapiens
ttttcgaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatatttttgctttattttattttattttattttattttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgttttgttttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgattttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttgggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccatgtagaactgtaagtccaataaacctcttttgtaaattaaaaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcaggaagtctcttgccagctgtccctgtgaagacccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactac

SEQ ID NO: 504 - DNA, 1788 bp, Homo sapiens
aacccccgcctagccccttcacagcaaatgcgctttttgccctgaagttgtgtgagaccgaccttaaactttctccgaccctatctcgggatgctacggctcaggtcgtggtggtttcgggaacctcaagacaacattccccagctgacctttgggaactttaactcgggtcgtcatgtacggaaaggtagtctatggggtacgcagaatggaaaagggcttccacatcagtcgtgtccgaggacgctctccaacttttgatgtccctggagagtttctgatatttccctggagagtttcagaaaggatttcttccgacagacgtgaccccagaaggctgccgagggagactttaggacaagaggcgttgtttttgtgagaatgaatttttatactttaccccgaccccaccccctaccccccgcccaggtaaatccaagtaaatgattttctgaaggtcggtctcctagaaagcgtttaggctctggttttttgttttgtttctattttcgtgttttcccagttagggaaggaagaggagcctgtgcagagttgaactggggtggagaggtgccttgtaaagtatggtttccagagatggtgagacctcgtagctaagcgttgtttcctctgcacgtaactgtgagttgtgaacttgtggctcctgggggagcgggacagggcctggcagtgcgggggagggggcaaggaattcaggaagttggcgagaattcttcgtttttcattcttcgttgtaaattgcttctaaacacttctgaattttaaattgctaccgagaaggtccagaaaccgttctcatccaatttagtcacttttattacgttccactttgcctcccccaatcactgcggcggctcccagtttcagcgtggccgcatttggaaaaggctgaaggtagaaaactctggaatggagaggctggcgactggagcaggatccaggggctttaaattttaacctgaatgcgatcgaatgcgcgactcccagaagagatagccaggcgtccgcccggccgctcaacccccgccaggactcggaatgccttgcttttggttcttttcgtgagttccgaccaaatgtttaagtggactgggttttgcagaagctcatttgtaagcactgacggaaatgggttgtgggcatttgatttcctttgattccaacgttttgaaataatgtttctcggatttgctattcgaagcaattttctaaaaactcatatcttatttgctaaaaataaactctttggctcagtttgtgtccaggctgtgtacggcctccaaccctgagccccgaggagatcgagccctggcgcgagcctgatctctgtcctgtgtgtttctttgtatttgcaagtacaaggatgtctgcgtggatatccctggacactcgataccccccggggacctgcttttcccgcagctccgcagacgcggcgggagggcgcgctggccccggcgctgctgggacagaggtgagcagcggggtggacattgaccgattcgacaacgttcgggctctaagggctcgggaagggacccggcattttaccctccagattcccaatctatttttaaaaataatgttcaaaacatatgggaaaaataagtgattgctccttttcatggtcacagattgtatttattttttcagactggttttccaacctaacgagggaatgggtagtgaatgttgttgttgttgttgttgtttatgttggttaatttcgaaataaaactgtttaactcgtacagttgattcagacag

SEQ ID NO: 505 - DNA, 448 bp, Homo sapiens
attttctcttcctgcggtcaggtgaggagagttcttcgcctcgcgccaggattctgaggcctccccagccatgtggaactggcaaggattgtgatgacgtttttgctattccagtgcagaaagcatttcatgtaaaacctggggttgatgacatgagcaatatccggagagagagagagagattcctgtagaatacaagacaagactatcacaatgttacatgacgatgaccttaaggaatgaaggatgctctatcctgctgagtgatttatcctcaaagctgaaatgttgggtctgtgaaagtaatgagaagcacagtggaaataagtttctgaaggatggaagaggctggaggctggctagtgggagaaggttcccagacacgtgagagacccagcaacagattaaaatcatccttacctgacaagaggactcagtgaatcaatgt

SEQ ID NO: 506 - DNA, 180 bp, Homo sapiens
ctgtccaaaggcagagttccattgtgacactccagaatgctgtcctttgaaaccatttgaaatgaaagacaggacatagagtgaacatgggatttaggaaagtggaggactatgagaaagacaattttggtcagagtcttattcaagaatgggaacttggaagaacatgtggaaataaat

SEQ ID NO: 507 - DNA, 559 bp, Homo sapiens
gctttatctgctgtgccttgtttctccccggccctaggcggaaggtgctctaccagcgtgcacccaggaatatccaccgccatgtgatcctctctgagatcaaggaagccgtcgctgccctgcccccggctaagtcctatcagccatggaaacaccattgctctcttcttccggtcactgttgccaaactataccatggagcacagacgcagtcttcagcaaggaagtgctgggaacgccctggagtgaacccaggaagatgcctgcagtgggtgccagggcccctctccaccgtccctgctgggcttcggggccacgcccgactgctgtgaacggcctgcggagcaccacgtgcgacggctggaggcgagaggtctgcctttgatgtggctgttggtgcagggcctgtggtgccttccgcagcggaaatggcgcgccgcccggggagggcgggagcagcgtcccgggtgcccctgtgaggatgagcgacgagatgactggagggtccctgaagacctcactagggtgcccccagccggtccgctcccaggaagcgaca

SEQ ID NO: 508 - DNA, 3091 bp, Homo sapiens
gcaaaggcctcccttggctctctgataaagttggagctgtgggtgcagcatttcacttggacctagcagcatcaatgagccagctcctcactggggaacatgcaaacccccagctgctggtgtgcaggaaaagaatccaggagatcacctgatgaagcccagcattttacagataggcagtggagcaggggaatccagttgacactgtggctaaatttcagaaaacctcccatgagatcttgcaaaggagatggagaaaatatggctgaatgccagcaaggtaggacggaagcatgactgctctaacaaccaagctcaaagagcactgctcacccaatgtttccttcatgactagagcaaagtggtgaaaggaccctggtgagaggcccaaagaacaggaggtgtgagccaagagaaggtcctgccaggcctatgttgcaggctatttggaggctgaacttgaggtcagtatcaccagcatttttaggacggcagtggcctgatcaagtttatattctgagaggagcacttgggtgaccaggtgaagaatggcctaggggtcagtcccaccagagatcaggagtatccacctcacacaccagcctagccccagaggacagggtcttgagcctgtctctgaagcactgctcccgtctccatcctgactcatcctgagacacagttactgaatgtttactgtgggccaggctctcactgtacattattctattcaaatcccataacagccccataatgtaggcatcatttctactttgtaagtgaggaaacggataaagaggagtgtataacttgtccaactccctcccttctcccaccatttatgaatgtcagagtcaagactgagcaaggtctagttgattccacagcccagaagaatcacgtttctgatacatgggatacattgtgggttctcccatgactactaggacacacaatgagaaaggcctaggaaggactgaaacctctggagccagctaaccatttacacaaagcccaggagatgagagctggggcagggagtagagcgcaggagggatggggtctctctgatcacattgccaccggggaggatgttttctctgtgcaggtctatttaaagtatctacttcccatacgtttctcatgtgtttcccttactgaagtacagtgtttttgaatatgaattcaaatgttttcttgggcccacaatgaaaggacaagagtttctttagaaaacagccacttaaaactgggatgtacttgaaagtcaggcagtgacaagaagccccatgctctaacttacacacgctgacagatgcgcagacttatcattgctccttggctggtctgcacaccaaccactcttacacaggtacaacaacaatcagactataaatgatcaaaatcaactattgaaaggatcccaggccatgtgtcagagatgacaccctaggcagttggctaacacacacattgcagcaggtcttaaatgaatagtccattctggataaagtcattgcttcccttgagatgcaagaaactgtgctgttctgctcctgggtagcctgatgaattgactagagcaaagagacttccagcaggagcaaaggccctgaagtaggaacttgcttagcatgttaaaggaagtgtggctgaaggctagtgaggtaggtgagggcacagagatgaagtcagagaaagcagcaggagaccaaacagtgtagggccttagaggtcatctaaggactccagtttttactctgaatgaggtaagagccaatggaggacactaaagagaagagtaacatgcatgacttacggttttaaagggtcagcctggctcatgggctatagatggaactccagatatgcagcaattgtaacatccagcagagagatgataatgtcttgaaccaaagtgctattggtagaggtgatgaaaagggtttaggtattagacacattttgaaataagggtgtattagtcaaggtactccagagaaacaggaccaataaaagttgagaaaaaaaaaaattaacaaattggctcctgtgagggttggcaaatctgaaatccatagggcaggccagcagtctggagactcaagtaagagttgctattgcagtctttagtcaaaattccacagagcagcagactagagactcatataagtttcccatgttgcagtcaagaattcttgagaagaatttcttctttttcaggaaacttcagtcttcagtcttaaggccttcaactgattggaaggcccccagtcagctagtgggaagacccatgcacattagagagggtaatctgctttgttcactgtctactgatgtcaatgttaattatctttaaaaaaaaataccttcaacatctattttgttctttggtcaaacaactggccaccataacctagccaagagaacacatgaaattaaccatcacagagacccatgaggatgtgttgatacattgaatgtatgagaggaaaaaaaaaaatctactttagagtagttctgattttttttatctgaacaactgaaataatttaataattattgaaatgttaaatgctaggagaaaagaagctttgtgaattgaaaccaggagtttggttttgtatatgtaatatttaatagtcctttagtatatccaagcaaatgtagacaaagcaatctggagttcatggagaagttaaaagctgaaggtaagtatttgggagttgtcactgtgtagagggtatgtaaagttagaagaccaagcaagatctcttaaggcagaaagtggaggatagaatacagaggatatatcaagaatgagccctacaagcacattaatttttatatgaataagaaaggagtagaaaccagcaaaagcgatagagaaatagtggccagtgagacgatatgcaccaagagcataagatggtacagaattcaagtgaagaaagtgtttcaagagcagaaggtgattaactatgtcaaatgctgctaataagtaagatgtgcacagagaatttaccactggacatcttggtggagcagtggagataaaagctagattgagaaagcttcaagagtatacggt

SEQ ID NO: 509 - DNA, 2155 bp, Homo sapiens
atggaaatcgtctttgacaaaactgaaatgccctgaagttttaattttttaaatacatgtaatgaattggtatatggtagatactcgtggctacttagtatttaccaaatgctttgtttccatctcgtttatttttattttttatttttttaagagacagtcttgctatgttgcccaggctggacttgaactcctagtctcagccaaccccttctgcctcagcctcctgagtagctgggatcataggcatgtgccactgctcctagctcttccatctcagtcttatgatgtagttactattttcattttataaataagaaaatagaagctcaaataaaatgggtagtttccttgaggtcatcctgttagtaagtggtggaatgaagttacaaacctaggttttattggtcagcacacacagtgccgggcactggcagtacagcagtgaacaaaaggtctgttggtttgtctgaagctctcaaccttgattctgcatagactcggtggattgcccaaggccactcaaccagttaatatcagagccagctctgctgtttgaccagtatattattttcaccatgctgtatctgcttctcagtcaccaaaagcaccagctaaaattgtatatagactgattaggggacttccaacctaagattgtcctggaaacttaattcttatcttggctcatctcttcaaaacagatgcctctttcgttggtgacctcagatacactgttcagaagtactcaaagtattccttttttctcacatttgagagtcactctagcattttaatgagttaagcaagccagccctgcatttccaaacccttcccagaagtctaaccttactttgatctgatgacatgggctttttaaaagattactatttttttagaggtggggtctcactatgttgcccaggctggaatataatggctattcacaggcacagttagggtgcactactgccgtgaactccaggactcaagccatcttcctgccacagcctcctgagtaacctaggactataggtgcatgccaccatgcccagctgacaatggctttatatacataatatttcctcagcaacaatttatgtcttatttggcacctgtaaaaccctcttcactgattatgcctgtttaaaggtttggtatttactccaagtcacctgcctttagccatggagtattcaagtttctttcagaatgagaatttggagggtgctcatagaaatataaaacaaggctgggcatggcggcttacaccttgtaatcccagcactttaggaggctgaggcaggtggatcacgaggtcgggagttcgagaccagcctggccaacacagtgaaacctcatctctactaaaaatacaaaaattagccaggcatggtggtgcatgcctgtaattccagctgctcggaaggctgaggcaggagaatcgcttgaacgcgggaggtggagtttgcagtgagccaggatcacaccactgcactccagcctgggcgacagagagactctgtctcaaaaaaaaaaaaaaaaaaaaaaaagaagaagaagaagaaatacaaaaccaactctttatagtagacagtttatcccccagaaagctttttaggctgaaaacgtttctatagattttggatttccttctgatagctaaaatttgtttctgtataacagagtagtgccctataagccagttcagtgcacattaaatggctgttcttagaattatgaatctgaggcttatgcagtgaggctctagctctctggagtcagttggtcaagtgggattcctgaggactgagcaaacacacacagagcaggattttgtcctaagttttcttagggatcctatccaaaaacaccattacttgaatttcccagcttccttttacagggagacttccttgctatgtgtactcccacctcggtatgtcaaatcattttctcagaggaagtacagcataaaataataaccagcatttgtagagcacttcttgtgggccttcttgggcaaatagacattctcatggaatgctctaaaattgttaagttcttgcacttgctctcaagtcatttataatctaattgctggtcttcctggtatgaacaaagatgtttgcttgttaataaattcctaccacat

SEQ ID NO: 510 - DNA, 472 bp, Homo sapiens
actccagcctgggagacagagcaagactgtctcaaaaaaaaaaaaaaaagttatttcactagcaacatataattaccataaaacaaaggagggttttaaatgaactacacatgcaaaatacactagaaaagctagatatttttaaaaacgtggtgaattatttggtaaagccaaaatattttaattcataagttactattcccccaatgcatctattttgtaaatgctgtttcacatatgaggtttgtaaaaaagcaaaatatatgtataaaatggcgtacataaagatgttctacaaatatagccagaagttattgttttactgtatgcaaagagtgatggcaatttttaattcaaatgtttttaaatatttcgaactgaaactaaatcttaccaatgtaaaattgccacaaagacggctggaaaagagaaaagttattaaaagctgctttattataaaataccattaaaa

SEQ ID NO: 511 - DNA, 2838 bp, Homo sapiens
agagttcactgcgaggactgggatcacccgtcaccccgccctggtctacggaaaatgacaagtgtttactgatatagaaacggaataacggcgctgtgggctggggtgggcggagctgccttcaggcttctggtctccagcggcggggaactcacacctgccgctgtgaaaatgcagacccgcggggcagtaattccgagtccagcctggggcgcgatctggaatcttgactcgcttgaaacaccacgacggattcggagacaggtgagtagagaaatgagcctcagcccctcccacgggccgcccacggattccaggatccggaaactcttcctgctgctgcgtcaccccaggaaggcagcgcccgcctctgggcagttctgatggaaactggcttcgccgcccagaggaaaacccacaactaaggggccaagaaaaagcctccatggtcccgccctttcagtgaggatcctaatttataccccgagtgtggcccccatcaaagtctgcagtgacagccgagcgcggtggctcacgtctgtaatcccggcactttgggagaccatggcgggcggatcacttgaggtcaggagttcgagaccagcttggccaacatggtgaagccccttctctactagaaatacaaaaattagccgggtgtggtcgtaggcgcctgtagtcccagctactcggaggctgaggcagaaaaatggcttgaacgcgggaggcggagcttgcagggagccgagatcgcgccactgcactccagcctgggcgacagagactccatctcacacacacacaaaaaatgtagagtgacgttcactgaaatgatactagaccagcgggagggacccagagcgctgcggttcacagaatgcggtgacagcgccgcctcgcgtcctttacttcaactgccccaggcagacgtggtcacgtgtgttggcctggaggctggaatacaccggggtcaaatgcagagtggagaaaggagggaaggatgggaggacgtgttgaagaaagacagtaagagctagcgctatggttcatatctgtaaaactagagttttcggaggcgaggcaggaggatcgtgtgagaccaggagtttgaggtcgcagtgagccgtgatcacaccactgcactccagcctggacgacagagtgagaccctgcttttatatacttttcatattttctgtaattaagcaagttttgtgtccggaattggtgggttcttgatctcactgacttcaagaatgaaactgtggaccctcgcggtgagtgttacagctcttaaggtggcgcgtctggagtttgttccttctgatgttcggacgtgtccggagttttttccttctggtgggttcgtggtctcgctggctcaggagtgaagctacagagctttgcggtcagtgttatagctcttaaggcggcacgtctggagttgtttgtttctcccggtgggcttttggtcttgctggcttcaggagtgaagctgtagaccttcacagtgagtgttacagctcataaaagcactatggacccaaagagtgagcagtagcaagatttattgcagagcaaaagaacaaagctttagcagtgtggaagagaacccgactgggttgccactgctggctcgggcagcctgcttttattctcttatctggccccacccacatcctgctgattggtagagccgagtggtctgttttgacagggtgctgattggtgcgtttgcaatccctgagctagacacaaaggttctccaagtccccatcagattagttagatacacagtatggacacaaaggttctccaaggccccaccagagcagctagatacagagtgtagattggtgcattcacaaaccttgagctaaacacagggtgctgattggtgtgtttacaaaccttgagctagatacagagtgccgattggtgtatttacaatccctgagctagacataaaggttctccaaggccccaccagagcagctagatagagtgtggattggtgcactcacaaaccctgagctaggcacaaggtgctgattggtgtgtttacaatccctgagctagacataaagactctccacgtccccaccagactcaggagcccagctggcttcacttagtggatcccgcaccggggctgcaggtggagctgcctaccagtcccgcacggtgcgcttgcattcctcagcccttgggtggtcgatgggactgggcgccgtggagcagggggtggtgctcgtcgaggaggctcgggccgcacaggagcccttggagtgggtgggaggcttaggcatggcgggctgcaggtccccagccctgccccgcgggaaggcagctaaggctcggtgagaaatcgagcgcagcgctggtgggctggcactgctgggggacccagtacaccctccgcagctgctggcccgggtgctaagtccctcattgccaggggccagcagggctggccggctgctccgagtgcggggcccgccaagcccacgcccacccggaactccagctggccggcaagcgcggcacacagccccggttcccgctcgcgcctctccctccacacctccccgcaagctgaaggagagggctccggccttggccagcccagaaaggggctcccacagtgcagcggtgggctgaagggctcctcaagtgccgccaaagtaggagcccaggcagaggaggcggggagagcaagcgagggctgtgaggactgccagcacgctgtcacctctcggttttactttattttaggataaaatatctattgtgaattttaaaaacatgtaaaataaaattttaattaaaaagcctaaa

SEQ ID NO: 512 - DNA, 602 bp, Homo sapiens
attcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgagagattgggtctctccacattgccccggctgctctccaacccctgagttcaagtgattcacctcccttggcctcccaaagtactgggattacaggcgtgagccaccgtgcctggctgagaagatggatttaagacatattttggagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccgtt

SEQ ID NO: 513 - DNA, 493 bp, Homo sapiens
cgctgctgtcaccccggccgcgccccccaactttctgcacagtcgcggagctggaagtttccgggcttcgcggacacgctgggctgggtttcagtcgcggctccgaggttggcaacaaagagggaaagaaggaggaaaagcaggccggggaggggaggaagagaaccgcgcggaggccgcggcgccgagagccccagaacttccaattctacccagaagcttttttcgtcgtgtttttctcttagacatgatcctctctgaggttggtcctgggcttccatacgtgattcatggaagaggtctcagccccaagagcccctgagggtactgtccactccccctggaaacttccagaacctgacgtggggctgaagacatagaggctctgagagttacataattgattctgactttggctgttggtcaacagtgtcataaggtaaaataaggctgttgtagaatctgctcagccagggaggggaaaggagtcggc

SEQ ID NO: 514 - DNA, 547 bp, Homo sapiens
tctttccacccgagcgcgaggtagacgccggggccacccgcagcacgcagagcttctgggagccggtggcaaggccgaattgggatgcaaaccaaatggacgtgggtgactggcagaaaacgcctcccacaaatgggagggatttcggagggaaccgaaagaaagttggaaaccaagttacagctgaagccagggccttctcctacccgactcccgcggcccattaaaacctacgtgagcttatctgataccttcaagccctgttttgtggccccatctcctcttcagatggcaatgtgcctagctacactacatttcctgcctcccttgcagctagaggtggccaatgagatataaacagatgctgtaagacatgatgtctagatccctagcagtcatcccagaccatgagataactttgagaaggaacaccatgtacaaaggactgtgcagaagagggttggcaggagcctggatctctgatgacttcacccttgactgcccacctcaccaggctgtacaagccactgttactggcagatgaatg

SEQ ID NO: 515 - DNA, 1143 bp, Homo sapiens
aacttttttaaaagtgaaaaaggaagcaaataatactgtatatttcatacactatatcttaatttgagatatatatgtatgtatatttaaatttagaaccatatattaaaatttttgcagtggttatttctgaaaggtggtttatggatggattaaatttctttctttgtacttttctgtatttttcaaattttctacaaacgaccatagtagaaaataatagagaagctgcaaaaaagggagaaaatttttataatagagaaaaagttgcaaaaaaggggagacacccaagtttatagtactatattttaggcaaattgccatgaaaaattgttaaacttaaaaaaaaaacttaaagaggtaaggtttggtgttattgagcacttcaaatgtggctagctcaaactgagatagctgtaagtataaattaccaaatggatttcaaagtcttagtgcaaaaagagaatatgaaatatctcatgtatttttaaacattggttacatgataaaaaaaattttgttagattaaataaactatattattttcttagtccattttgtgctgctataacagaatgtctgacactggttagtttacaattctggaggctggagtccaaggtcaaggggtggcatctggtgatggccttcttgcttcatcatcccatggcagaaggcaggagagcaagagaatgtgtaggagagaaatagagggccaaactcatttttctaacaagccctctcttgagataactaacttactccctcaataacaacattaatccactcacaagggcagagccttcatgacctaatcggcacttattaggctgtaccaccaacattgctgcattggggataaagtttctgatacataaactttggggaacatattcaaatcataggaattgttaaaagtaattttatgtatttctttttactttttaaaatgtacctaccagaaagtttacaattaaacatatggctgatgtttgtggctatatatgtattggacagtgctggtctagaatatcatccaatttttaataaacccctgaaacccaagtgactttaagtgctttacctttcccctaacatcctcttcagtattatccaataaaaaggctttatcctccatcctaa

SEQ ID NO: 516 - DNA, 4237 bp, Homo sapiens
agcagacattttcaaaggcttctctccccttcttctcctctctctgtcccccatgcggaaaggggaaaatagaagtagaatccagattggggcgcgtggctgatttggtcctcctcccgcaccatcctcccccagacagcagagaaactttgatgtctgggtgcatggcattcagggacagaggagcctgggcatcccagcaaatgcagccgcatgttccgcctctggacggcctctctgaactcctttgtgaggggagatgaagcccacagagctggaaagagcagcgttttgaaatgaggaagtgtggatcggcattccttgagctcagtgctagccaccttggcgatggggtgagccaaccaggagctcagatttataaaacttttgagctttgtgggccctagggggccactgtggcctacctgctgattttcagatggggaaatgggggctcagagaggggacaagatttgcttaatggcacctagcaaattggtaacaggtccaggagtagattccatgccttcagcctctggtgagacgtctttcctctgcaccaggaagtggaacttcaaacagcaccaggggttggaacttttgtttcaaatcctctctgcctcatccccacccactgcccagcaactcaaggctgggtctttcgccccctcaggctcagaagggctgtggcccagccacagagccagggggcctcctcagtagtattggccttcacactcttggtgctaaagttctccagttacttttttattaaaccaacatgtacagaaaaactcagttttcggctgggcacagtggctcacacctgtaatcccagcactttgggaggccgaggcaggcagatcacttgaggtcaggagttcgagaccagcctggccaacatggtgaaaccctgtctctacaaaaatacaaaaattagctgggcgtggaggcgcgtgcctgtagtccctgctagtcaagagggtgaggcaggagaatcgcttgaacctgggaagccgaagtagcagtgagccgagatcgcgccactgcactccagcctgggtgatagagctggagggaaaccctgataccacttctgggtccagatggctgtggctggaatgcggccacagccaggaacagcgtggtacggataccagtggggctctggtcttttcccagaggctggcacctttcatgccgagttgggcctcgggtctcggggctctaggccctgctgtgccagtggcctgatgtgtggccttatatgccagtcacaccctgctccagacctcggtttcctcatccacaaaatgggaaagctgggctagaaaatctctcaggaaggtaggtctctgctagctcccagccttccatggcagtgcaaagggaaccttcccaacaaagtaagagccaaaggctaagatggcagtctgtggtttgtagaaccttctagaagaccacgagacttggtaagctgagcttctaagtggtccaggatgcagggctggtgtcacaggtgtgtgaccagtagagctacacagggctttgtgcccagaagggccccacgcttgggaaataaggctctgcagtcactgtcttcaaattcttaataattttatctttgtcactgtgttttgtaagtgaagtccaatgggacagtggaatgtgaactgggagcatggagcctcccatctccctgcgtccaggatctgcttctcagctgcttgctcctctgcccccacagctccagctccagctccactcaccttctacctccctgcctcccacccagcaaccactgccaacctgcccccaacctgggcacaggcacaccctgtgggggagggggacaagcacaccccacagcatctcagagtggggcatggtggcagcagtccccatcctgcactggcagcccagggcacatttcatgtgggactctgcgggggtgagcctctagccccccccagatccagtacctcgtgtgtcctggtacaaaatttgtagtgccccgggggctgcccatctgctatgggttggggcaggggcctgtgggaggatgcctggctcaacctcctgccctaggcctggagcacaacatgtgggcccagcagctcacaggaaagggagccagaagatgggttcaagtgtttgtgtgttccccaagtcaccagggtgcctgtgggggtctgcactcccccaggagaaccctcatgtctagggagcactccatggggtcatctccatgcctgagaggaccctctcttccttctttcaaccttccggagcccagcttgtctcttccggccaggtcaaggtatcctcctgagagaaccgtgaaatacagtgtgccgctttgataattccacatgcatgttcaatattcggatatttccagttaaaactggcattgcacaatataaaaaggaatggtaaaagtcatgctaataatttaaaattttgactttacttagaatggtattaactagcaaatttaaaacaccatgacaaattgaaagtgagactggggaagaaagcaaaaagcatgttttctgactgtttgaacaaggggccccacattttcgttttgtagtgggtcctgaaaattatgtagccagtcctgcctggtgagccacctaccctcttgggcatttagttgtctatcagtaaactagatcattaacactgcgcctgcccctcctgctcacgggcacgttaggaacatgcgcttggataaaatccaagccagagatttagaaaccagtgtgtggtgccagctctcagccttggaaccacaagcccatttttcttaaaaagggatctggactggcatccaaagagatttcagtcccctcatataggtttaaccaccatgggcaaggcagtctctctcccaggtattcctctcactaggtgctctgctctagaaatgaagtctaaaagcagccccatcaatacagaacagagttagaaccacccggagagatttaatctggaatcccagcaagttgtgaaatggaaagactagtcggccagagagctgaggtctcacagtgtgcaaagaccagtcctcagtatctgcacccatccatttgagtttcaggtgaagcctaggatttgggagctcaatacaaagatgccagcatgaaggagggtgggtgccaactaggtttggatttagagacatcctccttttgggaaaggaaaatatcctgattccacttaggtttccaggaagaaggcatccccatttcagaacagttttctaagccaccctcatggaggtttcacctgcagctttcagtctgctttgtctgatgtttgaggatgcaactgcccaaaaatgggtctaaagtagcatcccgtcacgttctgtaaaaagtaatactgctttaaggtaacacttatggaatgaatgaatgcatgaatgaatgagtcagtttggatgaagttgcctcaaatagagtctaaatataagatttcatactcgatagtgtcatttcaggatcaggaaaaattaggtgactcccatttggtttctacagcttttccccaatatcatgttaaagttttggcttttatcttatttcacttatttcattttgagtcatgtcttctggctccagctcagcttcctagagataattcattaggcccgagagctgctccagagtgggattagaacccgtgtagtacatagtcacattaaactgagatcggctaattaatcgctcttctccgtgtaactgagcgatcgcgctccttccccgaggaattgcaatttcatggttcctaatgatggtgcgattacattatgtggatcacttaggctgtgggtgtcaggagcggtacttggagcctctctcggtggggatgggagaagtcacttctaaaaccggggagatggaggaaagcagttagaatgtctgttactaatttttgttaacgtgctgctgtttcctacatctcattcaggcattagtttcaagttccattttcccccagcaccgtgtggcaccttccccagaaccctcacattttttttctaatattcacagggttattgtttgtaaaaaatctatttatttgctttattccatcaagtaatttattttcatgagatttcttggaaatgtggctctacatatcgttagtacaagtaatacattttgattgttgtttcctggaataacttgtattatttgatgagttaaataaaatgcctaattctaaa

SEQ ID NO: 517 - DNA, 5372 bp, Homo sapiens
ccgccaagcatattgctaggcacagagcaggtgtgcaacaaaagttatttctcaggctttccctcctctgagcgccgtcctccagagggtccggagtgtagctgggggttggagcagcagcctcctaggcgatgggacagagcccacagggtccggtatgccacggtttcttcgtcagaccctgggaatccaacgtcgcaaaataaacacggccgcgccgctaatcgccagttcggaggaaacaaaacagcgctgcgctgggggatctgggcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgttgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaagttgtaattgtttgttgtgtatgtatttttttcaatgccaaaccagctgtgatccaatttacatccacattttaggtccaacagcaagaagttcagagagagatttcccaaccagacattgggtcactcactggtcaccttgccagtgcattttattagaagggaatctgttgtagcaaatgggaataaacctgggtttctatagacccagaactg

SEQ ID NO: 518 - DNA, 366 bp, Homo sapiens
gcaacgtgttggaccttccggagcttctcagaagacagagggttttcttttgagatccctcccgtagctgtcatacagagtgcgatttatgacttgtaagttgtgctatggagcttgacaaccaaaccttcaatacatttatgaagagagcactaccgagactttatacaatggaataaaataacaaaatgtgctgacagcattcttccactcaaagagaaaaagtacttcaactcggccgggcacggtggctcacgcctgcacgcctgtaatctcagcactttgggaagccgagacgagcggatcacgaggtcaggagatcgagaccatcctggctaacacggtgaaaccgtgtctctactaaaa

SEQ ID NO: 519 - DNA, 2672 bp, Homo sapiens
aatcaacactccactcagacaatgcccagacctccagaaaccatgtgtcaagctcggattgccttagacaggtgcaatttaagaacagctttcatcctcttttctctcatattgtcacactatgtgttctgacttctggctcctttcctcacaagaagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccaggaatccaacttgctgtttgctatcacatgtgctatacatgctgttgatgaaactgctaaaggggctgaatgtgactgacgtctttggaaggatgagacttagcgtgcctgtacagttgtgtccaaatgctgtcctcatctcccaatgaaaaggtattgtaaataaagagaaagatcagaggcttattttaaacactaaatatgagctaggagctgtcctagacactatgtaaaagttttatttagttctcactgtaatgttggccttatgttagcatcccatttttcagactgaggaaattatggctcagagaggttaagagacttattgaaggtcacacagctccacaaactttggtgtagattgaacgtgtacatgggtctatgtgactttgaatcttgcattctttacattattggaatatttcacagaaggaaaatgacatattaacatggcaataagatttctggttccagtctggttactggtcttccaagagtgttataggatgtatagcctgagctctgaagctttgttctgaagcatgctatcaatatgaacaaattggtatggaaggaagccacaaattatatactaaaatctagttcatcagaggaaaatatagttaaatacatttacattcccagaactgttaatattgaagaataaaacacacagtgggaaagagacgaagagaaaatacgcctgtttttatgacttgttgatatctacagggtttttccttaagcctcacaacaatttacagcattgccagcagcattcagtacattcagaacaggataatttcacccgcagctgaactagggccatgcctgggacagacagagaatggccttccagcagacatgccaagaagcaagccagggtcagtgagtgaagaggagggcaggcccatttgaagcaacacagtttatgtaagtgtgatctaactgctttcactggaaatgggtcagactccagttgagagaaccaggggcctgaatgaccccagcaaaatcactgtggcaattctttcaatcacctctgagaatatggccctgtgacgacataatgacgtttggattaattccagtcggctgtgttttcccctcctttcttgcctccccgtagttgatttgccaaattttttttgtttgcttaaatacgcggaactaaacaggatacattatatgacagtctgtgataaatttaccactgggaatagggaaaaagtatgggataaagaaataggtatttttcgcctctcacagctgtgattcagttctgactcaaaaggaagtgtgccacctactgaatcacagaaaccacttcctgtggctgtttggtttattctggaggagcatcaggccaagtgctgccctgccctgaccctgactggctcttcagagccaaggcattcacagcttgaggtggtttggcctcagactcttgagaacattgcatattaaattacaagtgtttcgtttcctagcaaggagtctttagcaacatgaaaacgaacgtgtgttatttgcaaaccaagtatatcattactgaacctgaatatccttactttttcataaggtacgtattccggatgaccactcttaagatctgaatgtacactggttctgtttttcctgaggggaacttgggcagtctgcagggtggcatttaccagctgagggacttcaagagcaccctttaatcagtgtggcagcactcaacttgtattcactcactcagagtatttttgagcatgtacttattgccatgtgctgtgctaggtaggggtagagggtacagtggtgaacaagaccccacagctcctgacctcatggctcatgtgttctacaccataagggaatcaagctgtgtctcccggggcaggggccttcctctgttcaccatgcagccccagcatctagcacctggcgttgcataaaggaggctctaaatcaagcttgtccaacccaaggcccacgggccacatgtggcccaggatggctttgaatgcagccaaacacaaatttgtaaactttcttaaaacattataagatttgtgtgtatgtgttttagtccatcagctattgttagtgttcatgtattttatgtgtggcccaagacaattcttctatgtggcccaaggaaaccaaagattgaacactcctgctctaaatacttgtttgttgaatagatacatgaaaag

SEQ ID NO: 520 - DNA, 351 bp, Homo sapiens
gtttgtttaatgatccgtcttctgcagtagtgagggtgttgtgtcatcctaggacagccttttgggagaggagccaagatggccaaataggaacggctctggtctacagctcccagcgtgagcgacacagaagatgggtgatttctgcatttccatctgagactggtgaaaatatatttatggactggtgcttgggaatcactacttagaagataaaaatatgatcttcatttctaatcacttataactgttgaatatctttatttttttctatctagaacttatgtttaaatctgttttaaaagtttcaaataaaactgtagtttcctccacattgaagaaaacttcaaa

SEQ ID NO: 521 - DNA, 989 bp, Homo sapiens
ttacaagtgaactttctttcctgttttaaagccttttaaataaacttccactcctgtgctgaaacttgccttagtctttttttctgctttatgcccctcagtcgaattctttcatctgaggaggcaagaattgaagttgctgcagacgcctgtggattcaccacaagtacattggagtaaccactgggaacaacaggttgccttagaagctttgcaggttgttttgtttttttgtttgtttgtttttttgagacggggtctcactttgtcgcccaggtttgttgcccaggctggagtgcagtggcgcaatctcggctctccgcaacctctgcctcccgggctcaagtgatcctcccacctcggcttcccgagtacctgggactacaggcatgcaccaccacacccggctaattttaatttttattttgtatttttagtagagttggggtttcaccatgttcccagctggtcttgaactcttgaggtgaagcaatccgcccacctcagcctcccaaagtgctgagattacagacgtgagccatcgcgcctagccttgcaagttgttttttgttgaacagaagaagctattcaaaaatgtccaggactctgttatttattcagcaagcttacaaagccatctttgattgactgattctttgacaatgactatctggatgacacaggaaggatgcaattctggccttggagagaaaacttgcaaggaaaggaacatgtttgaatttcagatgtgttcctcaatgaatcacgatcttcagggaatgtttcaggtggaggaaggggctcttggtcaatgagcctgaagactgcatggcaacctttgccagcttttggcctgaaaactcaacttcttcatttgagataattcctgttttatatactttcatttgagatattcctggtgtatcaactgaaacaaaatctatgaaatatcagattcacaaaaatacattttgaatattgaacgtgga

SEQ ID NO: 522 - DNA, 391 bp, Homo sapiens
gtggtgctggtgtccctccacttcccaaaagaatgatgccggactcattcttggtgctgaatgacaggttgatttctgttcctacatcaattggcacaggggagagctccacaaaaccaggcttaggaaagctaactgtgtaaacattctagtgggtgtctatggccaattccaaattggagcctgtagctatgaacaatgaagatcctgaaagttctgttccagtctttaaacctcatcattcaagtggtggatttacttttttctttacccacattttcccttcatttccctaattctattggagtggtttaagataattttgattagaagcagcagacaaaatgaataattgtattatgataggataattaaaaatgtatgagaatga

SEQ ID NO: 523 - DNA, 2468 bp, Homo sapiens
ttgaaatgctcgatgatcttctcttcccgcacgttctcgggccgggcgtggcggctcacacctgtaatctcagcactttggaaggccctggcggaaggatctcttgacgtcaggacttccaaaacagttgggcaacacagcaagaccccgttcccaggctgggggcaaagccgggctcggtggctcacgcctgtaattccagcactttgggaggccgaggtgggcggatcacctgagctcaggagttcgagaccagcctgaccaacatggtgaaacccatctctactaaacatacaaaaattacccgagcgtattggcgggcgcctgtagtcccagctacatgggaggctgaggcaggagaatcgcttgaacccgggaggcgaaggttgcagtgagccgagactgcgccactgcactacagcctggatgacaagagactcccgtctcaaaaaaaaaaaaaaaaagacacctttctttgggcttagtgagcaaacattctacgcagtgcctaatataagccggcccaggcaccacccaagccttcggccaggactgttttcccgtttcgagaaggctccatcacactccacacgggatccagtcaacagccgttccaaacatggcgcgggaaggggtggaagacaagccagcgcgacgccgtccagcctcatccccggggcacaaaggggagactaatctccaggaaactcggggtacagaatcgataaccccacaagaaactagtttccgcgagtgggccttaaggaaaaagtaggtcgggcacaagcgagctgttcagacgcacttcacagcaaagactcgcggacaacacagcgagacgaaaacggccccgtgcgcaggcgcgcggaaacacgactagcgcgcttcgggacgacccctcccccttccctcaaaggccaaggaagtggctccgacgcgcttgcgcgaggacggaatgttgaggggagggggaattctttcccttcattgtcagagagaaccgcccccgcacggcgagcgcgcgcgcgctcacgcaccactctcacactccggcgcgccaaaggctttccgcttggcgtctcgcgcatgcgcggagggggaagcagtggcgaaattggatgctttttgctgagtttctcagagaagtttctggaaagatggagccaaagggacgctggggggtggggagcgccaggaagcaagcgtttgaaagaaagcgaaaaaacccaagcgcaccgcgacacctccaaccttcaagccacggcccaagcagagcccaaggccactgagaccctcacgccagagaaaaagcacagggaccgcggcagccgctcctccctctgccactgctcagcccccgagactccccagcacggggagagggcagggggtagccatgagaaacctagagcgctcactggacttttgcgaggtggaaggaaagccgaaacccgccctttggagccgcctgtgcgcacgggccccgtcgagtgggctcagtacgttaggactcagcgtggccgccaaagcattggttgggggcgtctttcactaatttttcctaggttttctcttctatcgggctctgtggtcctttcaccacccatcttcactttggtggcctgacgctaacgctgcgagttggggaaaccgtagtaaccccgggcctgaggggcgtcccgggcggcggtgctccgtttcttccagcggttgcccctttaagaaaaagccccccggagaggggcccgtgtggctgagtaaaggtggcgtgcgcccgcacaaaggcgccgcgttgttggcgggctccggaccctgttgcccctgggcggggcggcgtgggaagaccggggcgcctgggcggggagaacgacgttggcgctagcggggcagggcagggggagggagtcacgggatttagcaggtgcttctccgcgaccgagcgactgccattttgtggtgcggccgccgccatttcgcgcggccgaggggcggggtgtgggcggagcggcgggcgcgcccgggctgtccctcggggcggcgggctaacgcggccgctttgttcttcgcttctcggctcgaggccccagtctcgaccgccgaccgcctcggaaccgggctgcatccgagctgccacgcggcgtgtgaaccttgaagcgcggccggggaatccgcaaggcgccgactctcttcctccttgcaagcccttcgaaagtgagatttctcaccccacccttgcagggtggagagaacacgtttcaaaaaggggatgcctagaactcagccgtgggaagtgcctgtctaaagccttgtgctggtgccagtagcaaacccgtgcgcgtgctcggctttgagcgatcatggagctctgcaaatagctcaactgcagagcgtgccccttagagctcctgtgctgctgggaggcctcataaaggtgccaaaaccaggtgtccccagcggttggcctcttt

SEQ ID NO: 524 - DNA, 239 bp, Homo sapiens
acgagagacttgctgaaggagaaacaaactgtgaagtctgaccctagggaatgagtgctatgcggatcagatcaagagagggcggctgcctggctctgatgcttcccagacttgggacccaaaactcaagaagacaacgaaacatagtttttgctcttgttgcccaggctggagtgcaatggcatcatctcagcttaccacaacctctctcccggattcaagcaattctcctgcctcag

SEQ ID NO: 525 - DNA, 1904 bp, Homo sapiens
gctagaactggacacctcgggggtttcctgctttatggcgaaggacggagttttgctcttgttgcccaagctggagtgcaatggtgcgatcttcgcttactgcaacctctgcttcctgggttcaagtgattcccctgcctcagcctcccgagtagcagggattacagatggagcctcgctctgtcacccaggctggagtgcagtggcacaatctcgggtcactgcaacctccgccccccagcttcaagcgattctcctgtctcagcctcccgagtagctaggattacaggtgcacgccaccaggcctggctaatttttatatttttagtagagatgggattttgccttgttggccaggctggtctcaaactcctgacctcaggtgacccatccaccttggcctcccaaagtgctgggactacaggtgtgagccaccatgcctggtcccccacttgttgattttgcagaaaagatagctgtgttacaacctgtcctaaggtcaggtatgaatacttgtgcttctttcttggctccccaagccagagggcattcctatgcccaggtgagagagcacggagtgttactttggcagcacagtcagttaccagaggtaggaaaagcaaaggccaggcaggacatgaggggcccttgcactggctggttctccctgccttcaccaccctccaggtgaatgactgggtgaataatgattgactgaggaggtaatgaataatttatggacactgctggacctcagtctcctcatctgaaagatgagtggttggagaagtttaatggttttcaaatgctttttttttcagtcttcaaataagtgtttacgtagaagcaccatatctgaaacaggtgacagtggaccagtctgaatgaaatgagggttggcaggcctgagctccaaaaccttctgattgcccaagccctccttgtcttgcttggattatctccacacaaatggagaaactggacaaggtggtcatggaggtccctgaaagctcaaagactttctcattccaggattccccatgttcatatgccagcatggcatgggggtgctctgtagtcaagcagggtcctttggggggcttagggatggagccaggaaatggctctgggactcagcgggtgtccagagtctcatcagcagggtttctttactttcactgagtggctggtgcctgcacactgagttttgcaggcttactctcacagagtgagcttcctgcaggccccccactgcaacccctttccttcctggagctgtgtgctgactggtgcgtgagcaccccaggccctctccccatgctgctgatggtcagctttctctgcacgctcgtggttgccacagtcaacgctgataaaattgctgatgcagattgcctgcccagctgcgagtgctggcacgggaccagcagcccagacggtcactggaagtggttgggctgattattggcatcatctccattgtcctactcggttcttaaaggcatatggacttgcctcactcctacagcaaatgacggcatgggcaaagaggggcaacagacccaccctgaagacactcctcatctggttgacttggcagggttaagggaaaaagatgtgatgactaggagctgagagcttagtggttctgccagagctgcagagtctttgttggcctcagggtgggacctctcacatctctgtcagcttttcacggacaccaacctgttatgattcatttcacctgtcctgagcactagcaagaaaaattcgctgtagcttgtgatgtattattctggatttctcaactcattcatttgttcattcattcactataccattactgtctattataaggggggcacaatggtaggtgctgggaataaaaacgatgtttaacgttt

SEQ ID NO: 526 - DNA, 464 bp, Homo sapiens
tctatctttgttgagttttggtattgattttatgtgtcagtacctgagaaggagagaagtccttgagttgtttcgtaaatgtggctcaagtgagatgctgaacagtgccagccatgtggactctgccacagtgaaggaggaaggcagcactgagaagtgaaggaatatttgggaggatcagaagcttggtcctgattttgccatcaacaggaacttgatgacttcaagggagtccccaaaccctgggtttctgttttctcaactctaacatgaggggctagatgcatctggtttagttagtctccatgatggtttagttcgtctccatgatcctgtgaatttcagatgttgaaaatcttcggaaaagccctgaaagatgaacagtggtctcaaatagtcaagaccccctgctgggaggagcttctatcctgctctgtggaagaaatgggcatgccagatgcctg

SEQ ID NO: 527 - DNA, 442 bp, Homo sapiens
gtgggtctgtctgttgccctgtgctgcgcggtgcactctctccccctcggatctccttgtggagggtgggttgctcctgctgcccctcccatcacccatctctctgagctgcattatttttagggttataggattttctgggtgtctgatgtcatcagcaacccctactgttcgccagaactttcatgggcacgagcattcacacacacacacactcctcctcaatttctaacgctgaaaccatggtttttttttttttttttgagacagagtctcgctctgtcacccaggctggagtgcagtggtgtgatctcggctcactgcaacctccacctcccgggttcaagtgattctcctgcctcagcctcccgagtagctgggactacagcttacgcagcccagtcccatgtcccgccatccctcaccattgtcgagggtgacc

SEQ ID NO: 528 - DNA, 373 bp, Homo sapiens
gtgcctgcattttccccgaattgtttaaccctcatgcttcagaattaggctgaggcttgcggggtgggtcatgttgacctgggtgaacagagatccctttaagaagaacttctccatgttccagaggcgcgttcttactgcagatggcgacactgaggcccagagagacatcatgaccagcctcaggtcccacatgcagcctgctgctctgtagcctaaatcagatcactgtcccagctttcaggtcaaggctctggttgtgacacctgggcctggactgcgggtgaaaagttttgatgcaaaaacacagaccgtccattgtcctatgggctaagtggactcccttctgctaaccagagatgcttgtgctggc

SEQ ID NO: 529 - DNA, 2958 bp, Homo sapiens
agccaattggggtctttgaggcgaatgcgaggctggggccggttgcctaccggccgcttctcgccgaggcagtccagacttttcccccggcggtgcccgctccaagacagcatctgtcaacgctcctcttctcccctcctcctcctgccgggccgggctccgccggctgcggccgagaggacgcgggacccggcgcggtgagcccatcagctgtcaggcgagcggcgaagcggctggagggcggcgagagacacacaaagaacgcggtgggcggcggcggcgaaaggggacggcaactcctccccgcgcccgccggtgccaccgccggccgtgcttgttccgaggccgcgcagacaatgcggccgggctcgtccccgcgtgccccagagtgcggagcgcccgcgctcccccgaccccaacttgaccgtctcccggctcgcccagccccctcccggggtaggggcgccccctccctccggtggccggcgaaggaagtcggtccgcggccgcagatcccggcaacttgcgaaccgggaaaagtttgcggcgcctccgcggggcggcgcgacgcggcccgcccctcgcgtccgcggtcatcgcgggtgactttctcgactcgtcgtcagccggggccgcagcgcggccggtggggactgcggggcgggccggagtccgtccgagggctcccgcacctcgggctgcggatttcaggtactccactgggcattttctcttcatggagcttatagcaacaaaagtgttttacaaaacaccagacatgttggcatcatctcttagttgggccatgtggccagggaacccttcatgaaaccacctctgcagtcctggagagttgctgtagaagaaggaaaagagaggaagacaacacaacacaggaggggataagtacctctggacacaatggaagtagtagttgttgagcagagggaaagggataggagaaggatgtggactgcagtgctgcagtgccaggtaataactttgatcatgtacctccttggctcaggtgctgtctcttctactctcctccttacttgtactaccttatttagcacttaattatatactttcttgactcactttgagacacactgattatgtggtctgcctcaaagacagaatcctagttttggattttagcattactgatctatagccttgcaggggcttaaggatggcagctgtctctctcccttgggatctagcttttgcaaatattgaagggaagagatttctttgatcttataggaatagatccacagttcctctccagatttgcttttatagagaagtgtgtgtcaccaaaacaatggagatacggtcagagaggcccctacccccagaattttaatataattttactttctggggcatttattcttgacaaatactttctctcctatcagctcacttgttcctcacaaaaaccctataagatattaatattattaaacagacccctatgaagcacctcaagtctttctctcttcccacttccattcttgcacaccttttgctagactagtctctgcgttcatcacatcaggtttctaaaataaaagtcccctaataactttctatttgttctctcatcatattgaaccttttttgcctggcttataaggtggccttaaaaccccattttcctctaaacattgtctctgtagttcaggaatatggcaggctcaacactatgcttgagcccatattgcttccctcattagtgatgcctcctctcagaccacccagattctactcattcttcaatttccagcttctccttggagccttcccagatcattagcttcttaaaaatcccagctttctctgaattctgatggtagcccccgttatttggacaattatgtcctggtcttaaagtcctaatgggaaaaaaaagtacatgatggacttcatgtagagaagaaagcactggactgagttttaagacagctgctaaggagctgtgtgagccaaaccaggttactttacctctctggatctatatttgctgatctgttaagtggagacaattgggtcagataatcttggtggtctttgcttattctgaggttcttggacaacttggcctagttcacgtgggatgggattgaagatcttactgagttcttggatggaaatgtcagtaatgggcacttagtgccttcaggacttgttctatactatcccagaaatttctgatgctaaacttggcaatttttaaatgtcatattccttttctccaaactctttaaccacaagaattcagggaaggttatggggggtgacttagttatctggataatacatattgtggacaatatagcattatccttgggaatgatttcatattgttgaataaataggatcaacttcttgataaaccttagtcccaagcatttcatcttcattggatagtgttacatagtaatatatttatgttttcttttaatcatttcataacttggaaaatactaacatagtcaaaactctagggtaggtgatacatgagtttctgtagtaatctggttggagacatgttgtaattctgtatatatatgtacatttatcccatgcatgttatgcctaaactaagacggatacccctgaattaagaggtgctgttatacattgaccaggcttaagaatatctctttaaagtgtgtcgacatttaattgacctttggaagttcattctgttaatcatactcaaagtgctaaagctatggttgactgctctggtgtttttatattcattcgtgctttagcatataaattcttcagcataattgctacttatttagcaagagtttcctttatttgaaaatgtgagttgtgcttgtatttttgtgtctttctttctttctttctttttttaaactttgcttcaggctgggtagtggtagaggtttgaattaaaatgttttcctgtcagta

SEQ ID NO: 530 - DNA, 3828 bp, Homo sapiens
ggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcagaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttcgcgaggtcccagagaaaagcaggctgtggaaaactgggcgcccccttctttcacccaccttcttacccctgtcagcgccgagatctgtagcagaggttcctggtctgaaccaccgattggcaaagaaagctgcagattaaacttctcgttttacagagaaggaaactgaggcccagacagccgaaggagaggcagtctatggagcgcagcggtaaagagcaaggggttggtggccccagaatggaacctcagctctgccaggtaaccaacagctgtgtgaccctagacgagttccgcagtctctctgagcctcagtttccttactggtcaaacgggataatgggatactagcgcccacctcatagagttgttctgaggattagataggagagcagtgtgggcctttgactcaatcaactttacagtttttgttactactactgtttaaggacaggaaacaagttagtggcaacgccgagctgaaacccgggtctctcaacgtccagttggaggttttacccaccacccctctacctcttcagagctaatgggatgcagaggcgaggacagcccctggaaaaccatgtggcgttgatacactggcaaagcgcaggcatcccggcctcgaaggtgcataattattgcaatatgaaaaaatcgaggctgggtaggagcagggcagtgaggatttctcaacccttactttcaccccggcgctgtccactgcatctgacagagcgcggagctgggctgctacagccgcaaccccagggaccagtgcgcacgcctgggccgccctccgggagtcacccagcggccgcggacaactgaataaacaccccaaagcgctgcggtcggtcaagggcggggacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggaaaaaaaattattctgcacctgtaaaaaaaaaaaaaaaaaaaaaaaaaaaaaaaaagtcacacaatcttaaaatctttccgtcttagacaattctttccaagtatttcttttgtgttttttaacctataaaagataatggaatgttttatagactggattttatctcatcccctttccctctcccaactgccctcagtttaatagttgtcagttttacctcagtgttgaatttaattatataggaacaaaatattcctcagtaaatttgcttgctaaatattctgtcacatttacttcccctttgagaaatggcttaattatagaaatctacctgcatctaggaattttttttcccttttcttttttgaccgccattccagcttaatcgtaagcagagattttatttgtgcagtaattttatttgtgttctaaattcgtttagccaatttcttccttctttctttagtaacaccctgctttattttcctctcactttgaccccctgaagaaaacgaaggaccaagcagtactggagaatctgttaaatttattagcataaatgcttagacaaaacgagatataaatcattcagatgtattaagccataaagtatcccaatgaagtcagtcccttgccagggtcctggtgtataaatgttcatataaaacaaggtatcagtattatctttcaaactgaatatatgttgtaaaaatatccaaggttgagttaggaatatggggggagggtgcagcagggcaggaaggggatattctttagaccagtttgttaacatagtggtggctcagaaagtatggtggaaaggaaaaatttcaaccgtttacatttggagtcttcttagataatatgtttttaaataacggtatgcaggatatatttgagagcaaaggaataagagaaaaaaaagatgactagagggagaaaggcattgatttctgtagaatgcatttgtcccccaaagatcagtttagcttcacaaaaatccacccagaggaggcactggctcttcacacagataacggattatccagtagagaagagctacctgggccttcgtctggcaactgggatatgcagccgctggtcagcagagggatgtgtattcattagcggtggaagacgaggaaagcgcccgggagtgaggaagaggaatggacagaattcctggcagaagcttaccaagacaaaaatcagacacaatgtttaagcagcaattgctcgtgaagttcataaccatggctctctgtaaatcttggcaaattgggacattctttgctttttggaaatgattgttttcaagactttttttaaaaaatcaagttgtccaccagaaaaa

SEQ ID NO: 531 - DNA, 317 bp, Homo sapiens
tgtggtttcactgctgttcaagggctctgttttgactgcaagaagagacactacgtagaagaataagtacataaaataagctgcattcatactaagtgagcatcaacaagcacctcttgatctctaagacagcaaaccaaaatcattacatgcaataaaatggaagcaaaatccttttatagaagacaagcaccgtatttctcaaccaaatgcaagcttacacaccaaatgttttgatttcaaaagaaacaatattttaatgtcctaggttgaagagttttgtgggattattattctgtatcttcaaagtaagtgag

SEQ ID NO: 532 - DNA, 537 bp, Homo sapiens
catccgctcattacagctggtgagctttctgttaacagtgctgcaagaacaaaggtggaggcattgaagcaacttgtgcttctctcctcattgcaacccacccttgtggcaggaaaagtcttcttgatcattcaaaccacttgaagacagcattcttcttcaggaattgaactgaatgtgctgccatcctaggcaaaaactcccaactgactgatttgcaaaggatttgtagctgataaagatggtgcttgggacacacattctccttcctttctggaggaaatctaaatgcctggagctgagcaggtgtttcatgtcgagaaagagaagaatatctggggatagggcattaaatgatgagaggaccaggataaggaaaccagaggctggcctgaatcactacaatcctggtcttgtagaaatccttgactcacctcttcattccaaattagcaaaatgagcaacatgtaattttttttatctacaggatttgggtttgttctgacttgtctaattacactcttcaattcaccaaaa

SEQ ID NO: 533 - DNA, 821 bp, Homo sapiens
ggttctgtggaaaatctgatgtgccaagaagtgttccataccattctgagaactctggatacctgctcagacagctctgtttcagctaaacagtaacatctgggagggaagcttaatgtggaatcaaggatgaagtttaacacaggaatgagaagtagagcacatagctgctaagataaggctggagtctcagctcattgcaacctttgcctgccaggttcaagtgattctcctgcctcagcttcccaagtaactgggactacagaatgtaatcatcgcaaggccaggagatgcgtttggtctgtgctgcatctcaagcaggacaatggctggaacatagtagggtctccaaaaatgtttgttgaacgttgctgatggcggcatcctggagtaggaaaaagactgaagagtggaaaaagaaatcctgacatgaattctgggcaaaggcaagcagtagctgacttggaaaatgattacactatagatggcagcacaccactacctacgatccgatcaccagcctgggtttgtaagtcagagctgttggtcaggagatggcagctaatgagtaatcagtccaaactgaatggcaaattaatgtcttcattaagtgaacaaaccagcttcctccataaacaaggtcagagtatttataacccagtgtatttcataaaagcaaaaacgcatctccatttacataactttactatggagctcatgatttatctgcacaaagcatatgcaaaatctcacttgtataccgtctttaataaggacccatgccattctgatgtaattattaataaagtcacacttgataa

SEQ ID NO: 534 - DNA, 553 bp, Homo sapiens
actttgcaaatactggggctacttttcacactggccaagtcagtttatgacaaaaacatgaggcaattagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacaggctgtattgattggggtgtagactgaactatccggggtctgtttcttttcggtgatgaaagtcttgagaaggtagtaatggataagatgtgaaggagaggagagatggagatttggagtgtaggcggaaatccgaacgccagaagatctgaatggaatgttctggattgaagaaagtgggaaatggcctcaattcacaaagtcacagcctgatagaaaccagtgtgactttactgcccagtgaacccatctcgtcctccagcctttaggaggtaggttgga

SEQ ID NO: 535 - DNA, 5356 bp, Homo sapiens
ggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggccctggatgcttcctgccagattccatccaccccagggaggggtggccacctctccatgtcactcaataaggactctgccaaggtcggtgccctgctccatggacagtggactctgctccaggccctgcaagagatgagggatgcagctgtccgcatggctgcagaagcccaggtctcctacctgcctgtgggcattgagcatcatttcttagagctggaccacatcctgggcctcctgcaggaggagcttcggggcccggcggtgaggggaaagtagtgggcagcatggggtccccaaccttgacgtctgggctcagccacccttcttccagcacttcagcagccccaagccctcctgcctttgccctcccctcccaggactgctggcaagcacatctgtgcctgcgtcagtgtctgtgtgtccgtgcatacgtgccaccacacatctcatcttttctctgtcctctctcctctctgaagagtcccacagactcagcagcagcagggccctggacacccctcgatccaatatccaatgaccagaggggaaacagggtgggctgtgtccaagatcactgagtccagtggtagtcagcgcttccccatgccctgtcccatcctcgttccctcgccctcaccctgctcaccctgtctttggctctttacttctctcttctcttctcttgaaccctgggccccttgatgatcccaggccccaggccttcccagctgttcccacagatgcagccatgggagctggggtgggggaggcagctttgtacactgccccctctccaagttccctggatgagagccaggacgccccaagcctggggaaaggaaacggagcatgcacatggcctagattccaggtcccccactccttctgggtaagaagctaagctaggaccttagactttcccctttcagaaggcagcagccaaggccccccgcccacctggccagcccccaagggcctcctcgtgcctgcagcctggcatcttcctgttctacctcctcattcagactgtaggcttcttcggctacgtgcacttcaggtgggccaccccgtgagcaggatttcccacagcactggcatctcttggttctcagctataaccattggatttaggagaggggacacttcagctcagaggggacctgccgagtccccaaatcacaaagagcacagtgcgggatagggcccattctctcaccaagcactactgaccacctgctcggcccccagccccatctgggtcctgctctcacggagctcactcacacaggtctaactgaccctgtgtcgtcaatgccatgatgtcaggaagctgaggggctacgagagtgcaggagaacacacttgaccccccttggttagggaatcaacctggaagggacatttgatatggtcattaaggtgactaggagttttccaccctgacaagataggtaaaggcatagaggcagagggaacagcatgagaaaaggcagggaggcatgagaaaaacataatattttagagaaaaagtggcaagttcagtaatgttggagcaaagggcaggacgagtttgtgaaattgggcaaagagatctgaaaaagtgagaggaggtcactagttttgcttggtgtgtgtttgctgaatgaacgtgcaccgtttagagatgtggggtgtgctaaaggcctcagcaatgagactgacaatctttgttggtggaatttcaagacaagaagagtccgtgtgggctgggatggtcctggaggaggagtaaaatgagctaagctttaaaaagcacaaggtagaaatgctcacaggcttcagcacatgcacaggagtgcagtggtggcaatcagcctggagccactaggacagaccttacatgcccagggggaaagcgtggaccatatgcagcgggccaaaggagccacagaaagtccaagaacagcggaggttgtggtgcagtgagtgtagcaaggcaagcatgagagtcctggtttttcaaaagcccataaaggagagacgcaagtaacctgtaaccttctctctggcagcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctccccatgctgtgatatgctggtcttctttccagcctcaccctaatctctgtgaaggcttccaccccttctgagtacctggctgggagtgcgctccaagcaggcaaggaggccaaggcctggcttaacctccaaaagaccggataccccacgggctttgaaccctcgactatggagggaaagagagccatgactgtatataattctgtcctcaaactcacccataacagagagcagtgtctcccagtgtccctcctggcccagctcagccagcatcactgagcagctctctccctccccactcctagctgctccaggggcagcaggggaggcgcgtgacagagcaaccctgagaggccaactcgtggaaccataactgggattcccgctcgcgccctcaggtctccctcccttttccagcgtcaagctctctgggcagctgctgggttcagtgacttgggtgggtggggagaatggggggcacccaaggctgggtttttaccccttgctgctacctggatctcccagctgaaatcctagttattagtggcccaggagaggagaaagttggaagaggctatggaacagggttccgggagtgtatgagctcaacccctctcccgggagagcgaccccaccaccgcaggccctaatcctctgtcagcagtgcccagcggagctcggcgttgaaggaggcacgtgggggaggcgggagtggggagcgggcacgtggtccagccttctcagccccgtgctgccccccgcccccagtgaggaggggtttggggaggtgggggcgggcccgggcgggggcgggcggcgggcggtgccaagcgtggggcgcgggcccgcggcgggagctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgaggataagggagatggggacaagtcggcagccgaagctcagggcatgagccgggaggagtacgaggagtatcagaagcaactcgtggaagagaagatggagcgggatgcacagttcacacagaggaaggcagagcgggccacactgcggagccacttccgagacaaataccggctacccaagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacaaaacccctggcacgttcagagacagaagccacagatacatcccggcacagacagacacacacgaggccagctcccttgcgtgtccagcccctccagacaccaccactcagaaactctgagagagagcatgggcagacaccctcagcagacaggaggcctgagttccagtctccacctttattgttcttgaaagcccctgctctctctgagccttatttcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtgtgcctaccttcccacttcttactggcttccaggagtcttggagttcatagccccccgagcctgccttaaaggggtgtcctccaccccccacctacagcttcacaggaggggagaaggcatccagtgctaggagtagaagtgtctccagctctgttctcttggggccctgggtgaaggtggggtctggggcttatgaaataggtctgggctttgaggaggatggagcagcctcattatgtggggaagatggggcctctggggcgtcactgagaccacaggtggggccggggctggaccgcagctgtcttgggtgcctgtgcctacacccctcctcaccctagagacggaagatgtgcaaaaagaaagaaggaagggcaactgcattccagccccacactgtgatgactttgagcctgtcctttccctccttgagcctgtcttgcttgtcccctgtaaaatgaacagtccccctctcccccaaatagtaataatacatgtttcaaagggtgaccatttataaagcatatgacaaaccatatcaataaatgtaactcattctttt

SEQ ID NO: 536 - DNA, 1540 bp, Homo sapiens
actcccaacctccaggccccatggccacttcctccctcctgcgaggacagctggcaactggggtgcagtaccctccctgccccccgcccccttctttgggccacacgctgtgagaaggggtctagatcctcgagggggggatggctgccctgtgccggctctgcaggcacatgatagccgactgccactgctggggcgaggagggggggcctctttccacccgacagataccgacacccaatatagaaaccgagaagagccaggcaggaaaacacaagctctcacccgtctggaggctccgcggcttggcgcccagatatgccaggttcacgttggccttgcggccgtcgatgatggggttcgggtctttgcaagccctctcagctgccgcccggtcggccatggtcacctggtggagcagagacacatcaggggctgccgtggggggaaccaggggcgaaaggggcagacggctccgccctggcaccggatgctgccacccctctcttcccttcctctgagggtgcctgtgacccagggtccttgagccaaagctcctctgaaccctacctggggctctcccacaaagatgcctcctggattccagctcctcccgtcaaagttcaaggcctgggaaatgtggccttcaaggacaaaaataatcccctgcggggatagggcaaaaatgaaccccgaagggagcttggggggccgcctggacttgcccaccagtgagggccgagactttcctctgagaaggagtttgcgacgctatgcttggaaggcaaccgtcaggtgctaagcagaaccatgcttgggccttccacaccagtcaaggtactctcacagcaaagccccaccgaaggggcccacaggttggattcgaggtacgtgaagtcccaagagatgacatgaagccccaaatggatgccctggctccccagcaccagagggaaacgccccctcaccgaagacagtggcaagtgccatgcttcaagtaacacagggagcggcctccagtgcacctgttttagcagccagtcctggaggcagaaagatttacaagggagtggaaaggctggcaaacacaggacacatggagatgcccaaagtcagtgggggtcagggttcaacctggaaatgcagtcttctcagctgaggaaggcagtgagtcctggccaggaagccggtccaagcccctgcctcgtccccagttcacctcgtgaaagctgatgaatgaccaatgcttgcagaggggtctggagtaatggcggcaccgtattaaggggcgatcaggctgtatcttgacactgggattcataagaggaggaagaaacctatcatgctgacgggtagtgaagaagagaaatgaaagacaaaagacacaagagaaggccaggtgcagtggttcactcctgtaatcccagctacctgggaggctgagacaggagaatcgcctgaacccgggaggcagagggcgcactgagctgagatcacgccactgcagtgcagcctggacgacagggcgagactcagtctc

SEQ ID NO: 537 - DNA, 3300 bp, Homo sapiens
aaaggtgccgccccggtctctccgtcccgccccgagcacgcccctcactccgcaccggccaatggcaccgccccgtccgccccgctctgggaacgccgctccagcagatgtgacatagactggaagtgatggacccagacaacaatcagaaccaaagcaccagatgagccacctcagccacgtgagccatgccagccaccctacctgtgaccccatctgtggccccagttatcatggagtagagaaagaaagagcaagagcaggcaggagggcaagacgacagcaagagaacaagaaagaaacctgaagaaaagaagttttagtgaagatggaaaggcttaaaacataccatggagaatgacctcagccttctgtgtggaggatttgcacttggagataaggaaagagagggacttcagagagttaagcagttcagtttcctttgcatttcttacatctgagcaggtgaccggagtgaacactctggaagccacagtggagtcctctgcttggggcctctttctggaaaccagatcaattcactgaaaaacaatttgcaaatgactagttcattgagaagcaagtgaccaaaactctaagtcaccgaatgacctgctcattgatttattgaagattttattccaaggtctacttccctctgcatttgtggctgccatttcatatgtgaatgggtgggcagtttgctgtcatgccctttttgtgcatctctatcctgaccctgtatgtggtgctgccttttcccaggccccctgcccctgccctggcctctgtctgcaaagcagttgcagcaacctccctcttgctgttgaagatactcatctgatgtctattgtgaattggctggagcccttctacaggtttgttagcgtccctctgcatccaggctgatggtgcctgccatgcttctacatgctgttctctgccacccacctgagcccagctagagtcagtggggaagtggaggagccacatcaaaacagtgtgtccacctcagtcaccctccagtgtgcattgacgaccaggcagccattagacccaaatgcagccccacagcatagaggcaaatggaaaggccacatatcctcttttcattctccttccatgtgaggccctgcagagcctggcatctgtcttcatcatcgtggcatcctcagactctttcttcttcctggagcgagctgtgctctctgaagccactgcctgtgtgggaagtaccccagcatttcttcgctgttgccaggcatcccttcctgtcctaccacttcaaatgcatcttttcatgtgtccttcctgagcacctctagcagctgcatgttcctgtttcagcctctgcctttccacagctcctccaagattcctctattgcagagcacagcaccaccttgcaggaaacctcccagaggactgtgaggaccatgaagcaaggggctgcatcttattctccttggtgtctggcccagcagtgggcccaggccagatgccattaagaacattcatgattcatgagaggagatcaaaatatcaacataaacaggagtttgaaagaagttgatttcaacccttgtggatgactatgagagattcaaggcttcagtggagaatgcacctacagatatggtggaaacagcaaaagaaatagaatcagaagtggagcctgaagattaaactgaattgctgcaatctcatgataaaacttgaacagatgaggagttgcttcttacagggttaggaactgtcagagtgtggctcaactgagaaacaactttctgagtagaggtggggaaagatgggctaagaggcttctgaggtcatgtgttcaccatcactgaggcactgtgatgtgttaggtgggtctgaaccctctggcttcagagagagtgcctgtggggcaccaggtaatccgagactgcagctcagagattactccagcaaagggtcaggtatccacactgcctctgctacctgcccgttggtcactcactcattgttctgatgataagatcgacagatcacaagaaggactgtggcttgaagttccagagcagagatgcacattactgtctaccgctgaagtgaactgctgcccctctggagtctggatatcatcagaatgaaaaagcgagtgtcatgggcaaagcgaggagtccagcaggatggacgctgtgtggtttctcagctggagcgcagcaggagcaagcgtggaaacatccttcttttctcttctcccctcccctccccaagtgcaaatggaacctgtgaaatatggcttgattttgaggcttctaattcttcattgcactcccagacccttcttttatctctggtggcagccctgagaataaatctcttggtcacattcttcaatcagtttctcccagagaaaaggttaggctgcaaggatgataggaaccagacttcaaatgggtttccaggagctgagggaaggaaaggtttttcctacagtttctccagccaagggattaagaaaaggatggggtcatagagcaacagcagtagaaggtggcattccaagactttctccaggactccacctaaggtcagtttctcgtcactcatacctgtttgtcttttgcctggccaccatcaatgtagagttaagaaccaggaggcaggaacatgctccccaagtcacagtctgcctcccacatactgcagtttgattacagcatcctgcctctccacaggaggaaagtggtgtcattctccagaaccaggtgtggattgtgatcagacctagaattggctaggtaaaaagcttaagagagagattccatgtcctgcaacactgtccacaattcaaatctgtattcaaaataaaactaaaagcagagaaaatccacagcagacctaccactctccaggcagatagtgccctctccacaatctgcagccatcaactgcctctgctggacgctgcccagagagagacctgctgctgcagagcagctctgtgtcagccactgcggccttagagagagctgcaggaaatgggacttctcacgtgctctccacagtggaaccacaggtcagcagctgaatggagcctctaccctctggatgcctttcttgtcacttagtattcttttttttctcattctggtactttatctgctggaaactttcaaatgtattactaatgtccttccaaacagactccacatgggaattttcatgatatcttggctatatttacacaaagattagcttgcaggaaacacaaaataagtatgcataaataaatgagtggctcagcacacc

SEQ ID NO: 538 - DNA, 1795 bp, Homo sapiens
acaagaaccggcagcggcggcagcagcagcagcagcagcagcagcagcagcagcaactggatttgctttttcaccagaggatccagatttccctgtggcctcgcaaacaaaaaagaaggaagacggagcagcacagtcatccctttgtgaaaaaggcattcagagacggggtttcaccgtgttagccaggatggtctcgatctcctgacctcgcgatccgcccgcctcggcctcccaaagtgctgggattacaggcgtgagccaccgcgcccggccttagctggtttttcaaaagtcatggcgtgtaattgtccgaacagtgaacttcggagatccaccggaggggcgaggccacagctcgaccgcgagcacctgagcatcctgcaccgcctgcgacggccgtcagggggcgcgatgccgcctcacagaacctcaagcggcgcccgggttccggcacagacggcctgcggctccagggggcggagccgagccgtctcctcaggacctacgcaggaggcgccgtcatccctacagggacacctgagagggcccagcctcctcctcctcaggacccactcgggagacgccgctggctctctaggaacacctggggaccgtggccagggacgacccagcctccttctcctcagctcctcaggaacgactggggaagctgtggcttcatggtccccgaggctgcccgaggaaaggtatttcaggacagccaggagggggcgcacatccgccgcgaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattgatgatgattattccccaccttctaagagacaaagaccaacgagccaccacagccaccagtcccagaacctgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatccgtttcctggccgtagaggtggcctgcactccgcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaattttttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccat

SEQ ID NO: 539 - DNA, 548 bp, Homo sapiens
ctggcggggctgcggcggctaggagagtgatgccatggagcacagtggtggataaggaagacatggtctggccgtaacaattttgaaatctaatgaagcagattaaaaagtcaatggaagcatttgagaaaaaaacacctttcaaagtgaaactgtattatgttactggaacatttgttaaaaatctattaacctctaagaagccaagaacagaaattcagcaataaaaggtaaacgtactctcagaaaccacctctggcctgaaaaggggccgactgaaacatatacctatttgaagatccctggcacacagatacagcagaagaagcccaaatggtttttgtggagcctttcggatttttttatataaaagagtcctgttctgttgtccaggctggagttcagtggcgagatcttggctcactgcaacctccgcctcccaggtttaagcgattctcatgcctcagccttctaagtagctgggactaaagacagagtctttctgtgttgcccaagctggagtgcagtggtgctcgtctcactgcaac

SEQ ID NO: 540 - DNA, 2666 bp, Homo sapiens
ttttttttttttttttttgagacggagtctcgctctgtcaccaggctggagtgcagtggcgcgatcttggctcactgcaagttccgcctcccgggttcacgccattctcctgcctcagcctcccgagtagctgggactacaggcgcccgccaccatgcccgactaatttttttgtatttttagtagagacgaggtttcaccggattagcgaggatggtctcaatctcctgaccttgtgatccacccgcctcagcctcccaaagtgctgggattatgggcttgagccaccgcgcccagctagacttttttctaatagagtcccccataaattttattaccatagatacgctgtgtatgtactgtttctgtgctttgtacatgaaaagagtaaaatgtttttgtttttgttttggagacagtctcactctgttacctgggctggagtgcaatggcatgatctcagctcactgcaatctctgcctcctgggttcaagcgattctcttgcttcagcctcctgagtagctgggattacaggcggccaccaccacccctggctaatttttgtatttttagtagaggtttcaccacgttgatcaggctggtctcaaactcctgacctcgtggtctgcctgccttggcctcccaaagtgctgggattacaggcgtgagccaccatgcccaaccaattttttttttttaaatccttggtagtgattgacccccattgagaatgcatgctctaatattttttaaaagggaagaagacctagtgatagacctttgcattggcaggcatgtctttatgtttatacagtgaagtagtattttttctgtcagggtcaatagaaagtagacgaaattcattttcagccaatctttcaccagttgtgctttgttccttaccccaccacaggcaacagacaaagcatttcctgctgtctttcaaggtcttaacagattctttcttgattataaatgtattactaagtagaatcatttgggttctttctataaaaatcagtgaaaatcctctagatgaatgaattaaagttgtaggcataacactgataaacctctgctctcatactgaagtaggctgcttgcaggaactgacaactattggttggctttaaatgtaatgtagatgccaaagttttagtgtacagtgttacttaaattaccaaattacctttgtacaaatattcctcagatgctgtctacaggtgccatataaaataggttgataagtatttgcaaattctggtaaattgccttgctatgatttttcatgctcagtattagtcctctagtatcaatacgaagtttttctattccccagcctactaaggcctacaggttaaaataccaggaataaaaaggttttcagtggacttgatttaagtggaatctggatgatgtgacaagtacctttgtctttggagtaatgagtttataattggcttttgtccaaaaactcttaagtggattaatatctgaacaatcttagacataattatatgaaactggatcagaaaggctttctgactcctttctcttcacttttttctcccagcttaactagaggcaattaacagtcatttcaaatctaattatttttattttccagtgtacttatcatcctttcatctttatgctaggagtatagtctcagttcttaatgagttgatgggatgaagatatagatagatagatagatagatagatagatagatatttttttttttttttttttttttttttttttttttgagacagagtctcgctctgtcgcccaggcgggagtgcagtggcacaatctcggctcactgcaagctccgccttgggggttcacaccattctcctgtctcagcctcctagctgggattacaggcgcccaccaaccaagcccggctaaggtatttttaaatgtactcaatcactgtcattttagtaaccttgaatcagaacctcagttgttaaaggcttaactgcttgtggcaactactatagtgctctagtggggacagtggttaaaatctgcagaatcccttgctttgtcatcttatccagaaggactgatagcttgttaaactgtggtatgattagaatgttggtggttgtgtagtgcatttggggtgctacaacgttaatcaaatataattgagctgttctgtttccagtcagtgtaaccatttaaaaataccttggcaaaacaagctaggagctagttcatgctaatattcttaaggacaaaaatagtttacagcttttttttttttaatctgaaatcctgaaggctatgcttaaaagttagagataaacctgttggaaataagtgattcatttatagactgaagcctctatgacttcaaaaagatactcaacagtctctggcatttgaagaacaaaatattttctctgtaaatacacctcatttccattctagttaggagcaatggcgcccaggacggcacacagaatggagaaaactggatagctggtaactcatttagctcttggcactctaaaaaacctcaaatacagccatccaagccagtaattctattgctgcgttatttctgtgtttaactgtgaaacttgcttcttgtctgtacccttgaaatggaataaaatttcatgagactccttgttaatgtagagaaaa

SEQ ID NO: 541 - DNA, 329 bp, Homo sapiens
ctggaattccatggctgaggtgcaacaggtcccacagcctctccagcctctgtgggaagaaggatcatctgatgcctatgtaatagagttgctgaaggagtggaagcagctttgacattatcagtggaacccaccagtgcagactgcttcaccaagggcacctgaggcagcagatctgaggattagggacgtagggagctgaagcctggctggagaggtggtgcgcacaagaacccccacattccccgacaggagcctgaaaaagcaagacgccatgttgggaggacacggaagcagttctagggagaggagcacatggcaagaagcca

SEQ ID NO: 542 - DNA, 555 bp, Homo sapiens
ctcgactcgtagccgcgggctgcgcggggagtcgccgctgccgccgccgccgccgccgccgccgccgccgccaagcgcccgtcggacggggaggaggagcaggagctggaggaggagccgccgccgccagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccag

SEQ ID NO: 543 - DNA, 132 bp, Homo sapiens
actgcccctagaggcgttgcagctgtggctgccgtgtcacatctgtgtcattaggtggcagagattagagaggctatgtctacgctcagcgttctgccccgtgaacgtttgaatgtttgatagtctcacact

SEQ ID NO: 544 - DNA, 2643 bp, Homo sapiens
aacactcaccaggaagttgatgtcggccgggcgcactaggcggtagctgcacgtcgcgcaatcctggctgcattcggcccgcacggtcgccaggagcccggggccgagcaacagcagccaagtgcaaagtgtcaggaaccgcgccatggactgcgaggagagagggacgcgtgcttcgagcctgcctgggcgcagaacggggtccctcggcaggaccctcgccgcgacagcctcagcaggggatcgtcgagcaaaagcccgcaggaatgctcctttctggggccccgccctcccggccgacagcttttaggtagacgtggaggcgactcagatcgcctcgcggttcccgggatggcgcggtcgcccccaacgcgaggctgcctggggcacccggctcttttcctgggcgtccgcggcccagggcaagattccggagagaacgccgcagaccaggggcgagagagcgggagccgggggaggcaggacattgactggggtcacaaagaagaaccagggaacgctgttggggaacccatgcaatgaaatgtgaagggaaagagggcgggcagacgtccccaaacccgctcagcaaagacaagcttcgggcaaattcactcacgttgacgctgttcggatggagcaggccaattggaaaagccgggttcagacacgactctagagggaagagaagaaggaagctgaactgacacgaaacaaaagaagtccgttgttttggattgagttccatacttggctggcccagaggttgatctcaccaccattcagatatccaagaagaagccacctgttggatttaagaaaacccagtcaccaataatgtggaatccatttcgtggagacaagctacttttagtcaaaaattgtaaggcacggtttgtcaagatggccgatacacaacagctccagtctacgcatcccagcatgagcgatgcagaagacgggtgatttctgcatttccaactgaggtaccgggttcatctcactgaagcttgtcggacagtgggctcaggacagtgggtgaagcccactgagcatgagccgaagcagggcgaggcatcgcctcacccaggaagtgcaagggatcagagaattccctttcctagccaaggaaagctgtgacagatggcacctggaaaattaggtcactcccaccttaatattgcgcttttccagtggtcttagcaaacaacacaccaggagtttatatcccgcgcctggcccagagggtcccacacccacagagtctagctcattgctagcagagcagcctgagatcgaactgcaaggcagcagcaaggctgggagaggagcacccaccattgctgaggcttgagtaggtaaacaaagcggctaggaaacttgaactgggtggagcccactgcagctcaaggaggcctgcctgcctctgtagactccacctctgcagccagggcacagctgaacaaaaggcagcagaaacctctgcagacttaaatgtccctgtctgacagtttggaagagagtagtggttctcccagcacgcagctggagatctgagaatggacaaactgcctcctcaagtgggtccctgacccccaagtagcctagctgggaggcattccccagtaggggcagaatgacacctcacatggccgggtacccctctgagacgaagcttccaggggaaagatcaggcagcaacatttgctgttcagcaatattcgctgttctgcagcttctgctgctgatacctaggcaaacagcgtctggagtggacctccagcaaactccaacagacctgcagatgaggatcctgactgttagaaggaaaactaacaaacagcaaggacatccacaccaaaaccccatctgtacgtcaccatcatcaaagaacaaaatgataaaaccacaaaaatggggaaaaaacagagcagagaagctgaaaattctaaaaatcagagtgcctctccccctccaaaggaatgcagctcctcgtcaacaatggaacaaagctggatggagagtgactttgatgagttgagagaagaaggcttcagacgatcaaacttctccgagctaaagaaggaagatcgaacccatcccaaagaagctaaaaaactttaaaaaagattagacaaatggctaactagaatatccagtgtagagaagtccttaaatgatctgttggagctgaaaaccatggcatgagaactacgcgatgcatgcacaaacttcagtagccctgcaagagctcctgagggaagcactaaacatggaaaggaacaactggtatcagccactgcaaaaacatgccaaattgtaaagaccatcaaggctaggaagaaactgcatcaactaatgagcaaaataaccagctaacatcataatgacacaatcgaattcacacataacaatattaaccttaaatgtaaatgggctaaattctccaattaaaagacacagattggcaaattggataaacagtcaagacccatcagtgtgctgtattcaggagacccatctcacgtgcagagacacacataggctcaaaataaagggaaggaggaagatctaccaagcaaatggaaaacaaaaaaaggcaggggttgcaatcctagcctctgacaaaacagactttaaacc

SEQ ID NO: 545 - DNA, 2839 bp, Homo sapiens
agatcagcagcaacacctagccaacccacagcttacttacagcagacatgtgaatcaatctagccaagactaaaagaatcactaaaccaatatgtcatcctatgaataatagtaaacgtttgtcttaaactatcatattataggaaaaaaacctgatatatgaaattaccctgtgagtttatattaaagatacacttaccttctccaacaagagttgtaacaatttttttcttattgcaaacaatgctatggggatacttatagtagcatttctgctcaacgtaatattttattgtagcactgtttgcaataagaaaataattggaaactgcagaaacgatcactaatgaggtatgggttaaaaatcttttaagttgaaagcaacaaatgtgacaattaaaaggcataaattagacatatattttacattatcacaacttgtattactaaatgataaaaatgagttgcaaaataatatatagaactttatattttataaatatgcacatgaaaaaatgtttgtaagtatgcacaaactgttaacagttattacttcagaggagtgaaaaataggttgaaaatgagaatgactttcatttttagtatacttaagtacattttcaattttcaattatatgcagtgattttgtcctttaaaaaataggatggacttttttaaatataaggaagacattttctgtgaaacaataaattactcagtatatacttaatgtgcatgaagtatgaggtaggaatacatccactgacattcttgcatttgcataccacttccccaaatatgaactcacttctctgactttgctagggctgaggaatcatcattacaatatctgtaaaactggatttattaagtgcatccatattgtttatgagtcatagaaaatatgttcattttcctatccatgttaaaggctgcttggaggattgacggagcattgcttagaaaatgttctggaattcagatgaagctgtgttagtataaatcattactggttaccatatactcacacatacttaggggataaagatcagaaattacttaaatgtactttgtcttcttcaatctttccgtagcagcacatgggtcaaaatctcctgaaagttgagcaggggagctgtagaagaattcctccttttctcgcagatgaaatcttatgatatagcaggggttacctggccaagaaggtaagtctgtcatccagcagtgcttgcagagggactaaaatgaattaggatgttcagagttgtatgttaggtgctgcagaaaggaagaaaagatctcatccataaaggggtctttgaccctggggaatggcagttggcaattacgctgcttctcagttccatcctgtgttgccccaggtttacttcatggtcacccaaactttctttgccatgtcttttgtaagacttctacttattactatgtatcatcatcttttggtaaatataaattctggctaggagaactaggacagacaggggagctgtctgcacactgtgattaggcatgcatcaattcagagctccatgctgctagctcctgtattctgctgagctcccagggaggaaataggaaaagggaggagaactcacctgtccaattacaacctactctgcagtacaaagtactgcaaattccacacagtggatctctgtgattgaaggagcacttgtaaaatctgagacatcctagtttttgatttggtatccaaaacaaatctgaacttttaattaaatattgttctttttccttcttgtttccaaatgaatagttacaccagcaaacttattggctgaaaagttgtttcctacatttgcactttgaagtgcatcagacagtggtgtgtttggatgtgggtcttgttgagtttggttagtgagttattattggttgggattgcagtggtcctgccaatggaagagaagtaggtgtgccgagtactgtcatgttcacctccgcctttcacagaggcatatttagccctcagttggtaagtgaactttttgacaaaggtttaagaggtcgtagagtctgtgtaaaagacaaaagtccaaaagtgaagcagaaggaatccagcttcttatttatgtctggcatgggaagcttctggatttgatagtgggtgcaccgaaatttgcatcccaagtcatagcctttgctctgccctaccttctggtatgttgtttttcaagttacttaacctctcagggctgcaacttacttatttgaaaaatgaattctagaatcacagagttggatacaatcttaagggccaattagtcaaactttctttccagaggtattctgcatgatctgaaatgtgtctctgaactatagcttcctgaaatttcattattcttgtaggaacacagaggagaacaaagaaaattcaaggaactaaattccttctccacctcaaccaccagcattgatactccatcacttatgtactgcatcaagccgtcctcagaggtgaggaaggtgctgtcaagactagaagcatgtgtccctctctccattgcaagatgggacatagagaggagaaaagtggcagacagaagtcttaggtatgtctttatcagcagcatgaaaatggactaatacagggaccaatgattgcatctacctcatggactttttatgagaattgactgatttaataaatgtaaaagacttagaacactgcctcatctattgtaaacagtcaataaatattagtatcaattttcattgaatcctaatcagtataactataatgttacattcatgaataagacaaaggctgggacaaaataaatgagacacttcactcag

SEQ ID NO: 546 - DNA, 1836 bp, Homo sapiens
gttgattcctagaggtggaatccattaaactgacaaagccccagtcccggggtcctaatagtcgggactattaggtcatcctgggtactcaggcctctagactctagactgagctgccttggtcactcggggacagttggcagagtattcgtggtcagggaggtgacccgtggtcagcaggatcaggccacccagggacaaagggtgcttctgcgccaggccctggagaaggacagagcggtggggactcggggtcggccgcagataggggagtcaccacctgccggcaatcagccatgactgcctttgcactgtccatgctctcagcccaccacctcctccccctgccattgcagtggctaacactggagacgaagaccaagacaccaccgcctttctccagtaccactcaaatcagcacaggcaaggacaaaggcctcaatccacaactgctgaagatggaccctggccacatgggatggtcagacacgcctgcccagctatctgcaggcgaagaggctcagaagaggtttaggggcctgaaggacatcttgcttccatgtccatatgagcaggctatttctgctccatgagtcaattttgccatataaaatacttaatttcagccattccagggtgctgtaggatgcacagcttcccatcagcccacctgaactccagccatgccattttaataccaggaataaggtcacctgctttcctgccccttaggaggccagagccgtggaagcaaaatggcacttctgtttacctgttatattatttttttgtcatccttatatgcttggaaaatgcaattatatgaaaaaagtttagtaattacagacataacagcagaaagtcctcggaaccaagcttactctcatggccgattctgctccacctgggactctgctgtgctgcgggcatcctgtggtcagaatcgcagaggggccatcagggagggccttcccagaggatggacctcacgtgactgctgcgtgggcaagtggcactggccactctgcctggagagaggagtaaatgcagggctggccaggcgacctgcacactctgctactggccttgtccatctttagcctctaatttgaaaatgaggctcacacagaccaagagtatctttgagggttagtacagaccacagaaatgccctgggcctttcactctctccttttgcaaattcccatgtgtggaaatgccgtttggataatgagggagcctgaaggaggtggacacatgagcagccccgacaggcctggctccatcctctgaaaatggggccccgtgcccggcgtgtggccttactggttcagtcttctttacagtggtaggttttgagtgcccagatgcccagtgcctcctacctggaacagcacaggatctggcagacccctggaagaatcacatgcacacttaaatattcagggagttcccacccagcagagctcgcctctgtggctaccttggtcttgctgctgatatctgccagaaaaggcctggacttggagacaagcctgggatttacactcagtccttccccatctggctggttccatttccttggctctcactgctggaagtctgtgctcctgaacatcaagtcagagggggcatctgaatgcagggcagggagcctcagatgggaagaagtcagaggaaccagaatgtgtcagaaaatgccaagtcatgtgcctgagctcaaaagtcagctgggccacaggctggctgtgtgatcttgggcaagttcaaccagcttctttatacctcttttcttgcctcaaaatgataagagaaaccacttcactaatacactga

SEQ ID NO: 547 - DNA, 277 bp, Homo sapiens
ccagctactcgggaggctgaggcaggagaatcacttgaacccgggaggcagaggttgccgtgagctgagatcgtgccactgcactccagcctgggagacagagcgagaccttgtctcaaacaaaaaacaaaaaaccctaaaacaaaacaaaacaaaataaaacaaaaacaacctctgagataatcaagtgagagctatacaaatctccaagttatgagggaggaaagccaggagtgagactgaaggcagagggcttggctgctctgaatgaggttaa

SEQ ID NO: 548 - DNA, 973 bp, Homo sapiens
agaaggcaaagggagcagacagctggcaagctctgtcccaatatgcttccctgaaagaggcgaggaaatttcagaagatgcaatgcctgaatggctcactttgcaggaaaacagaagaaccaaggcaggactgtactgccgcaatctcggctcactgcagcctccctgcctgattctcctgcctcagcctgccgagtgcctgggattgcaggcgcccaccgccacgcctgactggtttttgtattttttggtggagacggggtttcgcggtgttggctgggctggtctcagctcctgacctcgagtgatctgcccgcctcggcctcccgaggtgccgggattgcagacgggagtctcgcttactcagtgctcaatgttgcccaggttggagtgcagtggcgtgatctcggctcgctaaaacctccacctcccagccacctgccctggcctcccaaagtgctgagattgcagcctctgcccggctgccaccccgtctaggaagtgaggagcatctctgcctggccgcctattgtctgggatgtgaggagcccctctgcccggtgcccagtctgggaagtgaggagcgcctcttcccggccgccatcccgtctaggaagtgaggaacatctctgcctggccgcccatcatctgggatgcgaggagcccctctgcctggctgcccagtctgggaagtgaggagcgcctcttcccgggccatcatcccgtctaggaagtgaggaacgtctctgcctggccacccatcatctgggatgtggggagcgcctctgcccggccgccctgtctgggagatgaggagcatctctacccagccaccacccagtctgggaagtgaggagcgcctctgcccggccgccaccccgtctgggaggtgaggagcgtctctacccggccgccaccccatctgggaggtgaggagcgtctctacctggccgccaccccgtctgggaggtga

SEQ ID NO: 549 - DNA, 2002 bp, Homo sapiens
gctgaatagctgagaggcgcacccgggcggccagctgggctcggagtgcagcggggttaggatggacgaggacgtgttgcaccctgaagagcctcatcatcggtgagagtggggtgggcaagtccagcctgctcttgaggttcacagatgatacctttgatccagaacttgcagcaacaatagacaatgcaggaatcacatgaacctgtccatccacagataaagtggtaaagaaactgccgtattagatacatgatggtatactcttcagccataaagcttcgggaaaccctgtcatccgcaaccacgtggagaaacctgtccatccacagatgaagggatcaggaagctctggtatatatactgaagggaaatgctttttggctaccaaaataatgaaattttgttgtttggagcaacacagatgaacctgtccatccacaaatgaagacatcaagaaactctagtatgtacacaaggcaaaacacttcagctatcaaaatcatgacattatgtcacttggagcaacacagttgacccgccaaggcagcctcttcctccatagatggatgaacgctgtggccgctgctcctgcctgggccatgccctgatgctgccaacaccactgctcctctatttataagtcttagtagagttgctgacccagcaataactgaacagctgatatgtacctcacactaagccaggcgcttcatatgtatctaacttgaaaaatgctgagctagttaccttaacaccattaacttttacttaaaagtttgtttttcttttttaatcccagtgagctccaaacaagttttaggaggctccccaaaaccagtgaagactttaactaaaagtagaatttcaaagtattagaaaccaaaccccaaaattaaatgtgaagatcagtgtctgtactgagctggcccatctggtggacacaggatttgcgttatcgactgcaatgttacccaggattcacgatttctagcatctgtcagggttaagaaaattggattgagtaccaaatacagcagagcaaacccggctttgaggcaagggccccatcaagtagtcatgcagtacttttgttagggttctgggtgcaaatcttcctcgtccctcccaccttctcctggcctccttgtaaacccaaaccgccaggtacctcaattttcttcaagaccaggctgttcttaatgttggtaaattggtcaaggaaatgggtgagccactgcttgctctgcacatcgtcctcagagtgctcggtcttcaggcagtacagcagctgcatggctttggcctgcaggagtaagtggcccattcctaggctgtccccaaagatgtgtcctctgaagaagctggtcaggtagagggggtgtccactatggttatagatggggaaggagatgctgcccaggtcgagcgttttgtccacctgccaggtgtacaggagtgggttgggggcaccacgcagagcatcttgtacctcgcgcacacctgctggtactggagctggcttgcgtttccctgtgccacacgcagatcctgcactgtactgtccagtcaactgacttcagcaaagatgtctgggttcagcagcgagttgctgtgtgaggccaccagaatggaggtgatatcggcctcagtgctcatcctggaggtggagaagtggtcagagtcctctgtggtgaaatggccctacaccaaagtgggagacattcagaatcgaggcgaaattggcctcagtgctcctcttggaggcagagaagcagtaggagtcggtggtgaaatggccctgtgtgaatgtggaagaccagcagattggaggtggaattggcctcagtgcttgtcctggaggtggagaagcggtcagagtccttggtggtgaagtggccctgcacaaaacgttgctcccccttggccggtgaaagaataaaagaaagctggccacttgcatttccgtttcagtttatagaatacatgttttggaaatagt

SEQ ID NO: 550 - DNA, 6358 bp, Homo sapiens
gtggatccctagatgggagccggggatgggccgggtgcctggtgggtggcagtcggggctgacggcggcggcactttgccgcctcaggccctggacaccttcaccccgccgcctgcccaggcgggccggccctgcccgtccaccggccgccgagagtccccggccttgggtccccggggccgctgactggcctcggtcacctcccggggaaggctcccgcgcctccatctgcccccgcaggaagggaccctcttctcgcccgcgaggcttctccgggtgggatcgtcctggcccccagccctaagggatccgccccctccgagcatccgccgcccctcggagaccactccagctcggacggacccactccagcccccgctgcacgcggaagcgctcatcctccccgcctgccccgttccctcccccttctcctgtgggacaaccagggaccgcagctccccgctccccaggtgtgggggctccgacacgaacgcctctgctcgcagggcggtgagcgcagatcccacgggtccctcggtcgggggtcgaggctgcttccgtttccatcccggacccgacaatgggcgggaaaaagaaggctttacacgactacgcggcggagttcaccgacctggtggtgaagcacctgattgagcacagtgactctggggacacgtctgtggtggagaccctttactgcagggcctgcgagctgcccgtgcgcgtgcggagggaccgcatcctggaacacctgtcctcgggcaggcagcacggcctgcggacgcccattctcatgtaaatgtcagtgccaacgctggtgtttcaggagtcatcccagcgggctgcgggctattttaggattctctgccctgcaaacgtttccaaagtacgtggacaggccgcctgatgacactacgtttacgggatctgctagtggcttgcctacttagggagtaaaccctgtgaagtctcgcagttttgttaaagtgtgcgtggccacctgaatgctgccttatcacaagccagatacatactggtctgtagggtaactccccactgttgatcctctgagatgattgtggactgggtgctgtgagtcctgccactttgtttaagtgaatgtgtcttttgtccagctcagccgcctcggatctcgctgccaccagccttactgcacacccgtgccacccgcccttgccccgtcagcctcagcctcagctcattctctcaggcagtcccagcattggcacggtacctcctcccgctgtgggccacacgtctctgctccctgtcaaccctcctgccatcagcaccaccaccagcgacttgtctgcccgggaggatgcaacaccatctgcctccaccggccacctttcagtgtttcctgctttccaagtaaagataccagcagtgccctcagagcagaccagccagagtttttctgaagcctcccacagggtgctccccggaggaggcccgagatgctctcgtgactttggagccggggtggctggccaccttggcctgggcatctttggggtgggcttcgggagcccggcactgctgcagagtgtggtggatgagaacagctgctgcttgctgtacgtggtggaggaccagctgtgtgatgtggagcaagccttcagagctgagcatttgggccaacaccagagtggttcgggaacaggatgcagacattgtcctcaacgaccagcggcactttgatccggttttccagttcttgcacaagcaagtttgtgtcagccacgccctggggaggatccactggatcaccgccgtcactgcctgttcccggcggcctctccggcttccctaaagagagcaggtgggactttctacaacgctgctgtgcacgacgtggatgccgtatgcatgttgctgggggaagccactccggacactgtgttttctctgggacatgtcttctgcccagatatggccgccttaaaagatgcagatgctgttgtgatcagcatgaagtttccctgtgaggccgtggttagcgtggacatcagccagcactgcacagacagctgcgaccaggacgtcagccagcactgcacagacagctgcgaccagagactggaggtgacccttgcccttttccacccttcgccagtccactgtgaaaagctgggttgattgtgcgggttagatagaggtcatcagccgggttgattgtgtgggttagacagaggtcatcagccaggttgattgtgtgggttagatagagatcatcagcctggtagattgtgtgggttagatagaggtcatcagccaggttgattgtgcgggttagatagagatcatcagccgggttgattctacaggttagatagaggtcgtcagccgggttgattgtgcgggttagatagagatcatcagccgggttgattgtgcgggttagatagaggtcatcagctgggttgattgtgtgggttagatagagatcatcagctgggttgattgtgtgggttagatagaggtcgtcagctgggttgattgtgcgggttagatagaggtcatcagccgggttgattctacaggttagatagaggtcatcagctgggttgattgtgcgggttagagatcatcagccgggttgattgtgcgggttagatagaggtcatcagccgggttgattgtgcgggttagatagagatcatcagctgggttgattctgcaggttagatagaggtcatcagctgggttgactatgtgggttagatagaggtcgtcagccgggttgattgtgtgggttagacagaggtcatcagctgggttgattctgcgggttagatagaggtcatcagctgggttgattgtgtgggttagatagagatcatcagctgggttgattgtgtgggttagatagaggtcatcagctgggttgattgtgtgggttagatagaggtcatcagctgggttgattgtgtgggttagatagaggtcatcagctgggttgattgtgtgggttagatagaggtcatcagctgggttgattgtatgggttagatagaggtcatcagctgggttgattgtacgggttagatagaggtcgtcagccgggttgattccgcaggttagatagaggtcgttagctgggtgtgtgggtcccaaggcgtgctgcagatggagaatcagaattccttgggcatcaccgggcggggcatgtccctgtcccttcgctcccagacccaggctagccgctaccaggactcctatcgagagctcttcagacactttgtcagaacccttaaaggtgggtgacgttttcaggaggaacctgggatgtcctgatgctcaatgggtagatgccttccaggctgcagtcagtgcagatgatatgccaatttcaggtggaaaattgcattccagataccgggttcagatttgaaattgtccatctcagtgatcatttacgttgcgtgtacttgagggagattctgagagatgctcctttggggttctgtgcgtgtaccatgttgcctgacacgtcctgagaaatcttcttaaactctgagtttataaaataactacttctgaactcctgagatctagtggataccatgtatcctggaagataggacactttctaccctctgtcagtcctgggggtgactgggaaccagagaggttgagcagaattcctggacctgggtggggcttgtccaagaggggcaggtgggcctctctaggatcagtgtcccacccagaggccagtggccccttcacatgccccaacaagaggaagactgtctggctccgcagtgttgggttttgtcctgaatctgtgcaaatgtgcagggaaataacctcctgaaatcaccaaagagcagttcctcagggccttccgggtgaccgtggccgtggagcagtcgtggtgaaaccggtcagctgtggacctgccctgcgaatcggcagaggcctccgtggtgaagacagaagctccgtgaaccaactcgaggctggagccaagatcctgcctgatatccagttgcctgtttcacttgttactgttactgggagagggagacaaaacctcatggcaatcttgtcctcactggagactcagaaggggaagcattgggaaaccatgtatgtttcatttctggtttaaccaggcttttcaggatgggacttcagaccaaggacacaagttgggcttgcttaggtgttttgtgttgtgcgcaggcctcagagatgctcttccggtcagagttcccttggcagggccttggaggcctctggttggctctctcaggaagagggcaggtcagggattgggcggtgtaaattgactcagaaacctgcggtttcagcttttctgtggcaaacagggccgagggctggtgaagctgttaaggctaaatgtcgcatgcatgaggcgggctgcaggcctccttaggccttttttggggtaattacaccagtatttaaaaacatttttttttgtttgttttgagatggagtcttgccctgtcacccaggctggagtgcaatggtgcgatctcggctcactgcaacctccgtctcccaggttcaagcgattcttctgcctcagccttctgagtagctgggattacacgcgtgtgccaccacgctcggctaatttttgtatttttagtagagatgggatttcaccatgttggccaggctggtctcgaactactgacctcgtgatccacctgccatggcctcccaaagtgctgggattacaggcgtgagccaccatgctcggcctaaaaaacaattttcttgaagaatccgattttgtgcatagtaatgacacagcaccattcctgagaaataggaaatatatgtgtgtggtatgaaaagcccatattctgttcttgtcacctgaatctaggcttcctctttggatgtgaacgcgggaatgaacagtggctgttttccacccaaaggggcgtggagaccttttggaaacgggctttctcctttccattttgcagccgggggcgggtggaaaccttccttcgaagggtagtgccttggggagcagcagacctgctctgagtccagcttagctttccaaaattctgtgtggaacttactggagatgtttttatatatttgaaaataatggcctgtatttctcacgctatacttaaaaaaaataactaaccttttaaacaaagatattcaaactcacccttgtgctgaaagcactcacatttctgtgttcattcctgaaagggcgttttagagtccccgtttctacgttctatgtggcaccctcttgccgagggaacatccagaatccctccacttcctgtctagtttgaggcctcaacaccttcatgatccagagtcctgcggctatgagggggtgggcccaccaccgcccagccctccttggtggacgtggggacaggtaggagcctagggaaaggggtgggcgggctctggtgtgacggcgtgagcgctagccaggaagatggggccagggcttggcatggcacctcacctgtgggggaactcggcggagcttcctggcggcatctccccctcttgccttggtcctttctatctttgttttaggccaatttctaaaaagactgaggcctccttcaaggttgaacagatttctagagccttgtttttgctgtgacaagtccctagtccctgttcacaactctgaaaccaagaaacctgagaaccaagagaactgaaatgaagcccgttggtctcagcctggcttgagccaacatgaggctctctgctgccttttgttttcttaggttttgctgagaaacgggagtgcgttctgtgtcggtgtttgtgacgccctgagaccctgcttggcctagctaaagtccagaaggcctgggccccacagggcttggatgagggctcatgggcctgtacttcaggaggcctgagaggcccggtcagtcccatgaggctactcggcttggcccgcaggtcctccgaggcacagggcagagggacaccccagggacccatcagactcacgacacagagaaactcaagtggggtgccagggccggccacagaggccacgggcttcctgcctgtgaggagccgccctgtttgtctgagccctttggagatttaggttgagtcatgagaaccggtcattggaacatacactttattatgttacaaaaacaaaaatccccactgaaacacagctaaaaaaataacacattttcccaagattacattaccaaaaacagttgttatgtcattggagggcgtccattaatactgctcggagaagcacgatcttacacgaaaaacacggatgggatttcgttttcaccttaaagcattaaagtgctttaactggtaa

SEQ ID NO: 551 - DNA, 657 bp, Homo sapiens
ggtggagaggagaaaactctgtgctaaatattactcctggaaaagtgcatttgcttcggagaaatctttatcatgggtctctaagaggaaggaacaatagcatcttctatgtgccgaggtagcgcaataatgaactctgttcaagtggatcaaaagccatcaaggtcaaaattaggcacaggctgtacaggaagcgtgattctggcatctgtttggtttctgggaaggcctcaggaaacttaaagtcatggaagaaggggaagggagagcaggcacgtcttacatgaccaaagcaggaagaagagagagaagtgtggaggtgctatacacttttaaacagccagatcttgtgagaactctgtcagaagaacagcactagggaaatggtgctaaaccattcttggggactccatccctgtgatacaatcacctcccaccaggccccacctccaacactgagaattacaactcaacatgagatttggatggggacacagatccaaaccatatcaaattttcacacctttcagtaaagctttatattttttaaggatatttaagtacttggaagtagaagtagagagtaaggggaatattgtacagccatcacagcctttgtctactaaagaagtcagtttcatgtgacaaatgttcatt

SEQ ID NO: 552 - DNA, 3287 bp, Homo sapiens
gtttcaggcagctggaataaagagagacatcgggggaaagccgcgagaaggccagcgtccctggctgggagcagagctagccgagtagggcgcccggctgtcaaactggccggcgcagtgcacgctgggccgccccggagcggtcgcagagcccgtcgggagtcgtagtccgggacgggcccgcggcattgtccgcgacgcagctcgggatccgggtcggggtgtcggccgggttgctgccgggcaccgtcgagcgttagccacccagcattgagctgccagcggctgttctccctaagcaccctcgctcacgtcgcctcgcctcgcctcgcctgaccggccgcagccttggataccagccttaaatcgagccgactacggcccagccccgcccgcggcgaggtgcgcggggttcggtgccagccgctcgcccctggcggggccagcctcttgatgcaccggggacgggcgcccccatccgactcttcgaggggcggcagggccccatctgtgtctttcgctctcgagcccccagctagagttggcttcagcggaatacctactgtgcgggattattcaacaagccgattgatcacattcttcagctctagcagtgcaaaggcttcactgaaaaagaacattacaaattttttttgaaagaaatttgggggaatccactgaagacctacatttcccggaaggttaacagcccccttctcagttttcctgctgctcctatcagtgacaaatcagcgtattagaacatgcatgctggctgatcattctgatcaagtcaacaagcttcacaacttactcaatgaggtcgtccgtgagaacttcactgttttacggggacaggagctacttctttgctgaactgcatcacggtttcaactgctgaggttttcttcaagcttttgcattgtttggaatgtgaagggcatggccgagacacactttgaggttcccactgcattgttacacctcccccctcacttcagggccaggtaacaccaagaaggacgccatgagagcgaaggccgttgggtcaccgccctttgctctcgcgctgcgcgtctccctgccatcaaccgccgcaactggcgctgggagcggttgagggcggccggcctcgcgctggaacctcgcccgcctcaaggctcctgcggcggcacacggggcaggccaggacccgccctaggagggccccgctggagatgtggaaatggagggacgcggcacctgggcgcttcctggggccagacaacgccccctcattggaacctccatgaccctgcctctgagaaaccagcgcgtccgcaacgatcactcctaattttcggattcctatcatctgtctccacgtgataacactgaagagccttcacattgatgcaggcccagggcctcaagtgcagagactgagagctctgcaggacacagcatggagccgccattcctctactgggtggaggagcatgtgtcctctgaacaggggatccaagccctgagatgttctttctcagctgtcagtgcggcccaggactttctgtggggatgctcagacagcgggccggaggacttttagccaccacctcccatggccagtcttcacaaattacccttggctaatttgactgtctctcctcctggggtctaggacttcaaacatgtacagaagcgattgcagaattaagacaagacacttccacaatatattttttgtatcactggctcagaaaaagactcattcaaatcctgtatcaaagccacgtgtgagaatcttgagaaagcatcagctgactgacttgacaagggaggaagcaaccaaaaattctgcgcttcttcagtatctgagtatgatattttgcttcaacatccctcttagatgaagttattgattgaaaatcatttaagtttgccccatggtaaaagatcaagtcctcagaaagatctccaaagtgtttacggtttgttttgttttggtaagtttaccatgattttgcttgaattgctctccgttgatcttctcagctaagatggaggtagagagttgcacagtggaagagggctgcatgtaagaaggcagttctgtctcagaggacaaaaggcctgggagcacccagacagacagtcactgcatggaggtcactcccctcccagtggccactgtggagacatttcacagaaatgcttgctggaccattcaggttcagagttgggacaaaaccgagaactcatggggatattggacaggagttaggaaatgaccttctcacacaactggggcagtgggggagaaccctgggcttgagacttgcaatccaccacttgcccctgcccctgcccctgcagtgtggccgctgttaccttttcctgcaactctgccttcttgagtccaaatgtcttcgaaaggggcaaatgctcgtaagtgccgacagggtgtgtttcagtgaatgtttgcagtgtgcaccggtctggctgaaggcctcttcccttccccaacaccctcccatcgtgcaaaattaccctgcccagcagggagtgacttgtgtgtctcagaagattttgttgctgtgctctgagttctcactcctcatctcctttgaccagtttcttctaatactccccttgttcacaacacagaacatgagtgctctttcctatcattttgacactaataaacggacagtgattctcagtgtggaaatgagaatgaagttttttttaaagacaggctacaataattcccatgcagagaaccacatgcgatgacactggattccagacagcaagaacgtatggtgaagatgaggccaacagtgagctgagagaggccagccagggtgtgtttcagtgaagatgagaaacaatcagataacacctgtttcctccaggaaagaaaatgtggccagggaaaagagatgggaggaaggccggtcattgcctattccactgtgcacagtttgaatttggagccatgaaaagtattgcttggttaaattaaaatcattcaaaagataaaacataaatatttaacaccagcacaatatgctgggaaacaaaatgaaaggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaaca

SEQ ID NO: 553 - DNA, 536 bp, Homo sapiens
aaactcatttttaatggcttgtgcggcatcagttgtgcccctgagctgtaatgaagggctctgcaagtcaccacaagcgagtcagaaatgaatctcacggagaggaaaatgctggaacgttaataggttttaatccaagcctctggaatggatcattctactctcaacctccatgagatgcactttttaagctcccacatatgagtgaaaaaagcgattttgtctttctctgcctagcttattttactttttttttttcttagagggcttccatagattctacctggcttgctggaggcttaagctttcttctttccagaactggaaactcagttcttcccagcattagctttgcttctgtgctaagcataaatcattggaatttcataagctttctttctcttagcactcatacactttgtaaatcaatgatttgcaaagtaaaaagggctcccttcagtaaatatttgcaaggcaggtctgtcttcccctgctttccgagcagaggcaaagactccctctaatcctggcgttca

SEQ ID NO: 554 - DNA, 106 bp, Homo sapiens
ctttcagcgcctgcaggttccgggagctcccagccgaggacgtcggatgtcatcgtccttgctgctttgccaccccattcccgtcaataaagtggtttgaacccaa

SEQ ID NO: 555 - DNA, 1279 bp, Homo sapiens
gggactggcgggactgcgcggcggcgactacagacgtgtcgggggtccggggcctgtcgcggttgccaagcgctcggcgcttggcgctggcgctggccaaggcgtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgaggtagaaaattatggcatgccgtttagcagaactgaagatgggaagatttatcagcgtgcatttggcggacacagcctcaagtttggaaagggcaggcaggcccatcggtgctgctgtgtggctgatcggaccggccactcaatattgcacaccttatatgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggtaggaatctaatttctactttatttcctttgtaaaaatgaataaatttcatttagagtctctttattttaaggaaaatagaggcattgtagaatagcagttcagacacaggccttgatataaccacgtgagggtgatggcctttcccagccatggttcctcacctgtaaagggtgaggacagcagcacctgcctcggggtgagaaagcatggccctcattagtcggtagtggctgccgtcaggttcacagcgtacctctcccgattttagatgaggaaactgtggcccgaagagtcacatggggttttctggcaaaatccctcttgttttagtgggttctatgtttatactgattcctgggatagataagtctgtcttctccacataatgaaaataaaaaactttaattttatacagtggcagttactttagccactttaaaagttaagaagtgtcagtacagccaa

SEQ ID NO: 556 - DNA, 326 bp, Homo sapiens
ctgaatccccagagtagcccttcctggtgcccaactggcctggggacaaacagcgtccactacatctaggactgccggctaagtggacacacttcttgacctcctaccaggaactttgggcccttaaagaccttcacccgtgtgaagaaaggcctgcactgaggagctgtccaggatctaagagggggagatttggggtcagcatggcctttcctctgaagtcaccttttcctggcccccaccctgtacccactaaagcagtgccatctcctgggagaaaaggagaacatatacatagaataaagactatgaagatctgcaccaaa

SEQ ID NO: 557 - DNA, 713 bp, Homo sapiens
gcatggaaggaaggactgtgtctgtgagggatgatcatcctctcatgtgatccttggagatgccaggaagccccttgacacatgtggcatgggctccttcagaggcttttggatccgtcgtgaatgtggcatgggcatgcaaagaaagacagaggctgcaagggataaacttcatcttgggagatccctggagatggcagggaacccatggacacatgtggcatgggctcctttgggtgccggtggatcccttcatacggtagtgttggtgtaaaaggcaaacccgtgtcatgagggatggtcatcatcttgtgtgatccttggagatggcaggaagccctggacatacatggtgtgggggctcctccagaggctgttgggatcctcctggatgtggtgtgggcatggaaggaaggccagtggagacaatggatgatcttgttcttagcagatcactggatgtggcagggagtcctaggacatgtgtggtgtgggcttcttcaggtgctggtggtgttggcatgaggaaaggaggtatcttcgagggacaatcttcttcttgtgcgatccttggagatgccatgaggcccctggacacatgtggtgtgggctcctttggaggctgttgtatcccttctgaatgtggcgtgggcatagaaggaaggccagtggccacgagggacaatcttggtcttgggagatcctggaaatga

SEQ ID NO: 558 - DNA, 2055 bp, Homo sapiens
gacgccatcagcactgccactctgcccctgccccatcccctaccctgttgtgctggcccatgtgggctttggtgccagctctgctcagccatggaccctcgacttctctgaacctcagtctcctcttgcagcaaacgggctcatcacagccaggcctggcattgagccatggttgctaggactgtccacctagagggcccagccaggccttttgggtcatgcctctgcccctcaaggctgatggagatggcgttttcagggaggatggatggggtaacgtgaggaaactgaggctcgggagtacagagcctgccccacctgctgcatgaccttgggtcaaccctgcccctctctgaggcctttagcaggtagagaatgggccagagcagctccgagtgccctgcagctctgctcttggattgctccaagcctcattccctccacattcctgactcctgtgtggctatgggccaagcagtctttccttgagcctctgacatccgattctgtgtcatggggttatcagccctgccttcttggtcctgggctgggagtggaggctccatcctggcctggatggggtggcaaagaggtaggtgcccccatccctcacccctgcctctgccaccagtgtcgggactcttctgcctggtgtgggcctgggcctggggggaactgatggagaggctagagggggcgtcctgcagggagaggcctcaaggaaggcaaggccagcacccaccctcaaagggcctctgtctcacccaggagactccatcctcccagcaaggtcagccaataactgtggggatggagtggagccgtgagtgggggcagaggcctagactcccaccccacagggcggtcccgggcaagggctctccatctgcaaagtgcagctctggcccctgctctaggctgctatggctctgggaagccctcctcctgccccttctgggccgctttctctggggtcccccttgccatgtgctatgtgcccaggccgtttctcagggctgcccgctgtgccctactgtgacctcagccactagaacaaacccgagagacctggagggagctcaccagacaggtcagggctgatgatgttcaagcgcatgaagacagtcctatggacttcctggaggagaaagagagagcagtatgtggcacctttgggaggcggcttccaggtttactccctggctccgtgaccccagcccaccctagagccttggctttgaatcccatctccaccgcttcgtagctggatgcctctgggtctcctgttctttgagattacactggtgaccatactacatggatgtgcgggtggttagattcctgggtgggagggtggatggatggatggacggacgggccccaagtccaggtggcagctgtctaactggagcaggaactcggagacggatggggacactctgacctgcatgggtaggctgtctccctcctgactctgggagtctcatctcctctggagtcatggtgggaagaaaggcggagaggaagttccaggagctgggaggcccgaggggtgacaggcatgccaggcagaggcaggcagatcacaggaggccagaagttcgagacctgcctagccaacatagtgaaacccgactctactaaaattataaaaattagccaggtgtggtggcagacacccatagtcccagctactgggaaggctgaggcacaagaatcgcttgaacctgagaggaggaggctgcagtgagccgagatcacatcattgcactccagccttggtgacagagcgagacctcgtctctaaaacaagaaaaagaaggccagttgcagtggctcacgcctgtaatccccgcactttgggaggctgagtctggagacagcgaagaggttgaggtgttctcgtaaatcagtggtgaaaattcaaatcatctttgggaaagtgggttggcaacatgtattgaaacttcattcattttgacccagtaattccactaatgtggaaatctatcctgagaaaataatcctatataaagaaatgtttcatgcacaatg

SEQ ID NO: 559 - DNA, 442 bp, Homo sapiens
tggggagtggaggggccttgctttgcttcttcttgactgactggtactctttttattatgtatgtatttatttattcatttagcgatcctcctacctcagcctccagagtagctgggacacaggtatgcgccaccacactcggcgaattttttaattttttgtagagatggggtcttcttctattgcctagggctaatgttggactcctgggctcaagcgatcctcttgccttggcctcccagcatgttgggattacaggcatgaactaccgcacccggcccgtactctgtcttcacctcctctgggaagccttcctcagtctctggctctcaggtcgcccgtgcatacctgtcctgaaactgctttcccacctgtgttcccagggcagagagtggatgcccatggatggtttgtcaaaggaataaattagccttttttgga

SEQ ID NO: 560 - DNA, 552 bp, Homo sapiens
attccctgatgccatgaacttacacgtttcacacacgggaccagacgcttgctttagttgacgcatgaagaccggtccggtcttttgcggagaaaagtggttaaaagctgacttgtgggccgagaaactgtggcaccctaatgagctagggctagacgcttcgaccaccacgccaagtgattctgaagatctctaattctgtcaaggcgagagcgctccaacacgtgttcatcggctgttgctttttaaagagaagggtctcactttgtcacccaagctgaagtacagtggcatcatctcggcttactcaacctcctgggatcaagtgatcctcccacctcagcccccaaagtagctgggactacaggtcaggcatggtggctcacacctgtaatcccagcatgttgggaggccaagatgggagactcacttgagcccagaagttccagaccagccttggcaatatagtgagatgccatttctattttaaaaaatattttaaaaataaaatatttttctattcacctttcatcaatacaaacccagaagaga

SEQ ID NO: 561 - DNA, 2653 bp, Homo sapiens
gaaaactttgggcttggcattaggagagcctcggctgaaatccgaggttttgaacgcgattttttccgacagaagctgggcgctttctttcatgtaatgctgcagctgagcctgggacaggtctttgaaagctactccagaagggtatttctccaccgccgggaccaccagtttattcctttcggctaaatacgtttttggctgcgggtgcaaaggggaactgaggaagtaggaggccaccgggtggatgttcacgccggctgccgggtggcatgggccgtcacctcggttcaggtagcacaaggcgcccatggcgtggaatgaagagtggttgaccacacgcggccttaccagcttgtactgctgcagcggcagcgcgtcgcgggccaggtcgcccttgagactcagtgcgcagttgagcaggtcgctgcagctgaatgcgggagccgagggcaccgccgcgggcgccgccggggcctccagactggccttccgcggctcggagcccgtcactcctgccttggggctcgtgtcgtaggccacaggcacgaaggggatcatgcaggggatcgacgagttgagatgcagagagtgcttgggttcccccttggcatcaccagccgaacctgcctgcccagcccaatggactcctgccagcccatcgcagagttcttggcgcaccaatgactcggggacaatcactacttatttctatcaatagaaagtgttgtgtcaataacgcagccaagatctcgccaatcgttaacttccaagaggagaagggctcggggttgcccgctcccggaatcccggagtctccgcggcccgaaccgagtctggaccatttagaagacgccggcaggtaactggcctccccaaacgccccgaaaattaaaagccttaggaggcttgttctgtgtttgtggttttgtaaaggcaatgcccgcggcaataggcctgggaaagtcgcactttcatccacaaagttgaggagttgcaaggaataattgggtgtcacaccacaagcaaccttgactcgatcggaccccacccaggatacacacagacgcgcgcgcgcgcacgcttccgagtttccattgagagtctggaaagagcatttctttcttaagtacctgcgctcagctagagctctcccggagcattttaaatactgaatgccgagcggagaagggaaacagagtgtattaatccccactccggttgccggtgtctgcaagcctcctctaagcagcgcaggcggcagcctggatgtctgtgcgcatcaaggagacttgccggcgccagagttgtgtccacaggtgcacttgtgcctcccaaagagcgcgcgtagagaccatttcccctgcaacgccccccagccgaacacccgccgggtgtggcacctcggccgaaactcctggggcggcgcggtggagcgtgtggaggtttccgggaagacgcctacggctgcggctccgactgtgcgggctcccgccgcccaggcaagagcgtccaggagcgcgctggaagctgcggcgcgcaccttccccggcgcagtctcttgccagccggcgatcacgcagagctgaaccccgcagctaggcgcgcaggaagggctgcacagagtttgaagacacggcagctgtaagctggcgtgaggaggccaaaggagcgcgcagagctgcaagcaaagggcggtggggcctggaccctgaagtgagtggccgaccgcagcagctcaaggtgccatctgcctggcaagctacccgggtccctccgccccactctaactttccgcgaaaatcagttccgcctctgccccaagagccaagaggggtggaaaggaagagagcttgggctgggaacgcgcctgatgtctaacagaaaggcagtggcagctggcgaaaaatccccctcctgctgcactcctccgccaccgggctaggttgaaaggaaaaagccaagaagcgcgaagcagcccggctctggaaggctttggagagtccagctgacttgtacacaattcgcggcctctggagccttacctgccttcttgactgaatgccaccagttcgttttacgcttgtggctttttgttgaagtccctatcataagcaaatgcagtttctggctatggttactgcaattcgaaataaaaggcctgtgaggtgtgtccctccagactgagaggctatgactcagggttggactttatggaaaaaaagaagtttataaaacaagtaacccagtttctccaacctttactgtggagcaacagcgtcaagcaacaaaacccagcaaagttttgcttgtcacttacaagggtgttactgaaatctggaaggcgaacaattagaagatagcccaaacatgctctattgctctacactgaaatacttgcctccaataatagaaaaaacctgttttcgtgcaattgattgattagcgttctgcagcagtccctggacaattttaaagacattttgtgtttgtggccaaaattagaaacaagcagacacacacacaaaacaaccatattcaagacacggttcgactgtttccttgacactacccacgaagtttaaagcattttttatgttattttcaaactttcttaagtgatcccatgaaataaaagtcgataatagaaatt

SEQ ID NO: 562 - DNA, 544 bp, Homo sapiens
gtagctccctgggcgcttcgaagatccagcggcttgctgtgagtccgggaggcaaaattgtacccatttcaaagatgtgatgactaaagtctcgagagggccaaggctcgcccaaggttgctctgtggtgacagctttacctccttgctatgtattctcagatattgcaaacggacgagagaaaagtggagaatgaatcctggagaaaacaaggtcgttcgacgatttcgacacgtcgcatccctgagagtctctcgtgtcctgatcaactcgagaactggaggcggtgacattttagatgctgcagtgaaagccacagagccacggaaggccgagactccaccatgtttgtgatcttcacattcagcaaactcactcgcactctgcctcatcttatctctagaatgtattttaccacactgtgtcccttctttagtgggaatgtctttggccaaaaataatgaatagttctgacctgacttgctaatacccagtgataaaaggatggaatttgttgggaataaaagaaaactaagcttacaaa

SEQ ID NO: 563 - DNA, 6251 bp, Homo sapiens
aatacagctcgtttaaaacaagctggagtctccattccgttttccgcgttgcttctcacaactcactgttagaatccagaagtaagagaacccggggaagcgtaaggaagatgaataggacaaagattctaagaaggtgggaaggaagaaggctgcagtctatttcaagtctggtgaatttcaatcactgtagcctttattgttattttagagccacctagaccaaaagagaaggagctcaaattgctggtgaaagaagactgcagctgagttctattatcaaagcaaagtgctgtactgtacttgaaataactctagcaaatactgtgcttcctgcacagaacctgttggattactcacacaaatgtcaaagaacaggttgacattttagcaagttatcagcctggcccatataaaaaaagacatttctagtttttacactttgcagggttcagagagcagttgaatgttatttttagtctatgatccaaagcagctaatgacagagtctaccttagaagataaacaggcttctgatttataacacaaggctaatggtagatattgtgtgatgtgtccagttaaattaacgaaatagctttgcaacagtgtggagtaaagacttaggcttaaaacagagaatttgaggattgagataagtccagagaagcagcaggatggagtgcagatgcaagagaaaggctatgtcaatgccatattataaatatagctcatagacagcatatcctagtgtgtgtctgaagaggcctgtgcccttgaggaaaggggagattatgaccttgtcccccagtgtcatttgcataaattcttagagaccttggggcagtgagtaggagactggttgagatgattactataggaaaattgaataacttaaagtatggatatcttactgttacaggaaatgcttaggaggtgaggtactctgaatttagaatatgatggcctaagggattcggagtcaagaagcaggacatgggatgaagatacatccactgtcaagctggtcattacgacagggagaaatagccctccacagagtgagactagtgagacttgcaagaattgaatgatggtcccgttggacgaaactctttagggtgagtttgcttgtctgggaaagacagaactcagagccctaattgagatgaactgcaagatgggttcagcaggagaaagtggctggaaagggggagggaccaggagccaaatgggtgactatctgccaggtggtctcctgagggcacgcatcttccctggtggtgtgactagaaagagggagtccaaagcacagtcccttctcctccacttggcacacatcaacactttcctcttttcctgtgagccaaggtagaaggtctggtccagaatggacgatatgggtggaggggtgagtcagtattgtttttcatgttggtggttggactcagtttaaaagatggatgtcttagggtagtaggtagcatagttttcctagctttgttgtcacaggtgatagaagctggaccataagttagggtcacagctcccttgattctccttcttctttgttctccttcctctttcacaactctctctcctaggtacttttagtcaggctgcagatggaattctgggcgtttgctccagagagaattttcctaggtagcttttgcgttaaacagacttcattatacattttgctttgcatggggcctctctctcctgacacagatacatgggccccttgtagcccacagcccccagtgtcacacattagtggcacaggcttggttttgacattggttcaaggtacccagtgaagagcactttctgtaagaacagttcaatggcaggacccataatggttatgagcacggaggcctccagtgcaggagcatccgcagtggttgctgatccccagaagggagacgtactctctttctttttgtgtttccaaaggcaaaggcatactcttaggaggcagacagaaagatgtacagttaagaagtggggtttttaggttctgttaacagctggtttattaccttttttggaactttctcaccctttctgcagtgaaataggctatttctctatgtaggagtacacctgtggggaaaaaaatgtgtggaaacctagctattccccaaaaaggagcacaaaaagaaggacatctgagattgctgaatacttttcagatgacaaagaacttagaatgttgagaggggacttacagggaatgggctgataaaagacttgagtgtcatctagtatttacccctttctcctccaacttgagttagctaaatacacacacacacacacacacacacacacacacacacacgaatatacctgcttataataaacgctctaatcaacaaatctactggatcataagctctgccaaggtagcgcctgtggtgttccctttttatccttagcctgtagcaccaggcctggcacatagattcttggtaaatatctactgagtgaatgaattgttgaacagctcgtaatgaagaactgattctgagaatctgtggaatacttcaaaagagaatgaatacaatgcatatattaaaagaggaggcagtctgcagccactgccacctccgccaccgccagctgtgcgggtgagcatccccaggcagcacgttggaagttgttttcaaccatatccagcccttgccaaatacatcctgtttgtcacacatccaaagtgaggtccctccagctataaggtgggcaccatggcagagaagtttttgactgtctctactgcagggaccccttgcagaggaaaaagtatgtgcagaagggtgaccaccactgctgcctgaaatgctttgacaggttctgtgccaacacctgcgtggaatgctgcaagcccatccatgtggactccaaggaggtgcactataaaaactgctcctggcatgacccctgcttccactgtgccaagtgccttcaccccttgccaatgagacctttgtggccaaggacaacaagatcctgtgcaacaagtttgccactcaggaggactctcccaagtgtaaggggtgcttcaaggcctttgtggcaggagatcaaaaatggagtacaaggggaccatctcgcacaaagaccgcttcacctgtagcaactgcaagcaagtcatggggactggaagcttcttctctaaagggaaggacttctactgtgtgacttgccatgagaccaagtttgctaagcattgtgtgaagtgcaacaaggccatcgcatcttggggagtcacttactaggatgagccctggcatgccgagggctttgtatgtgttacctgctctaagaagctggctgtgcagcatttcaccactgtggaggaccagtaatactgtgtggattgctacaagaactttgtggccaagaagtgtgctggatgcaagcaccccatcactgggtttggtaaaggctccagtgtggtggcctatgaaggacaatcctggcacgactgctgcttccactgcaaaaaatgctctgtgaatctggccaacaagcactttgttttccacgaggagcaagtatattgccctgactgtgccaaaaagttgtaaactgacaggggctcctgccctgtaaaatggaatttgaattttgctctttgtgtccttactctctgccctataccatcaatggggaagagtggtctttcccctctttaaaggtctcctgtcttttctcccgttttacagtattactcaaataagggcacacagtgatcatattaggatttagcaaaaagcaaccctgcagcaaagtgaatttctgtccagctgcaactgaaaaacgaaaatttaagtagattgactcttctgcatgtttctcacagagcagaaaagtgctagtcatttagccacttagtgatgtaagcaagaagcatatgagataaagcccccactgagatgcctcttgcggctcagctgggacctaccgtgtagtcacgcgacatgcaagagttgtagtggctgcttcaactcgctgctcaccctcttctgtgagcaggaaaagaacttactgacgtgcatgatttaacttcctcatcaaaactctgaccttccttctgttattttgtgctttcaaatgactaatatgcacttccagaaaattaacatttgaacttagctgtaattctaaactgacctttccccatactaatgtttgatttccccatgtggcatgttttctgagtgttcctaccttaaagcatggaacatgcaggtgatttgggaagtgtaggcagatctgagaaaacgagcctgtttcagaggaacattgtcacagcaaatacttctggaaacttaacaaaaccaaccctgatgtcctttttattgtttttaattaggaatatttttgttttaattgatagcaaaatagtttataggtttggaaacatccatgaaaatattctatttattttattttattattattattattttttgagacggagccttgctctgtcgcccaggctgcagtgcagtggcgcattctcagctcactgcaaccttcgcctcccaggttcaagcaatactcctgtctcagcctcctgagtagctgggactacaggcatgcgccaccacacccagttaatttttgaatttttagtagagatggggtttcaacatattggtcaggctggtcttgaactcctgacctcaggtgatccacccacctaggcctcccaaaatgttggcattacaggcgtgagccgccatgcctggcctgcatgaaaatattctagccctttcagatgttcctgtagtgttgaaattcatcctatggaagtaactgcaaaactctatagggggagttgagcaggtgccaggactgtcatcaacatggatatgacagtacagagcagtggtgagttgaatcccttgtaacgcagttgtctgctctttgtccatgtgttaatgagggctgcaaagtccctcctatagcgattcctaggaattttcctcaagaggaaatgcggatttccacctaccacttacctgaaatacaggatcacctacttactgtattctacattattttatgatataatgagacaatatcaaaagtaaacatgtaatgactatgtgtactaacattcttgtaggagtggttagagaagctgatgtctcatttctacattctgtcattagctgttatcgtctaatgtttcagtgtatccttatggaaataaagcagcatatgaatttaaaaaaagaggaggattagtccaggaactacagaatgattaacttacttttatactgtaaaaaagttagtatccccatgatgtttctccaaaatagtttgaaaataattagaagaattataaattatagtgtgtctctcctctcttaccaaggactaagggctaaagtatcgacatacctcattttactgtgctttgcagatatggcatgttttacaaatggaaggtttgtgggaaccctgagttgagtaaatctattggcgttgttttcccaacagcatgtgctcactttgttagctttttcttaagcaataagatgtttttaaattaaggtaagtacatttcaagagacataatactattgtacacttaaactatggtatagtgtaaacataactgttatatgcactgggaaaccagaaaattcctttattgcagtggtctggaactgaatctcagatatctctgaggtatgcctgtatattaaaaagtggtaagatttttttttttacagtaaccaagtgttttatgcttttgttttgtttgatgagaataacttctagcactatgaaacaaatagctatttaattcaacaatcagtttaataaactttttgtaatcccagctagcaaaataaagtcacctcttaggaaatgagccaaagaggaaggtaaactattttagaaacgtagtttaaaatgtatatgtagtgacagagcgagactctgtctcaaaaaaaaaagtatatgtagttaaaaaatctaaaagcatccatattttttcaaaatggcattcaatgatgttcaagtaaactatttcctttactcaggagatgagtttctcacacctgcacaatgacatcctgtggctattatcagacatatcggagaccttggaccttgtgttgatttatgtagaggattccctttccagaggatatgctggataagtacagcaaattgactgcaacgctctataaaacagatctttcatatatctgtaa

SEQ ID NO: 564 - DNA, 664 bp, Homo sapiens
ggaagcagaggatgttgcgcgtgcggaagccggtgctgtcgtccacgccgcggtagaaaagcggatgggcatatgcgtcagggatgttcaggatctggcccgtggtcgccacgtgtcccgcgatgccctgatcggccgggatgcggatctcatagctctgccggagcagagatggagtcgagaggaagaagttagtgacccggccacagaggggactgttaaacctcgggccgctccccagcgccgccggcggactcccggacacccctagggccacatactccctccacaccctctcacctcatcatccaccacgcccccgtcgaacaccttggccaccagctcattctgatccagcaggaacacagagcagctgtggagggaggggtttggtcctctggggcctgacaaccccctctgatcgccctcacgtcccataaggaggcaaaggccggatttccgaggcctgggaggagtgctccaaggcccacccaactgtcaacacagttccatgctggtaggttctgcagctcagacctaggactcctggatctccaccctaccccagcagacctcaggcccgggctctgacacctacctagtcccaggctctctagtgtccacctcctgcaggagctccaggccctgaaacccagcctgtttg

SEQ ID NO: 565 - DNA, 552 bp, Homo sapiens
agtgctgcagctgaggttcgggttcggcccgcgcccggcgtgaacaaagcggctgccaaggcctgggactgaggggactgagccgccggctccacgccgcccccaggcccagaagaaacaccgactgcgggccgggcacagcacccggccggggaaaggacgccccgagttacgcgcaaacttcctttgaatggcgcccaggtgcccggaaagatgcgtacacgtggaccagttttcacttttcagtgccgaaatccatgaagatttaaggcactgatgcaaaacactgaatattccaatgtttgcaactttgaaggttttacacacgaaccgtgggaggtgtggatacatcttggccatcactttgaacaagcctcagaattgctaaaactagtatcagtagaagcactgatgagaatttctgccaagtttgaaaaagaatattccatcctcctctgaacactgaagattctgatcaagtcttctccttctattacttttatttcattcttccttgactaaaacttagcgctctgtggatttgagataaga

SEQ ID NO: 566 - DNA, 869 bp, Homo sapiens
tataagaggaggaagagagacctgagctagcatgctcagccccctcaccccctgtgctaccttgggactctgcagagtcctcgacagtaagaaggctctcacctgttatgcccctggaccttggacttctcagcctccataactggtgcctgtgcagcagtattcactgtgataggaagtgagaagcagtctgagtgttcattgctgagggaatcaagggcaaaatatcatggatgcactcatggacaaataagcagcagtttgaagcaacaacctagatggatgtacagccatcaagaggatcttaaagtgtggtctttagtggaaaaaaaggaggcagaactccataggctgccctctggcttccagtgcagtttggttataggaggcaccagcaggaggttggagggtgagaagagacaagttggggcatttctcccccctgccaagttcagctcttgtctgacagcccacttttcacaactccagacctcactaggctgtggtcaccctgacctctcccctggacccttcttagtcctaggggtgttaacagcttcctgctattgctgatgctaaggttacatttgaacatatttatctgctaaagcaaaataattcccatcattctatagcagaagcaatgtatgggagactgagtaattacatataagctcacatcactatctcttccaccactgtcatccatcatgactgatctgggagatgaaacagcacagatctaaaggacgtggtaagaatcgagatcaccagagatcagtagatacttgcatacttgcaggattaacactgtctggattccaacgatcagctgagtatgttcaagataaagctatagtacatatttt

SEQ ID NO: 567 - DNA, 513 bp, Homo sapiens
gtggctctccatgcctacctgtggtctcttggacacccttgcagaagatgacttcctgggaactcttctgggagtgaatgttatcagcaaattcccaaaacaacaccccttagacaaaaagcctcctcacctatgcattgcctagaccacccactaaagatggtgaccatggaggaagacttgtgttgggcccaatggccctcggccagtgtccgtctgccaggtgccagcccccggtgcgctgaagctcaggccattcctgatgccctggcctcctgcactgagctgtgtgagctcttctgcccaggcaggccccctggcattgaccggcatagacagtgagcctggaggaagacttgccctggtcccactgtccctgggccagtgtccatcagccaggtgcccagaccccagtgcgctgaagctcagccctccctggcactctggtctcctgcactgagctgtgtgagctcttccgcccatgagggccccctggccttgagcagcataggt

SEQ ID NO: 568 - DNA, 459 bp, Homo sapiens
cggggaaggcgccggtgggaggcaaggcacggatggactttacctgcgcacgcgtcgcagccatctccgcgcacagtggtggccaccgcgactggtgctgaagtgttggcgcgtgccgggcgctccgctgggacccgggttgctggccctgagtctcagctttctcatctgtacggttgggacaagtacagtaaccctcgcccgtcaagacgggccagggctgtggcgagggtccacgccttagagcaggcaggagtagggctgattggagccattgtacagtgtcgggaacataccaggacactgagaatagtgtcatgtcataaggacccagagcagatggaccctgctgtgatgcacaaagaggaccacgcaagatatgataaagatctacatcactgaattttggttccatttttgtatctcagcttccaggaaataaaaaagaattctaacatt

SEQ ID NO: 569 - DNA, 538 bp, Homo sapiens
gagggagaagtgacgatggtgatcgttgctgccgcggccgatatggaacccaagcagtggcgaagggaatcgcaaggctcttccctgaccattttctactgtccctgcgcgaggtggacgcaaaggtgttaaatgaggttgaatatattgaccagaaaagaaaatattatagtcctttgttgaagaagagttttctcatactggaaagaaaaaaaataaaagaaagaaacttcaaaaacttcatgctgctttctgaagtactccagccaaagaaaataattcaggtatcaagttggactagctcagatgactacaaaatggttcaagcgattctcctgcctcagcctcctgagtatctgggactacagatatgagccaccacgcccggctaatttttgtatttttagtagagacggggtttcacgccatgttgggcaggatggtctcaatctcttgaacttgtgatctgcctgcctcagcctcccaaagtgctgggattccaggtgtgagctgactagtgtctttataagaagagatg

SEQ ID NO: 570 - DNA, 922 bp, Homo sapiens
tgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccggatggctttccgtggctttgctacagccactcctggaagtgctgcctgactgaatcctcagggcaccccggcaggatggacgtggtgtaccccctactttacagatggggaaactgaggcttgagagctaaagcagcccacccagctcccagagatgaggaggccgactctggcaggagtcactgtcggtgcatgggcatttcttcctgttacagcctgcggccccttccaggccgggaggccttctgcgcaggtgccctgacgtgatggtatgacccattctgggaggccgagagcacctcaaagaactcagcaggaagcacagtttcaattcagaagttctggaaggcgaggcaggacagggcaccctccctgcatggcccgatgacctgcactcctgtttcatctccccgtgtggcacctggggcagcttggagcctaccaaggtctcaacaaggaaccagtaaataccaaaaaaaggacatcacgtcccctacagctaactgcaaatggtgaccatcccagcccttgtttgataacacaagcaaagcaatggcttcttcaaggacaccgagaggaacctcacctctttctaaaacctccaacacagggccaggcgcggtggctcatgcgtgtaatcccagcactttgggaggccgaggcaggtggatcacgaggtcaggagatcgagaccatcctggctaacacggtgaaaccccgtctctactaaaaataaaaaaaattagccggg

SEQ ID NO: 571 - DNA, 555 bp, Homo sapiens
aaggaggaagacctgaggagatacagggcagaaaaaggaataacatcactattggaaaatcttagatcagtgcttgagatattttgccaacactgaaattgatggaccagctggcaccacccagattgacaaaatggctcatctgatcttgtgccccctcaacccaggaactgactcaacagaagagcacagctttgactccgtatgatttcatttccaacacaaccaatcagcactcctgaccactggcccccaacccaccaaattatccttaaaaactccaatccctgaatgctcggcaagactgatttgagtaataatatttcagtctcctgcacagccgactctgtgtggataactctttctctattgcagctctcctgtcttgataaattggctctgtctaggcagcaggcaaggtgaacccactgggcagttactgtagcctccacctaatagaattctaatttagtgcctcgtagaaagaatgaagtccttcagtgatcagcatgggaatcattttgcttagcttatctcacctaggaaccatgctcc

SEQ ID NO: 572 - DNA, 562 bp, Homo sapiens
aatccgcgagactccgtggggtaggaccctccgagccaggtgcggcatataatctcgtggtgcgccgttttttaagcccgtggggaaagcgcagtgttctggtgggagtgacccgattttccaggtgccgtccgtcacccctttctttgactaggaaagggaactccctgacccttgctcttcccgagtgaggcaatgcctcgccctgcttcggctcgcgcagggtgcgcgcacccactgacctgcgcccactgtctggcactccctagtgagatgaacccggtacctcagatggaaatgcagaaatcaaccatcttctgtgtcgctcacgctgggagctgtagaccggagctgttcctatttggccatcttggctccttcctcatccttattcaattcttgaacggttccacacaaaaataactgaagatgggcctccagtcttacgacgccacaaagtgccctgacaccactgaacacgaaaactcattgcagagttttattgcatgaaagatgtttgtgatgtttgcaattggatgactcaagtctttgtcatggagac

SEQ ID NO: 573 - DNA, 583 bp, Homo sapiens
tttcctacgctaaaaaccactgagtggagtatttagtacacaggaagtcggccagagaaacatttctcatatttgaaggccggaaagagggacatttctgacaccggaagtcagtgagaggactctttcccacacaggaagtcagctagagagccgtctcccctctctggagccgagagaggccggtttcccccaccactctcagggtaaagaaggaaatgagaaattgcaagacagagtatttcttaggcaatggctgagaatggcaactcaccacatgcctttgaataagacgtgattattattaacccatattctatcaaagaagaaactgaggctcagagaggcaacttacttgccaaaggtcactctgctggtagcccacctgggaggaattttccagagatcactgtctgatgaccctgtcttggaattggagccatgcaagttacactgaccacgtttgggttgggatattgaggaggttatggttaaaagcatacgatgggagatcatattgtacttgcgagtgagacccggctggaggaatgttttaattcttcggaaataccaagtggtctct

SEQ ID NO: 574 - DNA, 2506 bp, Homo sapiens
gttctgggcccagatccccataagtcagcgatgaggggggccgagcaggggctgcccgttagacggccgcagagtcccagcccccagccctgctcacctttcttacctctctggccccgtcggcatttgagcctgggaccccagacgaaaggatacgcttccttttagaacccctgccaatctgaggacggggccaccccacagacgccgtggctcagcaagcagaccaatggccgaggagtctggcaaggggcgcttggcagatgagagtggaggttgtaaatcaccctccatgcaatggttcatcataaaggatatggagcaaaattagaggaggcacgagaaggaaagccggtgatgaacaaggaaagtgcctggttgaagctagcttgcaatcccaaagtcagaaggttgcctgggaagccatgaaacaaagccaaatcaaggcaaagcagacacatggagattttgagactgagaagaggaaaactgaggacattcatgtgagatggtttcaagtttcccttagaaggagaagttatcttcagaaggtcaggttggtgaggtgggagttcaaaaacaacaaagtatgtagctaccattgtgaggaagaccatggaaaatggacgaatcagaatgaaaggctttctgaacaagagggagtttccctgcacaagctccctcctgcctgctgccatgtgagacctgcgttttgccttccaccatgactgtgaggcctcttccccggccatgtggaactcccagagacagaagcagataatgcaagtgtcatctacatctggcaaaagccaaaggtttggaagatggaaaaaggaatccaggcaaaaaggagcccaagattgaagtgaatgaccaggtgcaccagttcaaatgcaatcaggagggacaggggtagagggagaagcctagagcagcgcttctcaaactgactattcaagtcacctggagatcttggtgaaatgcagactctggtgcagtaggtcctggcgggaacttgaaattctgcattttgaccaaggtccaaggtgaatgtccagtgctgttgtccttggcctgcagcaggaggagcagggatctaagacttggagagcaaatgtcaagctcagaagaaagactggaagtttggggacaaaacccaaatatggctaaagaaagcctgtaggatgaagttggaagttccagagccttctcttcacataatgggacatgcaagggggaaaccaaatcaaaagtgtagaatgcgtcgctggatgtctttgacatgttattgttctgatagaatatcagcggggagctactgaggacctcctcactaccctcccttggaagagtttgtctgcaatggagccaacacagtggaaagcagagctgagaaatggacaaacaactcctgatgcctcatttgagcacctggatttagccatgtctgaagctattatatccttgaacttttgaatcatgtaggttaccataattccttttttgttaaagctaatttgagttgggtttctatcacttgcaatcaacaattgaccaggtgcttagtacataatgaatgagtgaatgaacaaattcaattctgtaagtatttatcatctccttacacggcaggcactgttttaagtcccaaagaaagaggcagaggagcgacagagatgacttcctcccttgaaaacgaagcatgtggcctgacaacctaaaattggggtcaatccatccaattatggtgactgcttagaaatatcccttttcctcccaacgttttcctttccttctcccataaacataataatgtctcctgccagtactaaggcatggcccatggacccactaacacctatgctcacgttagctcttgaggccgagtggcttggttctatctggttatcagatgcaaacttcatcacagcagggatttgggctagacattagaggaatagtgtggtaccagatggtgtttctgaagaaggttgtcctatttttgcagtttaaggatttgataataaatctgcctggcagccctcagatgtgatttggccttgaaatcgtctctgttaatccttgatgctgtgtgtatctgtcaaggtccaaccagaaaaaacagaacctgctctaagtatctgaacaaagggaaatttaatgtaaggagctgattgcacagatgaaggaaggggctgggaggcaaacaagagggaactgtgaggtaacccagggatttgccacagtaggaagacatgaccactactaggatagagaggtaaaaaataaaaaaataaaaaaagagatggtgttacttgtattcaggaggtggagtcatccagaggaggctgaagccatggcaggtctgtgtggcagaagctgctgccagggaagacataccatggctccaagaaaagctgccagagacagaaagtgtgggggagaaagattcttccttttccctgcctcccacctctcaaactcaccgcagagcttccccttggcc

SEQ ID NO: 575 - DNA, 1776 bp, Homo sapiens
aatttagtagagttctctgtatagtctctaatcttagaaaaatgttggaagggtaatttttaagtgtagtggtttgaagaacaaaccagaagcgcacaaacctttgtgtattttagaatatatttgtcttcattctgcggagctcttgtgttgtaaaggtgcagaactacgtaaaaatagtgttgggcagacttacatagtacatctgaaatcagatactggtttattcgaccatatttctaagggcatttttccagtaaaattgttttattttttgagtagccttcctatagtggtacatgttacatcagttgcgcatatcttgattttacagaatctgtcttaagtaccaattttggtttttcaaatcaatgtttctgaaatttttgaacactgaaagtggttttaaatgaatattctgaatctagttctttagaatcctctttgaattgtgaaatgcaaaataattgttagcagtttaacctgaaagatctttttacatgataaatgggggaggagaaagactgaaatgaaaatgttgaagaccctgatttgaaattgagtgtaaaggtctagatactgtaagttttagagtagctttagagacaaagctagtatcccacttggtgagatcaagtaacttgtggtttaaaatttaaagtaaccagtggccattttaacttcactaatttctcttggaggagctaatttttaattgctcatgattgtaaaacatacttccggatggtaagggagatgttaagatgatttgtcttgaagaatggtaaactttttctttgtttattgcctgtcataaaaagagggaaagtaaaaaaaaaaaggttcataatcttaaatcagtccaaaaatttgaattttctgtatttctgtttaattcaatgcgttaatctttagcattggtcaatacagccaaaagatgaggaaaacaaagactgatagatactaagataagaaataactgcaaccataaatgtatacaggttatgtgtccatgagccatctcttcagtttgcccatagatttttgtctgtggaatattttcttgtttcatcacactgaatcgttggccaagaaatgcttgaaaatcaaaacattaatatcatctttcttcttttttttaaaggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaatttctcagtttgggtttttttttttaagtggaagtttaatt

SEQ ID NO: 576 - DNA, 454 bp, Homo sapiens
cgctccctggaggcccctccagagagggacccggggccccgccccgcagctggagaaggggtgaatgcctttcctacctaacgcctggtccgcggccctgcttgttgcgtctccaagaccacgtgtctgctgcattttaaaaatagttgtgaacatctgactttctccttttactttggagtttgctgaaatgtaacctcagaataagtggggtatgactgccctctcctttgagggaaaagaaaaagtattttcaggccaggcacggtggctcatgcttataatcccagcactttgggaggctgagaatacatcaataaaagaagaacaattcaagagaaacaggaaattcacagaagaggaaaccggaattgtcataaacaaatgaaaaatgctcaacttccctagtaattatgagaattcaaatcaaaataaagacttcatttcacactta

SEQ ID NO: 577 - DNA, 3651 bp, Homo sapiens
cgcctccttaggaacgggaaggagccccggcccagtgcactgacgtagttagcctaagatcacgtagctggttggtcacagaatcatgactttaattcatgtcttctgactctgacctggcacgctttgtacctcaccaaagacagtgatgaaattgcaaaagggcagagtggagaagactggaatgttcagccaaggcatttgaacttttaatgctgcaagtcaagacttcctgaagatttttgagcagatgagtgaagtgataagaaaatgcatcttcagcagtgacagcatcaacgaggaggagactggccgggaggctattacccgcatcaaaaccagtgaacattaaaaaaaattttttttttagagagagggtcttgctcttttgcccaggctggagtgcagtggcttgaccatagttctctataaccttgaattcctgcgttcaagcgatcttccttcctcagcttccggagtagctgggactacagatgcgtgccaccatgccaggccaatttttaattttgttttgtaaagatggggtttctgtgttgcccaggttggtctcaaattcctggcctcaagccatcctcccgcctcagcctcccaaagtgctgcaatttacgggcattagccaccgcacctggtccaaaaccggtgaagatttgttaaggtgttggcaatatgggtatacctagattatccttcatctgctaaaaacatgctctaatctctccccagcccaaaacaaacaagaaacctctcttccccttccagctcctaccacgtgtctttgctcctctgtatggcaaaactcaagtgttcaaaattccttatcttcaattcctcttctcccattcccaagtacactacagtcaggcattcacaccaccaaaactgctctcgctgaggccaccagtgctgtattcaaaggataatctttgttttatcagctgtatttgatccagcaactcaagtttttcctgtctagaacacctttcaccggtcttcttgcttctccatagtgctggtcgtaaccctcaaaaggtcccccagttcactcaggataaaagtcaagtccttaaaatagactacagggtgctacagcatctggttcctatggcttttctgatctcatttcatactgtctttgctcactccactgggccaatcaagacccacctggggggttttcctttgttgttttgcctgcctaggaaacttcccaggtatatgagtttgctagagttgccctaacaaataccacagaccaggtggcctgaacaaaactagtttattttctcgaagttctggaggctagaagtccaagatcaaggtgggattctgaggcctctctccttggcttgccgatgacagccctcttacttcctcttccctctgatgtctcttcctattcttctaacaccagtcagattggagtgtggggctacctttaacagcctcattttaacttaatcactgctttaaagatcttatctccaaatacagtatagttatattctgaagcactaaaggttgggacttcaacatgtaaattttggagggacacaatttagcacataatacccaggtacccacaagatatgttccctcactttatttgaggctttgctaatcccagtgaagtccctcctcactaccttatttaaaattaaaacctccaccaccttccttcctttatttctctcctgctttatttctgcttagccgatacatacattacaaatatgtaaatactgtaatttacatatttgttttgtttattgtctgctgtgtttccttccacttgcatgtaaattctgtgaagatttgctcattgatgtattcgaagacataaaacagtgcaaagtgtttagcaagcatttaataaatgtttgttgaatgaatgaatgaatgaatgaatacctgaggacagaaggaaagagacaactggaaaggaagagactgcagttgctgtagacagagggggttgattacgagagcaagattccagagtatctggaggaaaaggggcagctctgccttccatgttgaaagtagagcgtaggaggtattcctagagagtaagttattttgaaaagtagagaaaatagatgagcgaactcaaaccaattgaccattatctactcaacaaaataggagataaaattgcccacctaaaagggattatactagttggtatgaggaaggtgtcagaaaattaacataagatgaaaaatgattgttaactacctgtttgaaattagtgtatatattttagtgggcctggtcttcatggttttgtaattttttcaaaaaatgatcatggcatgaacaaggctattaatctgaactaatgaattaggagtctacttgccacctgtaaatactgtggaagttttatttattcatttaacattcagggattccacatgaccacctgcaaataatgagaataaagatatgaacaaaatagatgtggttcccgcccttctgaaggttaacacctatctagttagggagacagacattaacaatcacacatatattattaaaactgagataagtgctatgatgaaaaaggcgcgggcagaagagcacagtggtggaaaatgccagtaaggagagtcaagctttatacttgggaacaaaacacaaattttccattttggaaaaaaagcctgagtcgaagtgtgctgactgggaaaataaattaaggagagaaaagagagtctacctgctttaggacagcatggagcttcacagtgactttgtgggaactctggaacctgggtgcctcagggaaatgtaagaaagtggggaccgggcatgagagctggcccgtgaggctgggccaggaaaagaagctggtgctcaggtaccctgagccagggttgcccaaaacaaccaagattctacaactgagtgtggcccaaaaaatcagcaaaataggtctgagatttagaaacagtgagttcaatcccttaacagagagagactgcatctgttgaaatgatatttgattgtgaataacaaaaacgttgccatatagtgggtgaagcaagaagtgggttttttttttttactgacaccacagctctacagtgatgttttatttaaacttatgctccttctgtttctccatgcttcatgggtgactttgttccttttgcctgtcgtctcactgttttgggatggcaactccagtatcatttctttattataggtaggacaaagaggaatgacaaaaggcatgtaaccacctgaatttgcccctatcaaagagctctccaggaagcaccaccaaggaattttcactgacatttcccaggccagaccatgctgctgctaagcaaaatgaggattctgctagtgaggatgaaaggaagaatgtgtaatcagttttcttgaagtataatacatgtacaataaactgaacctattggaaatatacatttggatgagttttgacagatgtatataccacagtcaagatacagaacattcccatcactccaagagattctttgtgtccctttgtggtcaatccctcctacacgaggcccctaggtaaccgctgatctgttttccatcacaatagattagtctgcatattctagcatctttaataaatgcagtcatacagta

SEQ ID NO: 578 - DNA, 3676 bp, Homo sapiens
tatgtggcagttcctcactagggaatttggtctccagggccacttttgaccttaatccatgttggagccatcaatcaaagaattgcttgcatctaataatggtgtaatgccaatactaagccctggaacgaagataggattcatttctcatggattattgagcactctggggtaacctggccctgatctgatgacgctaagatttaaaaacccagatgcatgtgactagaactatcttttctcccatgatgcactgctttcaacactgcatgactgtaaaaacatgtgccacgctgattatatatagagatggtctaaatcagctgcatcccatttggtacccaggcaaggatttttccatacctatctttttgctggtggtaatgatgagttttgtcacttgctataacattctctgtccgtcttttttcttttatgtaaatacttttgtgacttcattgtaaccagcattttgtaatactcttaacagcagaggggattaaatcatgattcacttctgaacagtacaatcagcagtaggaaaacgaggagggagggagagggaaattgtccaccacttcccaatgataatgcctggctcggaccccagattcacatcatacttgaagttcataaattctgggcactgctcagcttgaggaggcaggcattgctccttcatatttcagggtgagacaaatgctctgttgaagccatgccactacaggatacattcacctctgcttgctttcctccctaagccagagtgtagttaaacatttatatgtcccaggccaggagatcaaattaagaggaggttagctactttccctggctcttaaaaacatttgagtccaagtatggttctctggcttgagggtggccatttgttgcctcactgtttttattaggacatctggagattagaggtgttaattggaagtaacttttctatatttggtttctctccacacattatgagaccttttagacccagttggatggctgtatcctagtatgaaattcagcttctaagtaggaagaactatgatagaggaacaagattgctctttgacttggtgatagtagggcaatagggagtgtcagtagggtagtttcaggtggggaggatgacaaaccactgataacaataaaaatgggtatttctcaacactcaagccaatttcccatttgataacaagtaggttctgatctattttccccaaattaatattttccctggaagattctgacctgtctgatcaaataaaggcattcctctgagagtatacctagcccacttgtggccaaattatacttgactgttatgtactcaaaacaagctttcctgttaatctctttctcttacctctattatgaggacaagacgtggaagaattaggtcaccggggcatctgccattgcatatgtttaagtggtataaagaagccaggattcctagaatggtctgtcttttgccatttctgggacaatgagaaaatccatctggagtgtttatgcccctctgaatagccaagtcatgggcttgtttgctttcagtcactgccttcagaaaaagacaattttacaatgacttacttctaataatcactgaaacagcctcatgaggacatgcaaaactgctgtctatcttcagacctggcccattgtcaaatggcagacttgcagagcaaataagggacctggcctagttcacaaggcagtcagaagtgatccaaagttcaggctccccctcccttttatcactccaccctgcctctactcctccgcctcctattcttccggcctttccatctggaaaccatgagcctcatggattccaggcacaaattctcagatttcagatgtttgggaaatttctcagcttgggtcattcttcaagagtaagaaattgaatttgtgagaaaaaaaaacagctgagactgtttcacagaagagaaaataaataaggtgtggtgcgtatccatcctcttcccaactcagctccaaaaccacacacaatgtctaacttcaaaaagagtatttagatcccccctgggaaggaacagaatggaaaaacaatctccactcataaaaacacttttctgccttctacagtataaacacaactggcatcagataatacaatgtaattgattttatgtgtgtaattggggaacagaagggtctctagagggtagacctaagagtaatggaatggagtgaaaagtaaaatttagactaaattgttgggaggaaactgttaacattgtgaaccacttgaccctagtgttgcatcttcacaaaaaagagcaatgtgccgtcttctgtctttggaaaatgggacaagcttgctcctgatactaggttttagaagcatacagacttggttttagtactggctttgttctttactaactctgaacaattaaatgagcagatggtctacagggcttagtacagtgcctgacacatagtaagcacttagaaatggtagcttctgactgttgtgctggagtcctgttagagattcagtagatggagccaccttcatgttgcccctcactgagctgctctgctcacctctagatgctccccatggctgtttcatagccctctgtaccacatccccatgtactttttcatatcaacggtaagtacctcaaattaccgtatgtatttacttgttcataaggttgatgtctgtaactctttgaaggttgtattagtcgtttgctcctatattactaatgatgacaaagtcgcctgacagagtagatgttcaaatttatggacttaaactgactgacatcttgataatgcccatatccagaggtactccagatattatatcttcatgcagaaaactgaaagatacctttagctacatctaccccagaatgagtgtccaaagcaggtggcaccaccaaaaggcaccttcttttcccatgaaaagagggaagagagttgagaagcctcactcccatccctgctctgccactgacaagttgtgtggcatttggcacatcatgttctctctctacatgcgcctaaaatgacgggtagggtcagagacattggaggatctctcttttctcttccacctctaacacggtaagatcttagcaaagtaaaaaggacagtgataacagaaaaattgttcctctaagagtcccaagtcatcttttttctctccgtgtgtgttagcatttgtgtgtgtctgtgggtgtgtatgcatgtgtgtggaagctatacaaggaaagctgaatccatatgtagacttcatggagactagtactgctccaaatgtgcacaagccatgtgatatggtttgcctctgtgtccccacccaaatctcatgttgaaatgtaatccccaatgctggaggtgggacctggtgggaagattggatcatgggggagttttctcatgatttaacaacatccgccctttgttgtcatgatagtgagttcttgtgagatctggttgtttaaaaatatgtgacacctccccccaccttccttctgctctggccatgtaaagtgctcactccccctttgccttccaccatgattgtaagtttcctgaagcctccctagaagctgagcagatgccagcatcatgcttgctgtgcagcctgcagaactgtgagccaattaaacctctttatgaatta

SEQ ID NO: 579 - DNA, 698 bp, Homo sapiens
gtctgggaacggctggtttcgcggtcagacgccgagggccctcgaagtccctagcaacggctgcggagggagattccacctaggtccgtgcaggttacaaatggcaaccagaacagggactccaagcacgcccaactagcagcatccaaacatgggacttcaaggacgtgaatgaagaaggtctgctggagcagaggaactgaaattgacaaggcgaaaggggaccctgggaagagtctgccggcagcagatataagtctgtaaaatcggatggaccaccaattggagaatgagagcctcccagcccagccttacattctttcaattaatacataaacagaaagggggatatgcagggagccaaaggcctgtgggacgtgaccaactcagcattctgctggaggctatatgatcaaacagcaaactgtttatcatgaatacaggatgtgagcaaactcaggactgctcctgccaacataaggtttgctggaggcaatcactccctggcaccgaggttatctactgcgacatctagagaatgcagtcttgcaagcctactctgaactgagcagccgaccccttcttccacccccccaccctcctatctcttttgcctaataaatacggagggctgtgtaaagctcagggcccttgtccactagaggtaaggtgctccctgaccccttctcccaaatata

SEQ ID NO: 580 - DNA, 2493 bp, Homo sapiens
agaagagaaactcatgtcagccccagccctggggctacctgacctgatgaagccatttacactgtatgtggcagagtgaaaagatggaagttgggagttttaatccagacggtggggccctggccaagaccagtagcctacctctccaaacagctagatggagtttctaaaggttggcccccatgtttgaggaccttggcagcaactgccctgctagcacaagaagcagataaactaactcttgggcaaaacctgaacataagcaccccccatgctgtggtgactttaatgcataccaaaggacatcattggctaacaaatggtagactaactaagtaccaaagcttgctccgtgaaaatccctgcataaccattgaagtttgcaacaccttgaactccaccaccttactcccagtgtcagagagcccagtcgaacgtaactatgtagaggtgttggacacagtttattctagcaggcctgacctccaagaccatccttggacatcagtagactgggagctgtacatggacaggagcagcttcgtcaacccacaaggagagaggtgtgcaggatatgcagtggtaaccctggatgctgtcactgaagccaaatcattgccccaggatacttcagcccaaaaggtcaaactcattgctttaatttgggccttagagctaagtgaaggtaagactgtaaatatttatactgactctcggtatgccttcttaaccctccaagtgcatggggcattatataaagaaaaaggcccattgaaatctgggggaaaagacataaagtaccagcaagagatcctgcagttagtagaggcagtatggaagccccaaaaggtggcagtcatgcattgcagaggacaccagcgagcttccacctcgattgccttggggaactcccaagctgactcagaggcttgaaaagtagcatccacccccttctgggcatcaatcacagcccccctattccctcaggcacctgaccttgtacctacttattctaaagaagagaaggactttctctaggcagagggaggacaggtgatagaagagggatggatctggttatcggacaggagaatagccataccacaactgctaggagccgcagtcatattggctatgcatgagaccacgcacataggccaagagccacttgaaaagttgttgggccagttcttctacatctcacatctgtaagcctttgccaaaacagtggtgcagcagtgtgtcacctgctagcagcacaatgctaggcaaggtccaactgtcccgcccagcatacaagcttatggagcagccccctttgaagatctccaagtagacttcaccaagatgtccaaatgtggaggtaacaggtatttgctagttctagtgtgtacatactctaggtgggtggaggcctatccaacacgaactgggaaagcttgtgaagtaacctgtgtgcttctccgagatctcaaccctacgtttggactgcccttacgaatcagctcagacaatgggctggtgtttgtagctagttggtacagaagacagcaaaggtgatcgggtatggatcacggattggaacatagcctccttgcagccacggtggagaggaccccagaccatcgtcttgaccactcccacagccataaaggtagaaggaatcccagcctggattcaccacagccatgtaaaacctaaagcatctgagacctgggaggtgagaccaagcttggacaacccatgcaagatgactttgaagaagatgacaagccctgctccagtcacacctggaagctgactggtccgtgcatggctgaagcatgaggaaactcatcgtgggactcattttcctaaaattttggacttgtacagtaaggacttcaactgaccttcctcagactgaggtagggcaaaaagttaaaacagactttctgtttaaaagggacttgtgtgtataatgctacccagtacaagatatgcagcccaagaagtgaccagcttgatgtgtgctataacccattggaactagtttatccctgttggaaaacagagtatgtaactctaggaattgatggaactggactggaagacctgggtagtgaagatgacagtgagaactcccactagtgagtgagattctcaaaggggggaatgagaagtgaggccatttctcttactgtctcctgtctctgaagaggaggaggaagtaaaagttgaaaaacaacaggaatgaagtcattggcaagaccagccggtgccactgatgaccaggcctgaggttaaaagatcaaccccccactctaaccacatgtgctctcaatctatcatgaccctttcatgtggacccccttagagttgtaagcccttaaaagggccaggaactctgtcttcagggagctcggttcttgagacatgagtctgccaaagctcccagctgttgagatgcgagtctgccaaagctcctggccgaataaagccaaatccttcctt

SEQ ID NO: 581 - DNA, 599 bp, Homo sapiens
ttaatttgctcacattcattataatccattatttaatacatttttcttccatttgatcatattacttgctgataggaaggactgagttcattttcagcgtgtctggcttttccatttctgtggcctgggaaggtgggtggctacatcatcatccatggtctctgaaatatcctgtgttaccaaggcctgcttgttccaccaaactgctccataggcagttgtgacacccagaaagatgctgatatggtttggctgtgtccccacccaaatctcatcttgaattgtagttcccataatccccaggtgtctgggaggggcccagtgggaggtaattgagacatgggggcgggttttcccatgctgttcttgtgatagtgaataagtcccaagagattctgatggttttataaacaggaatttccctgcacaggctctcttgcctgccaccatgtaagacctgcctctgctcctccttcaccttccgccatgattgtgaggccaccccagccatgtggaactggacgcctgctggccacacatcaccatgaggatgcacttgactgaatctggaagaatcccagggctgtggaagattttgg

SEQ ID NO: 582 - DNA, 858 bp, Homo sapiens
tttacccgcgggaaagccgaggcccggtgctgtattctgccgcccattttacccgcggggaagctgaggcccagtgctgtttaatatcttactcatgttcacttgatgagaaagtgacagatctgagacaaacccagttctagaggttatgacaccagccatggaagagcagagaggccaatgaggtggggaggttggaaacaaaaggccttctccaccccagcttgaccaacccaaaagctggaaggcaaggaagacctagacagaatttaagagacaccagaggatggcacatttatactgagcttgcagtttcctaaacatgaagaagatgaacggctctcagttaagcagcacgggtcagataggagcttgaaattgaatatttgagctgacacgggagagacatacttttgagattccaaatacgatttctgtggagaaaacaaaaaaggactctgtttttaattcaaaagggagaagtgaaattctacctcacttttttaaaagaagagcctggaattggcctatccgtctttttccccgttggatcacagagcagaaaggaaggtgggcgtttgtgttctgggtgttgtccacgctggacgtgccagcatctcccactgagccagatgttccagggctaaggccagtttcatttgaaggcacagccttactatatcatattaatctgatgccaagtttttggatgttatgagcaaccacctcatttattttttgtggttgtttaaccacaatgagtaagtcatgccgtgagggcccagagactgtgtcactgttgtgatgatagagtgcagggcccttcaaagggaggtctgtgggccagcagcacccaag

SEQ ID NO: 583 - DNA, 440 bp, Homo sapiens
gaaagaatcgaagcctcaagcgtcacgtctaggaatagcgctggagtcgggccaagtcattagagacgatgagtaatctggctcttccagaccttcctgagtggtagtggccacggctgaagacagagggctgcgtggaggctgaaggcagagggctgggccttgggcctgggtaaagacagctctggacatggagtggcaggagcgataagcagaactactggtgacactgtgggagagaaattctgcaaaataacagctgggcagcccgggaccccagggagttgaaatgggacctcggagacatcaggatgtcctggagaggcaccaaggccagaggtcccccagggaccgtggagggggcattaagccctgaaaacagatcatgatgcccatccccccagcacaattagaaataaaaacaacccgggacagttaaa

SEQ ID NO: 584 - DNA, 2567 bp, Homo sapiens
ctttgtaatttgtagcaacaaacctggggtcagacactccactgcctgtgcatcttgcctgtttccggatccgccgtgtcacagacattttctatgtcagtgcctatggctctacccagggtgatgctgctgatctggtctgattcccaagctggaggtaatggcgtgtgtcctgccctagtgctgctccctgatggggagcatgctcagtttcctgcattcaggtacgagcagagacttggcaggatccgccccgttcagagttgcaggaagagccctggatgcctgtcgcaaattggaataagtgggagggagccacaggctggtacagagacaaggtattgctgtgttgtccaggctggtcacagactcctggctgcaagtgatcctcctgcctcagcctcctagagtgctgggattacagacgtgagctaccacacctggcttttcattccttttaatggctaaataatgttccattctatagatacatatttttttccccattcatcagttgaaggacatttgggttgttcctagtttttggctatggtgagtaatactgctatggatattcatgtacaggtttttgtgtgaacatatgttttcatttctcttgggtacatacctgggaatggaattgctggttcaaatggaaactctttaagtttttagtaactgccagactgcttcctaaagcagctgcaccattttacattcacaccagcagtgtatgaaggatccagtttcttcacgtcgtcaccagcacttgcctgtctttgtacaccaatcaaaggtgtatgaagtcgatctcattgtgtttttcatttgtatatccctgatggctaatgatgttgcccatctcttaatgtgtttatttggtcttttgtacatcatcttgtggaaaaatgtctgttaagatggtttgcccatttaaaaatagtgttatatgtcttttattattgagtaacagttctttatatgttgtggatacaagtcctttatcagatgtgtgattttaagtatgttctctcattctgtgggtcatctacacgttcttaaaaaattttttgagacagaggctttttaaacaaatttttttgagacagagtttacctcccaagctggagtccagtggtgagatttcggctcactacaaccaccacctcctgggtccaaatgatcttcccaccccagccttctgagtagtttggactacaggtacatgccaccacacctggctaatttttgtattttttgtagagatggggtcttgctgtgttgcccaggctaatatcgaatgcttgggctcaagctatctgtctgccttgggttcccaaagtactgggactacaggcgtgagctgctacacctagcctgcatcttcactttcttgatggtatcatttgcagcacaaaacttttatctattttttttcttttgtttgtggttttggtttatatttaaataggcttcacctgacccagggttttgaagatttacttttatatcttctaagagtttcatagttttaggttttacatttaggtatatggtccattttttttgtgtattgcataggaaagggtcccaacttcattcttttgcatgtggatgtgaagttttcccagcaccatttgttgaaaaggcgattctttttctgttaaattttcttggcacctgtgttgaaatcaaatatgcagaggtcttgacacactgttactgtccagtctctacacatgctgtccttctctcccacaaagtgtaataatgtaataatgcaataacgtgcctgataaccaaatgagtggatttcagcagtccccctttgtctgaaacctttgtgatcagagggaataaacatcttagaggcatgaagcccttgctcagataaggagaagatagagaaccaaagtgccataatgtaccaagtaaaaagcatcagatgtgccagaaaataagcagtaggaattaactttgagggttatcacaggaacactatgtagagtaagcacaagcagctcagctgtggacgagctttgctgtagattttgctgcaaacctctgcaggcctgagagcttgccgtgggtccagagagcagcagatgtacttggctgtgacgtcactggatgtgtcctgatctactccttctccttctcatacatgaggttatctgaggtctcagccaagagacaaatcagcactttacccacggacagcaccaaagctcgccatcttggccgctgccccagaaccttggaaacttctgcagtgaaatggattctgattatttttattacctttgttctttttttagaattgaagtctggaatacataaagtgtgttaatattaagtgcaacttcgtgaccttttaattgaggtattactgtgtaaccatcaccagattaatatatggaacatcataagtaccctgggagactccttgtgctatttcccactcagtgctctcctcttaaagaggtcagcactgttccggttcttctattaccatatatttgttttgcctgctcatgaacttcaaataaataaaaactatggtatgt

SEQ ID NO: 585 - DNA, 2277 bp, Homo sapiens
agatgctccccggcctggctccgagtaactgcgagctggaggcgcggctgctctctcgggcggacctcagctctgcgaaccctgtggctgccggagcactgagcgccctgcccggagtcccgcggagcctggcgaggaggggtcgctgcatcccgagggccagccctgagccgggagatgaaacagctgtcatggaaatattttttaaatctcatactggtcaaacggtgtaaactttgctggaaggaaccttactcagagggccaatcacctgcttctctagagttctcaagctctcctgtgagcaccaggttgagctgcagaaagccagaaccagctcagaaactgagaaatggacatgaagatgcccaggaaacatctctacagcatccctaactgggggttgatccattcatttccagacacagagaacagagtcacattctgctgtttccatatgtaccattttagtaagacttcttggggcacaaggcaggaagttggggacaatatatttgtctgcaccaaggcagcctgagaagagagaagtgaatactcctggggttattctatattattcacttaatattctaagtgagtcctctaggggtacctgagacatggagtatgaaagtacacattcacaaaagtaccagctttaaaactagattatctctactattcaaaaacaccaaggaaaggccacacaatggagacaaagtgcatctgagatctagcaaatttccctgttggccacatactgataatgatgtattaaaatcaattctatactgtggggtacttatttgacattaataggtaccatggtggtttaacatagttgctgcccagagaaaacgccgcacactcacctacactaaaatgaagtctgagtcagctgcctcccctccgccatcccttccaaagccaatggttgaaagtcacagaagtccctctgctgccacctagtgacgacaatgtgaatacaactacacagcctcctgggaaagaagttttgaaccacgtttgcttctaaaggaagcctgtaattacctctgagtgctctattttggctacaatttaaaaacatatatattttaaaactctataaactcttatgcatatccctttttaagaatctgacctgtaatggatgtagcctcactttcaagaacctaaaagctatgcccccaattcagggagtagaacagacaggcttaagaacagtgcctaaaaatgccactaaatttatctttaaaatgcctgtggttccttagcacttgaattccgttatgcccctgggtatagtcacctggatgttaggggctgtcaaaattcagccctcagttggtgatcagtaggttttccctttaagtggtttctgaaaggattttttttaaaaatcttgaaattctcatgtctggatgatgtttccagttttgtggaagaataaaagaaaagggacatgaaattctggctccctgggggcagtggctgtgtcttattaatctctgtgcccattgtaccaacaccggtcagtcacagcatgtactcaaccaatgctgatgaatgcagaggggcgaggggctggcacgctcttgaccccttataggggctgcgtcgatggccagggttcaatgggaactttctggtacagtcttgctctgccaatctttcaaattaagtgcagcacaattggaagcctcacattctcatagacgggttgaggagggcattaggggcagaaaggctcacataaggcctgagcgtgaggtttcctgcccagcactgctgtgccattgcagcccaccttcttctcacctttccttccacaccacggcgcggcaggtgcagaaaccgtgctgggattgaggccctagaggctgactacaggtcttgggggcaaaacatctggacacacagctgaagatgagccaagtatattagtcagggttctctagagaaacagaaccaacaagatagagagatgcagagagacagagggacagacagacagatttaagtaactgacccataaaatcttggaggcttggcaagtccaaaatctgcaagatggaagtgggctggcacattggagactcaaggaagagttgcacgttgagttcaaaggccggctgctggcagaattcctttctgctcaggtgaagtcggtctctgttctattaagaccttcaactgattggatgaggtccacccatattatgaagggtcatttgctttactcaacatctactcatctaaatattaatctcattg

SEQ ID NO: 586 - DNA, 1563 bp, Homo sapiens
ggcagctaggccgaaacgcctgtatttaaagggatagtaactcggactcgttctgcaatatccccacaagggcctgactgagcgagcgagcatggacggccgcggggctttctggacagtggccattcccagagccaggcaggaaggcctcgggaggctggggctcccgttcccggtgaagcggacgccgccagcgccccagaacccaggaggaagcacacaggccccacagagagtggttggcaagagtcactcggggattaggatgccggccaaatcgcggaatttgaggctggaatccaagctcaacaggactgctgtgtgtgaagcactcaagagggcccctacaaccaacctgccaggagtcggctcctgaaaacagggtcggaaaaggggtctggcactcttcctcatgcttacgagatggctgctggaattccaggaatcacatgcaaattctagtcaggagcaaagaggaagagacacagtgaaaaggggtatacagcggcagaaggaagctcctcaaatgaactctgctagaactctagccagtagcttctccttctatcacagtggccagaactgtgacaagtgaccatccttaggggaaaaaagatgctgagaaatgtgaattttgttgccaccttacattttcaaaggagttccattcgtaagtacagaacgctcagagaagaggcagcagatctaggatatggagcagcagctcttaagggcacagtgggaaggtttcaagactgaggaggatcttggatttgggtaggggaaggcagttcacagtattgtggaggaaatgctgtgaaagagaaagtggaaggcatggaagcttaaacttttaatatgactggtgaatacaaggatgaagggcaaagggaattcagactcatggtggtcagattaagaccttcagcggctctgtctcccagccccacatacccacttccatgttctgctctttactgaagctgaaagtctgcaaccttcattctctgactcccttacattttcttaggcttcttgctagcttctgccaaaaagaggccctggcaggagattagatggcaggaggcagaggtaaggattccatgttaacaggtgctggaagttgctggtgtggcaatgagaactgggccccggtcaaggcagcactactttggtagatccagaatcaaccatgataaccgtgacagtgtcttcaacagtgcagcagtagacacaggcccctggtgctggaatccaatacagggacaggagcagcacggagtcacggaacaccgtcttgccttcatgtcactttaccatttcttctttctccctcttactctaccagctacctgtggagatgttgaaccttttatctgtcgctgtctgcttaggaacagaagaaaaggcagctgattgcttgactcagctttcagcttgatttttttcctttggcagagtgaattggggtcccaggtgttcattttccttttgtagtacctttcctcagcatgcaattaatacaaaaagaacaataaaccttaacaaagtttggcttgtatt

SEQ ID NO: 587 - DNA, 2271 bp, Homo sapiens
gcttcatgaatgcacacagtcacgtcgcagaagtgcccacccagcttctgcccattgagggtctcaagcagagagcgtgagaagttctgcagatgtatgtggcgcacagcctctacagccgccgactccgactcctcttcaggcaccaggcctggccgtggccgccttctcaccgactccaaggcagcacttccgggcgcttctctttatttttatacagttttattgagatataatttacatgctatccagcccatctatttcaagtgtaccatgcaaggggtttgtatatattcacagagttgtgtatccatcaccatcgttttagaacattcatcactccagaagaaactacgtacccatcagcagccactgcccatttccctgatctgccccgccctaggaaatccgtaatcactttcagtctatggatttgcctattctagaccattcatataaatgaagtcacacaacactgggtcttatgtgactggcttctatcaaagtttgcaaggttcatttatgttcatgggctgaccccacattggacaccgctgcatccatgtccatcacacaacacagctgccgtttcttctgcctgcttatgggaaagtcccctcttctcctccgttttcttctcttcctgccctatcacaccgtgcacttctccctttccttaaagaaccaccatcaactttaggaggagggaaaggggtggctctggcaggaaaagccagaatcccctctagccagcagagagagagaggaatggctgcatgttttctcccccagtccaaggcactgggtcttggctgggttgaaggttccaagctgctctcctgctgtgtcggtgagttctggtcaacctgcaacctcctgatatggccattgcagttcatcgagtcttcagggactccccatggcctggagtactttgccttgcttacacgggagaggagaatggatttatagagaacatcatctaaatccaacttgaccattgtgtggccacacttgctagattgctatagtctaaatctagcattgtagaaagacgggggagcttggagctgcacaaacccaggtctggaactggctccttaccttggaaggtgaatgatcctgccaggactcttagcctccctgggtctcaatttctttatctgtttcatgggaatgaggatctctgctgggtggttgggtgatgtgggggctgtgtgaaaacagcttgtcaatacaagccaaaatagaaatatttctccacagagtatgaaggtcaaatgagagaatacatttaaattaaatggaaaattaaaatggtaaaaaatgcaaagctgtattgaaagttccgagcttctctataaggagctttttgactatggaagaatcctgtactcgttccccctaaatataaaaaaaaagttgaaggaggcagaagggagagtgatgcacgatgggcaaggacttcacctgctgttgctggctttgaggatggaggaaggaggccacaaacctagaagctggagcccctagaagctagaaaaggcagggacccgattctttccttgagcctccagaagggacacagccccgccagcaccttgactttagcctggtgagatcctcttaggacttttggcaatcagaactataagacagaaatggaagccactgagtctgtagctgtttgttgcagcagcaatagaaaactaatgcagggcccaagaaatcactggtgatgagatcgggaaagtgggctcaggaggtctggatctgtgatgagatggggaaagtgggctcaagaggtctggatctgtggtgagatgggggaagtgggctcaggaggtctggatctgtgatgagatggggaaagtgggctcaggaggtctggatctgtgatgagatggggaaagtgggctcaggaggtctggatctgtgatgagatgggggaagtgggctcaggaggtctggatctgtgatgagatgggggaagtgggctcaggaggtctggatctgtgatgagatgggggaagtgggctcaggaggtctggatctgtgatgagatggggaaagtgggctcaggaggtctggatctgtgatgagatcgggaaagtgggctcaagaggtctggatctgtggtgagatgggggaagtgggctcaggaggtctggatctgtgatgagatggggaaagtgggctcaggaggtctggatctgtgatgagatgggggaagtgggctcaggaggtctggatctggggtggggatctgga

SEQ ID NO: 588 - DNA, 631 bp, Homo sapiens
gcaggaaagaaaaaagaagaaaacaaacctccatacgagaatgggtctaaaggaacttcccaaacctccatgattttgcaggaaacaagataaagagctacaggcaggaggatcacttgaggccaggagttagagaacagtccgggcaacacagtgagacaccccccactacaaaaaacaagaagacccctctttttacccctaactgagaggcgtgactagaaggcagaaagctggctgttgaggtgggagtctctctcttcaggcagaggtagggccgcttcctggggcagaggcgtgggtggtgtgtctggctctgcagttcctgatgaagacatactggggtgcccaggctaacctttggcaaaactaggagctgaactcaggagtccctgatgccagcctttctgatgcggtcccccctcccctcccccatgtgtctcgctccatagctccaggccaggagccccaactggctggtggaggatgtcttgctcctcagcagctgggatttgtaagtatttgtaggaacatggaacagatcagtggctgacaggcccaggaagcagacagtccccttcccataggtcaccagcttcacttccccttcctgcaccccatcctgatttga

SEQ ID NO: 589 - DNA, 464 bp, Homo sapiens
ctgggatccgacacagcctgcaccagctccgagagtctttccacattctgctgtctcagggcaaagccctctcaatttctcaccaggcttggagtcccattctgcccttccgcggatctgctgtcatgtgacggatcacatgagctctatattccaccaccactacccctctgcctagtaactagtgacggtactggctcctcccttgcatgggtggtcccaaatgctaggcaagggtggggccgccacccggattctcccctctggccagtcaagcactgagtaagcccagggctccccacctgcgtcctgagcctggtcccctgggaatcaccacaagtgagtgggctgtagagacccacagactggggttcttcctagctgtatgacatcagcaaaataacctctcagagcctaggtttctgcatttacaatatggagacttatataaaagtgatctgcct

SEQ ID NO: 590 - DNA, 1140 bp, Homo sapiens
ggaaatggtgctctgcatcactggaggaagcaagtgtgaaacctcagtccaccccatcactcaatcaggagaattcccattggacagctggcttgcatgtggaccctctggaatgaaaaggaagaaagagcctctcactcatgtttcccgctgtgcccacctgcagtgcattgctttaggactggacagatgaaatcagcatcttcccaaacttctctgctggaagactgtctggaatatctccccttggccctctgggggatgctgcccactccacagggctccctgaagctctgtctgattataaagcttctccctaatgggcaagatctcacacatgatagagccataaaatgtggcactcctggctggccctgctgcttgtctgataagggagatggagggactcgccagcacaggcagagggccctgggtcttaccccgcccctgtgcctcctcccgactccagctggtctcggcttccagcatgttggaaggcctgttctgcagaacccaaagcccgtgttttgcaatgatgaggattccatgttcaagaaaggctgggaaatctctcccctcctagggattcaaaacacccatgagcacagtcatggctgtgaggaggcttccactaaagaaaacctgctcgcatttccccgggacacattgctgaagcttgtcacggtggtgagagagacctgtggtctcctaggaggcgtggagcagccttcccacactctctgcacatacacatcctcgggggatctggtccaggggcagattctgacaccccaggcctcagctgaggctccagacgctgtgtctctcacaagccctcggaggacagtgatgctgcaggtccacaggccacagggatccagagtggctgctgaggagaagacagagcataaagaggttaaaccatgcctatggtcacccctatcggtgaagctgagatttgaagtggcgtttggaccccagagctgagctgattatcaccatgacattcaaccttccagaatcctgcagaccctcaatagggtgccctgccctcctgtccatgcctgggccttccaggactagcagagtggtgtaggacattcagggatgggccagggcatccttgtacgtggcccctcc

SEQ ID NO: 591 - DNA, 802 bp, Homo sapiens
gaggtcaggtccgcctcatcagctatgaagtctgtgaatcctgggagaatcaggaagtcgtcgtaggtgaggcagtcggcgctggcaaagagctgctgcgcggggagccagttatcgggcacatagtcggtgccgcccctgatcagccatgtgaagaccatgattgctttcccttcagccttccacctttgtaagtttcctgaggcctccccagaagcagaatcctgcatagtctgcagaactgattttagaatgccaagctgacattttgagtttttatgagaaaccagaaaatttggtgtgaagaccctaagtggtgtgtctgacttacagcaggcccacactgctgatttatggtgtaccagtggaagacaggagagacaaaacctgacaaccagaaaagaaaaaaaaataaattgaagaatctttctaattttctgctcagcagtggctaatgttgttgtcctcttgttgttgattacttccatccactcaatttggctgatctccagggggcctacccttctgtccactaaaacctggcagcctgttttttgttttgttttatctttaactgatgtgctttcattttgttttattctattttgattgtttttcattttgggtgagtttacagcacactaataccaaagaaaatgaataaagaaaacattagaataaaactatgttggaggagaaggggaacaacaaactctacaggaattctgatagctttctatttcctttttttgaagtttactttttgcaagtagtattctcaattgtaaatccacaaaatatt

SEQ ID NO: 592 - DNA, 780 bp, Homo sapiens
cagagagcggggttagggcttcattgccttgtgtcctctgctccgggagacttcggtgattctgccactccctccgtcgctctgtgacctgctggcattgaatgatttatagctaagactccaggacacccctgaagccgagaaatgaaatcccaagttgaccgtcaagtccaacgctcgctgcagacatctagtggacccggcgctcgcggacggaagcggacagacctagttggatccttatcccaccaatctggcccacctttgctgccatctaactccgctgaccggcccaccgttcctccactgttcgctggttgacccgggcagcggagagaggaggcggcaccaacagaaggcttctgcaaagctgagagctccttttacccatggatcaggagcagagtttgcagctacactgtcaggctgtgtttggatgttagcagttagtttagctttgcgtcttcagagcaattgttcttagctacttaaaaaaagaaaagaaaagaaaggaaaatttaaaattttcttcattgatcattcaggagcatgtttaatttccatgtatttgtacaatttcaaaagttcaccttgttgttgacttctagttttattccattgtggtcaggaaagatactcgatataatttcaattattttaaatttgttgagacttgttttgtggcctaacatatggtctattctggagaatgtttcttgtgctgatgaaagaatgtgttttttgcatctgttggatgaaatgttctgtaaatgtctcttt

SEQ ID NO: 593 - DNA, 321 bp, Homo sapiens
aatgatgccagatgtcctgtatcttgcacggttgttccacatgacagaactatctggctggcaattctactagactttgctagtctgtttatgctttcctactctccaaagaatgagactacatacactaaaaaaccaaaaagcctaaaaaaagagatgatattttaatttcaaaagcttaataatttgctgaacagaagacttttgagagtcagcagaaatcttccactttgcatggttctcttgatgtgaaatcatctatatagccccagaattggaaaagaaaaaaaataaaaaaatggaaggaaactggattcgaca

SEQ ID NO: 594 - DNA, 333 bp, Homo sapiens
ggcggagggaagctcatcagtggggccacgagctgagtgcgtcctgtcactccactcccatgtcccttgggaaggtctgagactagggccagaggcggccctaacagggctctccctgagcttcggggaggtgagttcccagagaacggggctccgcgcgaggtcagactgggcaggagatgccgtggaccccgcccttcggggaggggcccggcggatgcctcctttgccggagcttggaacagactcacggccagcgaagtgagttcaatggctgaggtgaggtaccccgcaggggacctcataacccaattcagactactctcctccgcc

SEQ ID NO: 595 - DNA, 509 bp, Homo sapiens
agggtttgctggcgtctcggttaatagcagtaacggcagccgcttgtgttcttgattctttgccaagcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatg

SEQ ID NO: 596 - DNA, 3054 bp, Homo sapiens
atcacatgaccgactttagttacttaatcaccagctgctccagaggtcaaaatgatacagcatggcccaaggtccccaccataaatcacattattagcacaaactatctggcctggtatggcccaaggcctgaggtatacaaagacacccctacttgggaggatattccaaggacttagaggttatctcccaggagcccattaaggccagttttttctttgagatgtgctgggtttggacacttcaagcctgctgagttaacccttatagcacagtccccaaatgctgagggaccaactgggcctacaataagtttgtatctttaagggttaaggtgttttacccatacctccttgccttatatctcatgataatatgaggcttttggaaggcagtgacttattgtggcttggggcatgggtttttggagtcaggctgacctactggctgtatggcttgagactttgtctcttcatctgtaaaatggggaagttaaaacttcatggtgtgtatgtgtgtatgtgtgtgtttagacagaatctcgctctgtcactcaggctagagtacagtggcgtgatcatagctcactgcagcctcggtctcctagggtcaggtgatcctcccatcttagcctcctgagtagctgggcatgtgccaccacacctggctactttttaaatttttttttttctgtagagacgaggtctttctatgctgttcaggctgaacttcatgggtttattggggatggctaatggatgacattggcggtggtccttgataccagataagccctcagtgtgaagcagctcttatttttccttgtcttgagattgctctggaatggaaattaggcttttttgaaggtgtgaccctttttgttcatttcttcagcagttactttttattttttaaatgtttgacacacagtctctgataaatgatcattcaccaatcaccgattactctccttgctctgttaagtgtgacactgtccctttgagaatctggcgacagctatgtatcccatcaccacacaccccaaaaaaaaaatttatgtctggttccaggagttaccttttatgagaagtccatctgtgaagaccctggatgttcagagaacttcctgggaaaacactgaaagaaaataaagaggccgggcccggtggctcatgcttgtaatcccagcactttgggaggctgaggtgggcagataagctgaggtcaggagttccagaccagcctggccaacgtggcgaaaccccatctactaaaaatacaaaaattagctgggcgtcgtggcgcatgcctgtagttgcagctacttgggaggctgaggcaggagaattgcttgaacccaggaggcagaggttgcagtgaaccaagatcatgctagtacactccagcctgggcaacagagtgagactccatctcaaaaataaaataaataaaacaaaataaaataaatacaatttctgtttctagcccctaagtggtagcactgggtcttgttccctgaaaaaaactaggctcagaatccactctcatttcatctcccctgatttgatctgaaaagattttgtttagagtactacatgaatatattataaaacatgggacaatcagaattgatagtaagaaggcaagtggctctatttgtacttcctctcaatagctcctaaaggtaatgctaccattttctgtttgtacatagtcttccagactttaaatttttgaacatataaatattatcatcttaaagacgtatggaaaaaaccattttgaataggttattccaaaatgtaatttaacagattgctctggaggattgtttgtttgtttgttttggagacagagtcccgcttggttgctcaggctgcagtgcagtggcacaaacacagctcactgcaacctctaactcctgcaaacacagctcactgcaacctctaactcctgcaaacacagctcactgcaacctctaactcctgcaaacacagctcactgcaacctctaactcctgcaaacacagctcactgcaacctctaactcctgggctcaagcagtcctttcacctcagcctcctgagtagctggaccatgacacctacctaactttttattttttgtaaagaggggaatcactatgttgcccaggctggtctcaaactcctgggctcaagcaatccttcctcagcctctcaaagagttgggtttacaggcgtgagccaccgcacctggctcctggagcatttctgatgtgaacatgtgctgatctaacaccactccttttaccagctgcctgttctagagcaaaccatcttttttgagcattccactttggctaggcccttaggctgttagcagttttcatcgctactggcaaagctgcagtggacgttctcctgcacatataacctcttgatgccactgtatgagtgagtctctgcaaaatgagaagtagaattgctggggtgaaaggcatacatactaacttttttgattaattccacccatgtaccctgatttgggcagaattttaatctcactgtgaaatcagagctttgttctagagcctttcttgggggttccatggatcagtgggtcagccgtcacttgtgccctggcccatcctctgtccagcttgggcagcatgcatcattcattctgattccttaatttgccatatgtgaaaacatggtaatctatacattacttgggtgctattattatatataactagctttggagtcagaattagcgtctcatcctggctctaccactttccaactgtgcgactgtggccaagtgactccccttctctgagcctcagttttcctcttctgtaaaatgggggtaaagggataagaactatagggggatctcaggggatggttaagagaaatccatgagataagcaaacacattatctagtttagtaaagctaagcaatgaagacttaacagccccatggtgaaggcttaatacatggtagctataatgattactattaatattgtgaaataaaaggttgtgatgaaccaaccatatcttctca

SEQ ID NO: 597 - DNA, 841 bp, Homo sapiens
cttaccgctatcaacgtattttctggtgttttcacagtgctgcgcttcctaatccccattccatggcaatccacatgccatgatgcccggagtcattaacaaaggagacacacaggggctcctcacgttggctttccagggttttgatgaaaatctgtttcctcgtctcatacaatgtggctgtacaggaagcatggtgatggcatctgcatggcgcctgtggaggccccagggagcttttactcatgatggaaggcacagagggagtaggcacatcacatggtccgaggaggagcaagagaaaatgggagtggggctctttgtcctgggaagagtttgctgcatcttccagtttcagtaatcaaagaagcaaagttccctgcagttcttcaaggaaccttgagaattcagaaggtcttggggtggctgcatccatcctgcagacaaatgccaatcagcagaggggccattcccagggacacatgtctggctgacttgggccttggccaggtaagacacacagcatgcatgcctgcatttctgaatgccatagacctgacaagtcataaaatagcaaccaataattttatgttagagtgctcccttcctcacagaaatctcagcatatgtgaagataggttggaatgtgtaaagaaaagctaagaaagcagatttctgataagaacagcgtgtgacttgtacagcagctctgaattacagcccgtaggatggaatgctgacagttccttcttccttacctgtgatggctagaattttatttagcacatcgtttttgagccaatctcaaaatgagaaaacttttgaggaattatgcatagtg

SEQ ID NO: 598 - DNA, 2977 bp, Homo sapiens
tggtacccgaggccgggccggagccgcaggccagccgcgattccttcgggcgatgctgggggctttccggtcggggccgcagccgcttccggagccgcgggcgaggtgcaagcggtcttctctgtcttctttatggccagtaaaattctccagaagagatttatggcagcctcactcccagtagtttctgcatttagtgagataagccacagcaattgtctgctattttaaaagcactgtgatgcttaaatattccagctgctacatcggacaggtgtctgatgatcctgagaacagtcatcaaaaagtagaacttgagcctggaatacattctctggcatagccatagtcaatcaccagtataattaatgtaaatggacactggatagcttttttgtgaattctgatgcagcacaaagagactttaattgtttccaaaaagaaaatgtctgagattaaaatctagagttttatgacttagaggaaattttatagctttactccaaaaagggtaaggcacaaaatattctgtgccaaaggatgcatatttggtatttttcctatgaatcccttagtgtaagtggcatgatgaaattttcttggtttcaacacagatgatgtgttgaggtagtgttgaggctgagaggtgggtgggatgggtcttggagaaggaaaagatttgttttgcaaggtttgtggagagctgatgcggtagtgaggctaagacgaggggtatttacttgctacttacattgagtccactaacatctgcagcactttgcttgcattatccacgcaattatcacgggaaacctataaaataagtattcctctcctcattttacaaatagggaagcagataagatttagaaaatttcccaaactcacacaattattaaatgacagaactaggactcaaacccaggttttattaattttagagacatgtttttaaccacttggacactgccaaccatggaattgttggtatgaaaaaaacgtactcttgagttatattatccatggtcttaatatcagagaagtgcagttgagtcgctattaaagaatatggtaaaattataaaatggatactatacaaaggtataaaaatattataaatacttatgtttggggtaaaaggatcaaagtagccatgctcagtggaagggtaaggaactcttagcagagattgattaattgggagataattgattaattgggagttgattgattaattgggatttattaatttgggagtaggtaggaagataggaagttgtataaaataagggagagataacttagtacctggaaaaaaagaaatggaaataggtagaagctaagagttcaattaaaaaaaaggaataaaagatattggaagggaacgatgaatgtagcatggaagatccaagatgatgggagttcaggggctaattacagctatggggaaaaagtaatgtataagctggaagccagagataagagccatgtaaatgaagaagttgggccccaataggaaagaattataaggactagaaggagcaggagccatgtggaaaaatatcatgtagtacttttaagcttgatctgtcatctgtagcaaaaccagcatgcttgagtactgaattgacctgactgaactatgttgaaatgtactgtggttttatatccatatgcacttggtctgtggagttgtgggaaaagcatcagtgagtaggaagcccaaggatttgggtcaagtattaaatatgctatttactgtctagctatgtgaccttatataagtcacttgtggtctctgagccttcatgtattcatccataagatgagttgttgtttatattaaatgggatgtggtatgttaaagagctgaatgcatagtgatacagaattactttctgtaatactattttttaaatattttaaatgaaaaattaatgaacttataaattaaaagattcaaaagggataaaaaggtatacaatgaaaagcaattctccttcccaccagtaactctgtcctactccttaggacattcaccataaacagatatcctgaattcttctagaaatattatatataaaatcttatatttcttatgtttcttttttactattttaaaggggataaactaaactttgctttttttcatataataatatattctggagatcattttctaaaagcacatgtaaacatacctcattattataaaggtttgaaaatatcaatttatttgacctgtcccctctcgatagataattagattgtatccatccctttggttattaccaacagacactaatcacttatcatgtacatatagcctgttttttagcattgttagacaaagtaggcatattcctttccatccaagaactcataacctagtaattgtagttggctgatagctcattgcccatacacaaggatctaacacaacctcttgaataaacatcccccttattcagaaatgccttttcctatttccatattgcaactttgcttacaaatttccaatctgtctttctgtttacagaagatatacaaaattccttttgtatgatctctttatatctcttgattttcttttgtgtttgctaccaaagggcctgcacatagtgagaagattgtgcatgatctgtgagctctaccacacctggaattagggatcaccaatatgagaaaaaaaattggaggtacaaataacattatcatatgtaattggcatataaattacagatgtatctatgactaaaaaccctgtggatataaaccaaatgcagataaatataataaaatatataaaaatataatcaaataatgatagtgctattcaaatacttcaaatttgcacagtgatttatttcttaaaatatgttaacacatgtgagccaatacactgaggtcactggataaataaacagattcttgcaagtgctttggaaatgaaacttttttttatcattttaatttt

SEQ ID NO: 599 - DNA, 693 bp, Homo sapiens
aaattatacagccatgtttatgaagtctacatttcccttgtcttggatatatatatatatggagatatatatacaattcaagcagttttaattaagggtaatcattgggtttttctgaaaccggaaaagtcacgagtctctctcttttttcactttcacatctccagcaaggatggttgcaatttccccttgcataaaggcccaggggacattggagcccacaagagggcatttttccccactgggacaatagacctctccactagctccctgctgtttgatgctttgtctggagcaagggaagcagaacttgtgcgaagggacggacgggcactgcacaaaatgggtgtcctccagccgctcgtggcagagggtgcagcacagcggggcactggttgccagagaggagtccgggaggctggcagggtgcactggctccagtcctcctgtgttgcctgctccctggccccccacctctctggggcccagccttctttggttcatagaggacggagagggcggactgttgctattcctcctggtagtggagtgaacctggttggcatcttttgaggcatgactgccccctgcattgtctgctactaagatcagggctgccatgggggactgggcatgcggggcaggtcacacaggtagcacgactgccgccgggacgcggccgccaccgccacc

SEQ ID NO: 600 - DNA, 262 bp, Homo sapiens
ttgatcccacccccatggcgcccagcaaggttttgagcaccttttggattaatgccagaagaaatccttcaaaagtcaaagctccattccactctctggcttctgtggaggaagggctgaactgtgcctagttattttgaggtttgggacaaaccaaagaattgagcatagtggtgaatcgttttgaaatgagagacctagccaaggatatgttcacttagtaagaggtcacatcttctgcaaaataaaaaaatcaatcaaa

SEQ ID NO: 601 - DNA, 425 bp, Homo sapiens
attttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggcaagggggcgcccgggccatcccgaacccgttccccgccttctgcgccatcgccctccgggaccgggactcgccccggttgccctcgccccctgggccggcctcccgtgatgaaaatacgagttctccgatcgcgttggaccggagcgggccacgtccgagctgcttgcagagggaaaccatcggaaataatgaatagccgctccatgcaaattattcagacagtttagcgtcggtagccgcgagaaatatataaagaacacgagtcaaatgacattaa

SEQ ID NO: 602 - DNA, 390 bp, Homo sapiens
cagatatttttgaaaagagcattcagatgtaaaatgctgtattgaccctggagcgtgacattaatagagtgagaaacatgttgttgggcagattcagtaaatatcttagagtttctctcatgtgcaccatctgtggacctgcatcggaatcatctggagtggtcatttcaagtgcagcttcctgggacccagaagcagactatgggggtggggcccaggaccctgcattctgacaaacccctcactcccacccaaggtgattcttaggaacactaaagttgggaaccagtgtggagaaaataatgctaggtgcattctaggatctaaagggtaaaacattacacttgggtaaagaggttttgtgtacttattataaaacaactgtagcct

SEQ ID NO: 603 - DNA, 1282 bp, Homo sapiens
gagggcgtcaccagcgtgtcggcgcctgcggttttcttcgggctgtccccaggcgtcgtgcccgcgtccgtcacgcgcggtggcttgcaggggcgcaccgcgacagccttaaaggaaaacctgttagggacaagggctgctgtgggcagcgagggttatagactcatgtgtgttctgaattctggtgggggtagtgatggacgctgacccagttcacagaattatctgactggcgaagtaaaggtacttgaattgcaggaaaaaaggtcaaggtgaactgaagaaaataagtctttccccaaaggaggtagaagatggggaagatgagatgtcagaagctaaggacaatggcagtagagatgaggttcttgtccctcataagaattgcaggaagaataccactgtcccgggaaagaaaggggaggaaaagtctctggctcctgtgtttgctgagaagttaatatcaccaagcaggaggggagccaagctcaaggaccgtgagagccaccaggagaatgaagacaggaacagtgagttggaccaggatgaggaagataaagaatccttctgtagggggttcccgatgagtggctgtgagttagagacaagctgctgtgtgtgccattctacagcacttggggagaggttctgttaaaaatccatccctctgaaaactgccttggcaattcccggctgattcttcgggatgggcctcattgatggggagtctcagtggatgtttgacttttgctttctacctgaccctagtcagagattttttctttttccttttttttttttttttttttctgagacagagtcttgctctgtcacccaggttggagtgcattggtgtggtcttggctcactgcagcctctgcctcctgagtagctgggactacaggcgcacaccaccacactggctaatttttgtatttttagtagagatggggtttcgccatgttggccaggccatcttgaactcctgacctgaagtgaccttcccaccttggccccccaaagtgctgggattacaggcatgagccaccatgcctagcccagaaattttctctttgaatactatacattgatgagttctgtctttatgcttatgatccacgcaggtaggtcgtctcagatttaattttcagtggtttttttctgtcttgatggagtctgtgtaacatttaaaatattgctaccaaagcagtaattcttactatagttattaaaatgcaagaacaatatatttaaaattatttcataataaagttaaaatgag

SEQ ID NO: 604 - DNA, 634 bp, Homo sapiens
cgggagctgttgggggctccttccctcgcagcagtgaccactccaaggaccacggcctggacatgagcggcagcggtgagctgggagctgctggcctggagtctagatgaatataggcagcagccaaaggccacagtcacgacaaacctacacactctcaccactgtcatctcatattgtcctaaaatttccagccagtgcaaaaaaacatgaaaaagaaaaaatacagccattggaaaagaggaaaagtaattgttattagctgatgatgtgaatgtcttcctgaaaaccttaagagaaccaactggaaaacaaccagaaatgagagcatggagttaggcaaccgccgatctgctttctgtcacttgggcgagtttttcccgtcctgggatttcatatctctggaatcctgcagtacgtagccctctgtctggcttcctcgctccgtgtaatgttcttgagattcatccatgcagctgtgtatacctgcagtgattgtttctcttgttgaattgctgagaagggttccatcgtatgccttttccagtttatttgttcatctgttgttagacatttgagttatttccagcttgggactcttatgaacaaaactgctataaacatgcatattcaa

SEQ ID NO: 605 - DNA, 4769 bp, Homo sapiens
agctttcttcccgccaggccccctccacccgatcgccgcgcgctctccgaaccaaaaggcgacctcacgaaatgcccctttgagctcaaaggctagttacccccaggggcccttccactctcggggacaggcgaaacctctttgtctctgcctcggcctgcggcccccagcccagcctccgcgctttccctccgccagtccttgtcaatcaaacctggtgccaaacgcggcagctgaagttttcagggacacatttgcttctccccttgaagaaccagttacaaagcgtgatgtcctctctggggtcccatcagaacaaagaaacaggtctaaagaccctcattccagagagcatcctgccccatatccagaatgaaatccatgctcagagatgccaagaagaatctagacagacaggcctttctaggctgtacaagaagcatgatgccagcatctgcttctggtgacaacctcaagaagtttacaattggccgcgtgcggtggctcatgcctgtaatgccagcacttcgggaggcggagacagatggatcatttgaggtcaggagttcgagaccaggctggccaacatggtgaaaccccatctctactaaaaatacaaaaattagctgggcatggtggcatgtgtctggaatccctgctactcaggaggctgaggcaagaggatcacttggaacttgggaggcagaggttgctgtgagctgagatcacaccactgtactccagcctgggcaacagagtgatactctatctcaaaaaaaaaagaaagaaagaaagaaaagaaaaagaagcttacaatcatggtggaaggcgaagaggaggagcaggcatatcacatggccaaaaagggagcaagagaaaggtgagaaagacactagactctttttaaaaccagctctcacatgagctaatggaataagaactcactcattaccacaaggacagaacccagccattcatgagggacctgccaccatgacccaaaaacctcctacttgacccaacctccaacactggggataacatttcaacatgagatttgaagaggacaaatactcaaactatatcacttgttgtccatttttaatctttctctaacataccctaacttcttcttgaaaatgcttaattttctctgttttgagatgtaaatttgctatcctgtttttcttaaaacttggtaagatcttcagccatgaaggacagacaaactgtaacctttccatttacaaagctgcatttgaattcaactgtccttttaaactaaggagttttactggtctcgtggctaaaattttaaagatgtaggccaggtgcagtggctcatgcctgtaatcctatcacttttggagaccaaggcggggatggatcacctgaggtcaggagttcaagaccagcctggccaacatgatgaaactccatctctactaaaaatacaaaaattagtcaggcatggtggcacacacctgtaatcccagctactcgggaggctgaggcaagagaatggcttgaacccgggcgacggaagttgcagtgaggcgagattgcaccattgcactccagcctgggcaataagagtgaaactctgtctcaaaaaaagaaaaaatgatataaagtatttatttgtgtttatattttatggatacgtgtctatgtttatagattgcctgtatggtaccaacttgacataaataaattagtactcataaattaagtaaataagcccaaacgcttttcaagttcacagggcattagtaatctgtggtaaatgaagatagtttaaaatttggggtaaaataaaatagaaacattttctgaatttaatttagatatttttctgggtctatttgttagacaggtttacactatctctgctatttttttaaggacctaaaactgaatggacatagaaaattgaggaaagaaataaaaccgtaacaattataagaggttataaaaggttcatggaacctttttatgttttttcttgtgcagtcaaaaccaattgcaggctggatgcagtagctcacacttgtaatcccagcactttgggaggctgagatgggcagatcacttgagctcaggagtttgagaccatcctgggcaacatagtgaaactctctcactaccaaagtacaaaaggaattagctgggcatgatggtacacacttgtagtcccagctacttgggggactgagatgggaaaattgcttgagcccgggagtcaaaggttgcagtaagccaagattgcaccactacactccagcctgggtgacaaagtgagaccctgtctcaaaaaaaaacaaaaaaaggaaaagaaaacaattgcaattggattgatctgtttataaggctttattaaaattagctttagcatttataatacactggcacaaagttagaatttggatttctcttttgaacaagatttttgtatacattaataagaaatagtaaaagatttttgtttaccttttgagtaaactgcaaaaaatattagtaataagaggagagaatttccctaatgctgtttttattatgtcttttgattgtttggaaaactgaatctcccctctgtcaaagagtaaaatttttgctttttgaaatttttgaattatcagtttggctaaatgaataactattatcttacagtgacctgtaatcttattttgatcaagtgttttaaacctttgatatttgacaaacttcccaaaatcaaatgtaaaattctaacttaaatgttttcgacctcaagctaacttttgggcattaaagcccttggaagtccaaatagggcccctggaagtccaaaagaaacatattaggctaatttggtatattaaaatcatacaggaagctgatcaaataaaaaatgttgtttaattttctttgagttgtatttgtataaatctgttattaatatgcatcccaaaattgtatcatattgctaaaatgttgatagatcttgttatatgttattggtaataattgttatcctgttaaattattgtataccacagaaataatgaaatttctttgtcaattgcatcagtaatcatggctcttctaagtcttttgtcattcacagatgattattgttttacttggattcttttcaaaagtggtttgtaattggctacagcctaaaatctgcttgttcaaaaaaaaaaaaaaaaaatccatggaaagggccctgacagcacacacacttaaacacagttttctgataactttggaattcacaccgttggactagttaaaaacttctaaaataattttttaaaatctaataaattaatgaagattgctaatccaacatcaagcagaataagttaattacatggggctgaactgataaaatgccaaaataatattttcataacctttttttggtttgagacattgctgatactttttatgttttgttttccagagtcaagaaaattgtttttttcttttgagctgtacatagcttacagtaattagataaattacacttttgtgagaacaattgaaacactaacctttctctctacctgatgtctccagaatttggaaagtatttgtgagtattcttcacttttggcaatatagttatttgtacaaattcgataggaatctgttttcttttgtaacagaacacagttggatacactgattattttgccaaggctttcattggaatggcataattttttaatgaccagactgctttgaggatttgaagttgactttatagagcctataaaaagcctgttggaaaaattagcctgataccttgtctacacagtttccttacaaggttcctgaccttgcggtagtaaagaatgtcactctctggcaggcccaggagcctcaggatattttgggaaccttgacaagagaggagtgtatccaatttatacaggaattacaagtgcagtctgattgtgaatccttgtcttggcttcttagccttgagagtttttaaaagttgaatgtgaaattccttatgaaaaagttccaacaaagccaaactttaaaagagcctatatgtggtcaatcactatttttgctgtactttatgcaaataatcaggccaaatataataaaactaaaacttattttgcaaataaattggtcctgttatgatttgcctttaatagaaaagggggactggagagagaagaattatgtttcagaagaaaatgatagcatacctgttgttagattctagctttgtccattgtttttaagttgtaattatttgcctacatttgaactaaatcttgaattctttcctggctacaagtctccaagctaacatttaaatttttttctcctatgtttctgacttggaataagtagaagttaaaactatgcttttcttgaagccctgcagactggagcaagacaacttgaataaactatgggaaaaatcactacagcaacttatatataaacagcttttatgctttgttgatgtatggaatactcagaaagttcactgcaacacctgatttaaactacaaccaggagactctgtcagattaacactacaatctgaagaactacagagactctcaaaaaactagtgtatagtctacagtagatattaacctttgtttttcttctgttttcatagaaacaccttttattaaaaatctgtttgccgcttcatatatagagtcctagtccatctgtaatgccaccccctggaatgagacatagctgtttaactgaactgatctattctcgggactaagagactg

SEQ ID NO: 606 - DNA, 584 bp, Homo sapiens
tattattgtattttacagatcattcattcaggacatgctgcatctggggttggcatcatttcccttttgaatgacagaatgtgcataaaagtctcttgcccacgctgaactcacacgtgcccggcaggaaggagctctcacgaagtgccagctggatgtgagcttgctctggcagcagcagtgctgtccttgtttctgagctgccacctattcactggagttagaaaccttgtgggaaaatggtgcctatttttgacaactggatgtcttcgtggccgaggtccctatgaccttcctctcaaaagaatacgtgtagttttagttctcagacatctgggtcttgctctgttgcccaggctagagtgcagtaatgtgatcatggctcactgaagcctcagcctccgcctcctgggctcaagtgagcctcctacctcagcctcccgagtaactgggaccacagcatgttcttttaaacttcctaaagaagcccatgataactgggaacacgggcccttcactgaggcaggagaatcacatgagccacacatgatatccactggaggagacagaaagtctgggagtgt

SEQ ID NO: 607 - DNA, 340 bp, Homo sapiens
aatttcttaaaatcttgttttctctcgttgtcttcggaagaagcccgacatttcttataggaaatggaactcttcataaggtcgccccgacccctcctccctgacctgggaagacgcgcgcagtccccgaccagaggacctcagacacaggtgaaaaccatccatttcttggagaagtgccacggtggggttgcaagtcccaggatcaagttttcgatgtgtctctttttcccgtaaagtggctgaaatctgaagctgaatctgcaagtgtcatggagtcattgaatctcacagtctcaactgataaaagttattaaaggtcgtctggttcagccttcta

SEQ ID NO: 608 - DNA, 720 bp, Homo sapiens
gcacagacagactcgacagaaaacatgcggaggcggcacagtgcagttgccaccaaaactgagctttagacaaacctaaactacagagtggtgcttggagagtcagaaaacttgggcagccaccaaggggaagccagggtccctggcgcagaagaggccagagaggccacatcttctgcacacctgaggcccgatggccctgcagaagggaggcaggttgggaagtgctagcgaagggccagcactgaccctggctctggggtgatccaaggacgcagctcagaactgcttagaagaggagccggagctgcctgaggaaatggaatggcagccacagaaacgatggaaaagcgtccttcgtataaattctggggcagatctgcacctgcaggacctccccagttgctatagatatttggaatagatcaagtgaaaaccgaacaagcagaacagatgcctcattttgcttacaaaactgctttgagaattgggacgtggctacaccccacgaagtacatccctctgaatttcacccacatcagaacccagagcccaggagatactcacatttggacggtttccaaaggcagcatagaagggctgcttagacggggcaaacagattcttgatatcatttagacactcaattttgaacttctctggtttcttttctatcacttctctaagaaaaaaatacaaatacaatcaccaatctcaaaa

SEQ ID NO: 609 - DNA, 509 bp, Homo sapiens
tctgtcaccagccaggaaggacatgaacctttctctccctcagggccatccattctagagggcagagagttggcctcatttctgagataacttaggggacagaagttcactaccctgagcccattgtgaggccatcctcacagccgtgactccttatatttctactgctgggttgggaccttggcttgtcaagactaagtagtcagcccccaccaccccaaaaacaaaaccaagcaaagaccacatacagattccatttataggaaatgtcccaaataggcaaatctataaagacagaaagtagatgagtggttgcctagggctgaggagactgaggatgactgctaaggggcataggggtttttttggggggaggtgtcaaaaatgttccaaaattgtaatagttgcacaattctgtaaatttactaaaaaacactgtataccttaaatgggtaaactgtatagttaagtgaactgtatctcaataaaacaaaaacaaaacccaaaaa

SEQ ID NO: 610 - DNA, 641 bp, Homo sapiens
aaatctgagacagccttggtctgagggagcaaagacagagaattcacgtgctgcccaggcatagccacatagcaggtggacatccctggacacttttctgacaaagcacgcaatgtggggacaacacagaaatccaagaaaggcaagaccaatttcaaggcactaaataagtggactgagacaagaagtacacagatacttcccagaacaaaaccctcattggattttcctggaagtacggagagttacatccagagaactctgaacattttggaaggaccccaatcctgcaaacaatgaatggcaataaatcctgggactggaaaggggcttctcaaccccaaggcaaccataaagtcctatacaaagaaagatacagcagtgtgaaagaggcctggatgaaaaaacaaagacagagccagtgagccagagccagagccagaggacaagagagaaaggcagagaatggaaaacacagacagagaaggcagatgcgtagagagacagagattcaatgagaaaataaggaaggaagaaagaaagaaaacaaaaacgttctcagcactacaacttctgccttgttctgttccagaacagtatgagctcagtactttttcagactctcaattttctacaactaa

SEQ ID NO: 611 - DNA, 410 bp, Homo sapiens
aggcccagacccacagagacaacgatgatggccacagctaagatgatccagaaattattcctccaccagctcattgcagtggaatcctgagaagaatggagagagaagaatgagcttcttgcatgactgcctgaaatccgcctcctgtcagatcagcaggggcattggattatgataggagtgagaacaccattgtggactgcgcatgccagggatctaggttccgcgctccttatgagaatctgatgcctgatgatctgtcactgtctcccatcacccccagatgggactgtctagttgaagaaaaacaagttcagggctcccactgatgctacgttacggtgagttgtataattatttcattataattacaatgtaatgataatagaaataaagggcacaataaatat

SEQ ID NO: 612 - DNA, 551 bp, Homo sapiens
cagtgccattttgtgggaacttagatccaatatatccctgttcacgggtcccacaatgcttagaatgatgcactgccctgaggagtttgacagacgtggcagaggagagaggcaggagggaggaggagaagagacacttaacaagtgtctgtgaggtggcgtttacatttagaattccctttcctttcaaaggaatctccaggatagccaaagagtccagcttaaaggtagccagccagaaaaagtgcccaaaccacgcagtgagatcacacctttgaagaccccaccttggcatagactctacggctttcacgaatgatgctgagctctcagcagcaccagaacctcaggctctgacacccacaaagctgcaggtctccagggctgcttgggccaaaaggacattggcactggatttagagcccaccagataatttgggatgatcttcttcatatcaagatccttcacatctgcaaagatcctttttccatataaggctccaaatcaccaaacttctttgcctctctgggaaaactaaatgacccaccac

SEQ ID NO: 613 - DNA, 572 bp, Homo sapiens
aggcaagccagtcccatccttcccagcaactgggactttccgggcagggctccccagcgcgggttcagctaattaaggaagcaattagcctcccctgaggctattcatgcttcctcacccacagttctcaggttctgtgagaccagagcctcagtctcccgtgagcagagggtgtgtgtgtggctgccactattctgcagacacgctggctccaccccagagagttgcagggccaggaaatctgcatttaaacagaccctggctctcacacttcggaaactgcccgaagcacctctcaaatatgggacaggtgcttaggccgaaaatcaggaatctcttgaatgaatgcatgaaggtggagccctttcccttaatgcgcaggtgaaaagggcacctcggtggattctactaaatttaatagaagacccaagacggggtgggggagacgtgctttgtgctcacctggctggttcatgggcaggtggcctggaggacccagccctggcagctgtggggtagctccagcctgggccggacagcttctttcatcgcaggcaccactgcggacattg

SEQ ID NO: 614 - DNA, 3398 bp, Homo sapiens
atctgagcattgataatgttctatctaaatttgtacagtgtgatttttttttttagaataaatattttataaaagggtttattgtcccttgtttatgttaaaatgcttgtttccatgaggggtttcttccctctcaatgtccctagccccttgggaaccagaggccccagagacagtgtgggctcctcagcgtagcctcttggtgacagcgtgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagtgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcaagacagggtctcgctaggttgcccaggctgctctcaaactcctggcctcaagtgaacctcctgccttgccctctcaacgtgctgggagccactgtgcccaatcaacacacagtaaaggggaagctcatttccagtatttgtgcaaagaaaaagacatcctttaagaagctatcgtagcaaaccaaaaaatacaaaattgtgacccagaggatgtacagtgacttctggctttctagggtgctgtggcttttgagttctgatgatgacaaaaatattttggcagagactccatctcaaaaaaaaacaacaaaaaaaaaacgtgaacgtcagcatcctctggggctcccaggacgccgtgacttcctggccgcggtgcttaccagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcatcgaacgtctccaccgcttgccagaaccaccgcacgatgttgctgtcggccacacagtgcttcagccgcgtgttcgacttccagtcgttcaagtctattttatccaggccgcctatgatcagctgaggaggtgcagaaaggtgaattacttccaaaatgcataaacccacgtcaggatgcgcctcctaggtacccgacacacaacagtgaaaagtcgattcccaagcaaagcagcagctgtgtactaggcagatgttgagacaggaagaaagctacaaacaggaggcctgtggcacatgcttccgtccgcctcctccaaacgggtctccaaccccaaggaccgcggtgcacagctgttgatgggatgttattttataaccaaagcggggtttttgctctgcatcggtgaggagtatcaaagaaccaaccggtgacactgaacagagctaaccatgaataacggcacgtcccagggtctctccaggacactcaaggacatgtggagtttcaagtctgaagagaggagaattcagcaagagttaggtggggctggggccgatagggcatgtttccgcaattggcttaaaaagttcaacccctgctgggtgcagtggctcacgcctgtagtcccagcactttgtgggggccgaagttgggcagatcacttgagcccaggagttcaaggccagcctgggcaacatggcaaaaccccgtctctacaacaaatacaaaaattagccaggcatgatgacgtgcacctgtagcctcagctactcgggaggcggaggtgggaggatggcttcagcctgggaggtcgaggctgcagtgagccatgatcgcaccactgcactccagcctgagcaacagagcgagaccgtgtctc

SEQ ID NO: 615 - DNA, 1157 bp, Homo sapiens
aaacaggctccaaaagcttgttacttgcttgtagtcaaacagaaggcagagctgcgaatcaaatccaggtttgtctcgacatgccactagctcatacttcccttggatcagccactaaatggctttcactccagtgagcagcgaccagcaccagaattatggaacatttatcaacagcctaaaataaagacaacacgaggagaatttggttgcttatatagattcaaggtacaatcctgctggattctggaagaaatatcacagtgtgcatgcacagaagtacgaccatgtgaagaggtagcaagagagcagcaatctacaagccaaggaaagaggccacagaggaaaccaaccctgccagcatcttgatcttggacttccagcttccagaactaaccagggaccccactcccatgccgacagtatgggctgctgtcttcaggaccattgcaaggctgcaggaagacttagaggcatcatcctgccttggcttctggttgccaaggtgttctgcctgataccaactttgtcagcagtcaccaactagccatgcttttcccttgaaggcacatgtagattgcctaaccatccacaccaggcaaacaattcttcaaatgtcatgccctttgcacttctgttcagatccagccttagagaagcttgtgaagcaatgactgttttaattggtctcctgggtacccaggcctaatcctttaccaagtcactagttatcccatgttccttatctgtctgtctatccatctatccttccatcctcatccaatacttacagaatgcctatggctgcaaatacaaggatgactgcttggttcctgctgtccataaactcacagcctgggataagtgtccttcacggttcggttcacatttcacaagccccatgaagtctatctggattttcggtaatgtttcctgtctctgaaatcttatgacatttatgtctgtatcagccatttgatgcttgattatctatttttcagatggatgtcttgccttttcctctacacactacaggaagagtggccacccctgccaagggcctagtatagtaccctatacatgtagctgatcagttgattgttactgatcatatgtatcctgcatcatgttataaaaaattaacacagtgcttggca

SEQ ID NO: 616 - DNA, 537 bp, Homo sapiens
caggctggagtgcaatggcatgatctcagctcactgcaacctccgcctcctgggctcaagtgattctcctgcctcagcctccctagtagctgagattacagcaatgaatgaaggttcctgttgctccacattctcaccagcacttggtttcatcagtgttctgacttcagccattctaacaggtttgaactgcatggactgcttatatgtgaattttcttccacttctgccacccctggaacagcaagaccaacccatccttttcctcctcttcttcagcatactcaaggtgaagacaacaaaggatgaagatctttatgatgatctacttccatttaataaatagtactatattgtacattccactgtaaatgagcaaacattacactggcagcagggaccagcatcctttatcaagaggcagttgtagctcaagagttgcatcttggtagcatcaatacagaatttaaggattacagaagatatctcaaaagttctctatacttggaagaaaaataaagaacgatttgcacttca

SEQ ID NO: 617 - DNA, 573 bp, Homo sapiens
gtttttctttactagcaattagggaaacatagagtggctgctttctctactaacagcctcataatggagccatctaaatctcttactgattcctctaacctccagggagccacacctttacccagtcctcctagatcctgggggaatcagaggaccttgtgtaagcactatgtgaggaaacaagaaaacctagggccacaacaactggattctcttttctgatttttgctgcagcttctgctttgtaatcatacggacagttgtgcttgtcagagttaacggtgaagtccacaaaacaaatttccacatcggcagtcaaacctgtaagaccaactttctttctgcacatgaaacatctgtttttctttggtttgggcaattcaggagctttttctttactctgagaagtactgggctgaaaaactgatgggctgggctgagtgacaactggctctcacacctctgttttcggggtagttattttgtcctctgttgaaatgctcatttctgtcatttgctgagttacaggcaaggcagccgcaggcacatttcttgatttttcagatgtgctgc

SEQ ID NO: 618 - DNA, 5984 bp, Homo sapiens
ggtgcagaggatttgaacagaatgagagtcctcctctgtgcagggagaaaggcttcagtgggtctccccctccctgctagggatcctccttgccagccctgggctgggcgctggcaggcccgttcccaggtctcccgccgagggcaggagaggagccaggcctcaggagagaagtgcttactgagtaatttaccaagagcgataggcttcccactgagccagacgggatccccaggaggggagtcagaggcgggcctggcatgcatgcacagagagagtgtgcccacttggggagtgtgaagggccttgctgtgggacccgagaggatgagcagagtcaagtggcaggtgggacacacagtctgcagtcacttcttaaaaggccctgggtggtgtgtccttcaatgatgaccattgtccacaatagtgagttccagagggtcgattgggacagttggatagccaaggaccagagtcaggaggcaaggctgatgagcaagaggctgttgccattggccaggcgaggcgtgagggaggctgatggagcgcagcagcagagggatggagaggcaggaatggcatctcctcacaggccaggctcctctgccggattgggtagggacgggaagatgatggcccccaaccctgggccaaggaacaatagcacccatccgggggcgggggacctgctggagtacttctcctggaccactgctcagtgggcaatagagggaacaatggtgtttctgaccaggacgggggaaggcaggggaatggaggaagatactgacagggtacagaggaggtagaatggagcgagggccatctccaccgggctaggaaatggggctttggtgggccacactccattgtgctggagcactctggcatctccattggcagtggggaggggcttgtgacctatcagcatcttcaccctttctgagtttccgccgggctgggctctccagccaggagtcacaggtaccgggtggttgttcatgctgaggccttttgcttggcaaaaagttaatccatttgtgttcatttttaacctaagcaagggttggagcttgttggattcagcatctgtggaacacagtctgtagcccatgggaagacgtggacattctttcccaagttcttgaaggacggaaaggaccatgaacttgtgaggtgaccggaggattggttttgggtgtcagttttgtgtctgtcccagtgctgccacttttgctttgaaatggacggggagagctgaaggccagcatgggtttctgcacctgtttcctacagctctgctggggactgtggctcaggtggcagctgtggacacggatcctgtcagcctttgggtggccagagctccaaggccaggtgtctcttagctgcaagcagccttcactgttaatcaacaggctacacaaatctcacctctaaagaggtgaaatgtgaaaatatatgggaagcgctgccttagccctgtgtccacaaatcctttctgtaaagggccagatagcatttcaggctttatggaccatgtggtctctgccacaactgctcagctctgccactgtagcacaaaagcagccagagacagtgcgtaaatagatagcatggctgtgttctgatgaagcttcacttacaaatacacagggctgtagtttgccaacccctgcaaagtagggagtattttgccaaacttggctgtatttcaccaaccccttagactatagagatgacttaccctttggcttaatcatgactggaaacttccttcccatccactgcctggatccatccacctccccacaaaggcttcctgagcatctcctccgtgtgagcactggctcaatgcacaggacgatgtagttcctgcccatatggaacttaggttttgagtgacacgtgggacattggaagaggagagcaggtggctaaagagcatcatacagaacagggctcagggaagtcccaggtgatagaatctcaaagagaagggctgagggtgaatcaggaaagccctgaaggcaggcagctccggagtcgggtttagacgaggaggctgcagttctccaggaagggaagcaggaccagataacggatgagattgtgtcaaacaatgaggaggcctgcatagtcacacaggcgcatgaggtctgctcgtaaaggaccaggagggccaggctcaggggtgtggactggattctctgggctgtagggagccactggacagctgtgctcaggagggtcatgtgatcacaaatgcttattagaaatgtcactggctatggaggaccatgtctgtggttgtaagttacgcctttccgtttagtctggacttcctggtcaaggtacttttggtattagagtggggaagagaggcccagagagttggacaggttttctgaccattggcttatagtcagtgagcaccccacctttattttgacatgacagagctttacagaatcttccttcttcaggcgttttctttcctgctatcctaaagattcacgtacgagggcaggataaatgaaacattctgtctccaatctaagttcggcttggggcctcagaatatgaaggtaaaggggcggggacggactgactgccccttgcttcagaatcaagtcacatggcgggaacgctctatggagcagattgcttcctttgtacatgccctaggcccgtgttcagcaggcctcagagaagcagaggtgctggcctctcgtctccagaggctgccagctactaagggaggtggaagcaactacccctgggggtggactgctctgggccgggcccgacgtcaggcgtaggggactgaggtgaatcagacgtggtggctgcattgaggaatgctcagtgtagttggggtgtttgtagcgctttctgctgagcatggtctttcctctcagaggggtttctaggcacgttgaagggagctgccgttcagagcatcggagaggtgccagggacgtgagctgctgccagtctgacgtgaacagaaggtgggaatagctggcgctgccgtgcgttgataggagcacagtgtccgctgcgaaggggcggctagggctggagaaagatggcctgatagaagcgcctccacaggcgctgattcagcgaagccccagcagccccgcggggcaggcgaggatcacatgcagctcggagaagaggaggcacttgcccctctgcctgagctgggaggtggtggccagctgcacacagggctgtcccaggatgctgacgaggcgggaccagccacaggccggcagcgctgcactgtgactccctttcacggggcccagccttgtctctggccttccgggactgagtcaggaggcgagggctacgttgctgccccagcacagtcgggccaggtgtggggaaaggcgggagggaggtgtgctgtgctctgagcagcctggcaggccctggagaggcaggaagccactgcaaacttcagaaactgggtgctgcttcctctcggtgaagttgtgttttgctaatctctgataatcaggtcagggatacagaaggaagagttgcccctgggtggctgctgtctttagacttgtcgggctccctctggtacagaagtgcctctcggattttgctgcctggtcttctctcttatggacatggagtagctctcaggctcttatggtacagctctaagaaggaacacttcttgcattgtctagtgaagtttctgggtttatggaagggaaactgacaaactggagccggcacagatggacactgggtaaagagaatgcagcctgtccctggctgcagtgccaggtgtggcctttcctgtgacagcaagtcacgtgctgtggctccagcttcataggaaggctcttgtctgtcaggcagtggagttacttacagacaagagccttgctcaggccagccctgcccctgcctacaggcacaggtgctttgccatctgtcccgttttcctgcttagggaaccaagatggtcagaaagttgcttgactctaacctaaatatttctgccgcttttgcgagtcagactctttttcttttccttgttcatggaaatggatcaaggagtaggagttttagatagctagggaggtggtgagaagttccgtctccacctgtaatttacaagtcgtgtcttaggtttccagcctctttcctctgttctgggtatctcgtgctctccaccctttagggattttggtgtggtgggtccgtggcaagacactcgatccagacacacgcatttccgaggcacttccatgtcacttaccaagcctccttgtgtgtggatatcacttcactggctccctcaggctgcagccctgacccccaaggtagtgatggcagctggtgcatgaggtttgatttggaagtagccaggcaagccctggttgcaaaaaatacctcttctattccgacagcgggccagaggccgctgccattagacgcatccctctacttacccccgatcacttttcatggtcaggccggccttgcacaagcaggttctgttcactgcgcacccccatttcttagatggggtactgagcactgcttttcccttagctcacttcatgtggcagcttctcagggatgggacctaccatggctgtgggagatgctttgctactacttactacctttccgagggaggagggctcatttttagaaatgttactggggagccaaattgtaggcctccgaccagagggcctcgctctctccatctcccaggaaccaagggtagctctggctctctgaggagctgtctccagcctccaggtggacgtcctttccagcataccagggcttatggaggcaaaatgaaagctggtccacgtgggaactccctactgttgtcctttccttgggcagacaccatatactttttagctcctagcagtgtttatcccgttttccccaaagcatccttggactcaggcctttcatcctggacccatctgtctggcctgttgtgctgagcctttggtctaagtggttggttggtcccagccacttcttcaaaagaaggtttcctgaggtaaccataaattagggcaatcgtacttccaggaacagtgaggctgatgggcctgttcccaagggtactttggcagggggtgctggggaaggggctggcctagggccaggttcatcataccgttagccctgcagccccatgcctgtgtgtcctggtttacccgccgtgtagtggtcctgcaggagtggagcctgtaggacttgcttctcagcggctccaagcagaactctgtctgggaaggtgggaggtgcagccagtctagacctgaagccctcacactaaggactaaggtaggcctgctcagccttagcccttcgtcaggcccaagggtgggggaggcaggaggaggctgagcgtagtcgtggatagaaacctttccctaccgcacggttacacacatggcatgggactcctggctgtagctcactcgggtctactgaagaccaagttggtttttagaaatctatttaaaatatctatcatgtatctatttactgtgtttttctgaatacgcaagtgtaaatagtataatttgcagtgcaaaatccttggcaataactttgtgtattatgtttaaaaacactggaaaccgtgaccaccatggactgcccttcccctctgaggcaattattacatgtaggactctgaactttaaaccttcagcgtgactgaagcagcagcctgcacatgtggatggtcatcagtgcctcgcccagagatacctggccttcatccaaagggaccctgctgccacaagtcctccaggcagcacccgcactgtggctccttcgcactgagtatgttggactctgccatagactgaccctcttgtctggctgctgcagtttgtctgtaatgccctgacatgttgcattctccccatttggataaataaaaacaaacaaatgcttctgtcacacaca

SEQ ID NO: 619 - DNA, 752 bp, Homo sapiens
gaggggtatagtctgcctccccacccacggctggtggaacctgagggcccccggcgccaccagagcttcgtggcttaatgggggaggcgaggagccactgcggacctgctcgggacagtgaagggcgccagtctcagccctcatctgaaacctgctccgtgaccctggactagttcctgctcctctctgggccaaatcctggccctgctcctttctggctgagtaactttggagctgtgccctgaaaccctctgccctgctgaagaatggagaggactcccccaccagcacctccacctaggacacatgggaactgtgggacttggagcaaagttttcaagtctctgtgccttagtttcctcacctgtaagttgggggaatgatagtaactgctcttaagagctgctgtaggaattgagatcttgcatgaaaaaggataaaaccaattgatatggtttagttcttagtccccacccaaatctcatgtccagttatgatcctcagtgtaggaggagggacctcgtgggaggtgattggatcgtgggggcagtttctaatgttttagcaccgtccccctagtgctgcttgtttaaaagtgtgtagcaccccacctgcctctcctgccggccatgtgaagacgtgcttgcttccctttcaccttctgccatgattgtaagtttcctgaggtctccccagaagcagaagcctgtatagcccacagaatcatgagctgattaaacctcttttcttta

SEQ ID NO: 620 - DNA, 1039 bp, Homo sapiens
atcgtggtggctgcgcttgcgaggaccctgaggtagattgggtggtttcaacaggaacgcatccactgtctgagaggtggcaattgaagccggaagaacatctaccaagagcagagaacccaggaagaaaattctgcctctttaatacgttccaatatggacgttttccatatagatacctatctatatagatagatgctctgggatctgacggtcctggacacctgtatggctgtgtgctgtggtctttgcctagcctgcggttcacttttgctctggccaccacctcccctcatgtacaaaccgcgtctctgctctgccagtcttggcccccgtcaggcagcggttcactccctcaccagggaagtctagatagatagatatagatagatatcgatcgatagatatagatatatatatagatagatagataggtagatatatggatagatatagatatttggatagatatgtagacgtctatctataaatatatcgatatatcggggttctcagccatcccaaagaagcttgcacagggccagttgctttatgtcaggaaaagggacacagactgagtgtatgagggttttttttttctatagatgtatagatatttatatcagatgcaaataagtgaaactctcatacaacttttaattttgtgttttttccaaactctattccattcaactttttctgcctttttatttgattataatgagacatcgtactggaggcaggcttgaaatggatatacagagcactttcaacccagaaatttgtctcacgacttggggtccttacttaagttgtagctgttagtaatttcatccatgaattcactttgtgccatagtgtgatgttttgttatgaagttggaattgggaagggaaactaggaagttttgggagaagttaagaaggttgagtaggcaggcgttgttatagatattaaatttcaccctgcttatcaaagtacctggagcgtatggtatccaagctgtaaatggcccaaaggaatcggggttctcagccat

SEQ ID NO: 621 - DNA, 423 bp, Homo sapiens
atttgcaaatcaaacataaagcctgaaaggaaacattacttttcattaaatagacggccagccgaatgaacagagaagaagtccggacagcttttcaatgtgatggattctgtggcaaggattacatcattggggggttttatatttctataattttagattagttattttagttcccttacccccatttttaaatattcctgtcagctaaaacaaggattttcttaggaaatgatgaagccaggtttaatttctacttagtgagaagactgcattaccaccccactgttaaggtgcaggtattgtcagtagggcaaggatgggttttcttttgtaaggaatgcatttgaagggatagattacagactcagggtaatgtgaacctgtttccatgcttgggaatgtcctcccaggtgatggaca

SEQ ID NO: 622 - DNA, 3116 bp, Homo sapiens
agacctgtactccgtactccgtacttcgtagtcgcagcggcgcggtcttcggcagtctagtcatccaccgccatcctgggccccacgtgttgcctgaccattcctgagcccaggtaggggtcctgggggattgggttcagtggcgggcggcgtgggaggctgggccgcagtgagtgggggcaccagtgattcttggagaccaagccttcactacacgtgctacttcctctcaagaggcggttgagcgcgttcggaacattttacccggaggagactcggggattacttgatgagtaacctcgtgcttctctttcagccgagaagtggggcttctgcatgacctgggtggaccccagtaggtgggatgggacgtgtggtcaggagggacctcaccggaaggcatggggtggcgtgtagacctgccgcaagagaggctgtagagtgggccaggcgttgcaaggagctagagctggataatggttcagaggcacaagctgaagctaactgcgtttggagctaactgcatttgttcccttctaggtgggagccgtggctgaggtgacggtctcaaagtggaagagcttactgtcacagcaactcctttgcaagatgccccggtaaatcacgttgcagagaccccaactctgccttcctggaactaggcctgcgttttctctgaaccattatttcatggggaaaatgaaatctacttcatgtgcctggtctacttactccttcagaagtgatttctgagccgtaagatacatgagaaaaaaatgaaggggaaaaggcagtatttatattaactacatgatgataaggatgtttctggtcacagtgaaaagccatgctagaattgtagtgtcatagaataatgtggaagtttagttcgtgttgtctgatctatttaataatttaataaggttatctcttccaagacaccttcccttcttcctcagccagaaaggatctttccctgagagtcattagtagctctgggctcctggaaccaagctcaggtgcctaattgaactctggtctcttcccacagcccccagcagggactggtgcttagtgagagtggactgccagattccttgagtgtgggggatttgggtgaatgagggtagcaagcctccagcgtgcttgggtctgcggtgaccctatgcattccttcagtgcttgctagaacagttttgaaacggtttgaggccttgccctgctccatccagagcaaggttatagaaatttcagacaatgacttcctccctcctggatctagtgtcctgggccttgtatagatccgtgccatctaatgtggtagccacttggcacacatgattaaattaaatttggagttttatttcattttcacactagccacatttcagatgatcagtagccacaggtggccagtggctaccatattggaccgcacagattagagggcatttctgtcgctgtggaagttgttttggacaatgctggtgtgaaaggtgaagggaatcctgagtgtttgctgtgctccaggctcagtacaaattttattttattatacacttaaagcaaaagtcttataaaagttgaggatgaagccaagagtggtggtaagggtaggagttgaaacagtgaagaggaataacagggaagagtcctgccctgagagactcatggaataggatatttacaaggcaaagcaaagagaaccaaagtctcagttctgcagaggagctgagtgccccaggagctagtggagggtgaggtcaatgtgtgctcatcttaaaggaaaaactcatggaagaggaaggtgctaatgttgaacacctattttgcgccagacctcttaattgttttaaatctttgaggtatcatcatgaggtcgtttttaagttcagtacagatgaggggcccaaggtcagaattatgtgtccagggttgcccagccacaaaccagcagatcagggtttgatgccaggcctctctaaccctgcatcctgagtggaatatagaagccggtgggaagtttggatgggaaggagatggatgccttcaagttcttgtcttggtgttaggtgtgttaaaggactggctgggatgagaagagtgttgctggcttgagcatagcacgagcagcacagctcctgtgttcctctgggtggtggggtcacctctcttaaaggtagaggctttcagctgattctgtcttttcaggccaggaatagttgctgaacaccccaggcctgctgaggtccctccttgagtctcatgttcaagcagtcttgtgagtaaagcactggctaccccttttcacttactatcttttcaagcatgttctaccaccttggaaggtaagaggttagtaccttcttccagagcagagggcaggcattcttgctgtgcgttgtgaaagggtagagtcctgcgctcctttcttgtagtagtccaatggctcatgcaggtgcctctgactcccctatgggaactggggcttgggagggtggtggaaaatgctgatgctctggctattgctattgttttgaataatcagtggtcccttgtccctaatcgaggaattttgtattttctaccagtgtccatgaaactgggaggcgaccgtgttagctgccagttcctgacagccacctctcaccagtggcttcactctgtgtccctgacccagcacatggcacaagagtgcctgccatccgtcagtgtttctacagcagcaatcccaagatgctggagctagaggggacctgacctgagagaagataccttcagtggctgccaggctgttccttggaacctgtgcagggatgaggcctgcctgtgttaatacacctagtgaggagtggagctgaatttgaatgcaagccttggcaccttaattgagcaagtttgaaacctcgcttgttgcccttctggaaggagtcaggaatttccagttctgggcctgggctgtgggtctggcagacagacctctggccctaggtttgggtgccaggttctctgcttccagaatgagaagctttgctgtgcaccaggacctgggcccttctggtatctcctgaatgaaaaacaagggatatttaataaatatggatttaaatatgtga

SEQ ID NO: 623 - DNA, 736 bp, Homo sapiens
tatacactgatcactatgaagacataaagatttgttaaaagtggcctttgaagagcatgtaattgtgtccagaattggcgggttcttggtctcactgacttcaagaatgaagccgcagaccctcacggctaagacatccaaggtcaaagggcctacatctggtgaaggtcttgctgctttatcccatggtggaaggcagatgggttcacagaaaatagaaattctttacacagtcttctgatcaatagaatcaaagccctttttctgtaaatactggctagagagttgctaacttccataatggagaaatggaaaaagcagtttctttctccaataaaaccacaaaagccatggttttaaaagaaactatagaggatttcttgtgtggagtccttagctttgtgactgctgagatttaagacataggaaatcatgacttcctcgtggcagcctcatgattctgagatcacagcacgtgcatttggtacagccagcagaggtggtggtgtcttctcgaattcctgaccttctttccatggcagaagaagcaacccttttgctaactgaggtctatggtggtgttcctggaatctccatctctaacctatttacctaatccttccaaaaatcttatattgaatcttttcatgtttaaattatttagaatggtttgtggtatctgtaaacactgaccaatgcttcccacaataaaatcagcagtatggaaagaaagaaa

SEQ ID NO: 624 - DNA, 4641 bp, Homo sapiens
tccatcagagaacaggctacacgttctttggaatgtgctctgagttccagctgggacattgggatactgggatgccaagaacgtgtctgcctgatgtcagcagtgggctcgaggcagatgtccctgcgcacccactagtcacttagtcggtgcatcttcacagaagataacatctctgtgggcccctctcctcccctgctgtacagtggctcttctgcgaccaagtggcccccttggaggtggaagcaaaaggaaaggctctggacggaggttccccagctccttgataacgtgtaaaaatctctggcaagtcagaggagttcattgctcacattaagagctgcttctcattgctctcttattcattcagccattagttaattaattctctcaacatgaatctattcggtcccggctgtgtgccagggtctgtgctagatgccgggggcatcatgtcagccaaacatggttgccagcctccataaaactgttctagtggggaaattagatattaaacgagcagtgtcacaactccataattaaaaacagtggatgagctttcagggaaaatcatagtgtgctgtgaaagagtaaaaatgaggggatccgatcaaagctgagggagctgcatttgggctgaattctgcaagatccatgagaagtaacacgcaaagtgggtgcgaaggtacagttgggagagggacacgttccagggagagggacattttccaggcagaggcatgtgccaaggccccagggtggagccattgaaagaaggaacctaagagctgtggtgatagtgccatatgtgttcatgctgcttttgtttttacaaagacttaactttttagggcagttttaggttcacagcaaaattgagaggaagatacagaaatttccgtatgccccccatgccctcacatgcacaagctccccaactatcaccatcccccaccagagtggtgcatttgttacaaatgatgaaccaaattgacacgtcattatcacccagagtccatagtttacattcgggtttgttcttggtgttatacagcctatgggtttggactctatccactgttagagtatcatagagaatagtttccctgaccaaaaaattctctgtgctccatccacctgttcattcctgtctccctcctgacccctggcaaccactgatcttttaactgtcttcatacttttgccttttccagaatgtcagatagttggaatcacacagtagccttttcaaagtggcttttttcacttagtaagtatgcctttaagtttccatcatgtcttttcatgactcaatagcacatttcttttcagtgctgaataaaatcccattgtctggatgtactgccattcgtttatccaatcacctgctgatgggtatgttggttgtttctaggttttggtaattatgaataacattgctatacatatctaggttttggtagttatgaataacattgctatacatatctgtgtgcaggtttttatgtggacttaaattttcaacttctttggataaatgccaagaactgtgattgctgcattgcacagtgagaggtatgtttagttttgtaagaagttgccaaactgtcttccaaagtggctgtgccattttgcattctcactagcaatgaatgagaattccagtggctccacatcttcaccagcatttggtgctgtcggtgttctggatttcggtcatgttaataggtgtgtagtgatgtctcgttgttttagttcacatttccctgatgacccatgatgtggagcatgttttcatgtgcttctttgtgtctatatatcttcattggtgaggtgtctatcacaatatttggcccagtggttaatttttcgtagctgaccagtatgatgaggggtgctagggatgaaggttggtgaagcccacaaagtgagtttctgtctttttgagtatccacatttgaactaggcaacctggctgcatgaaactcgtagcttttgttttcccccactttttcagccatctttcagggtcacatcctgaggtaatgttggggcccctggtttttactgttgataattattttaaaactgcagtgacctcactgttgcatttaatttttttaaacacaagggctgggggtggtggctcacacctgtaatcccagcactttgggaggctggggcagggagatcacttgaggccaggatttcaagactagcctggccaacatggcgaatccctgcctctaataaaaatacaaaaattagtttggtggcacacacctgtaatcccagctactcaggaggctgaagcacaaaaatcgcttgaacccgggaggtggagcttgcagtgagctgagattgcaccactgcactccagcctgggtgacagagtgagaccctgtctcaaaaaaaaaaaaatgtaatttacacaaaaaactacacacaaagtatataatttgataactttttgacatacatatatagccatgaaatcatagctacagtcaagataacaaatgtatccaccaccccaaaaatatcctcacacctcttattcctgggcctgcttcccctactccatattcaggacgcagtcctaaggcaatccgctttctgccattaaagactagtttgcatttctgaaattggactcagcatttactcttccatcatctggcttcctactcaacgtaagtattttgagattcatccatgttgctgcatgtctcattggttcattcctcttcattgctaagtagtattccatcgcatggatgtaccacagtgggtttatccatttatctgctgacggacatttgggttcttttcagtttgtgattataacacataaacgtgctatggagttcatgttttaatctttgtatgaacacatgatttcatttctcctgggtatatacccagctgtcaaatgcctaggtcatatgataggtgcatgtttaactatttaagaaactgccagactgttttccaaagtgattgtaacattttacgttgttaccaccagcagctatgagagttccaggtgtgctgcgtcatcctggatgcttgccatggtcaatcgttttgagtttagatattccaacaggtgtgcagtgggatctcactatggtttcaatttgcatttccctaacaaatgatcctgagcctcttctatgtgctgctttgccatctggttatcttatttggtgacacatctagtaaaatcttttgctcattttgggcagttgttaccttagtattgagttttgacagtcctttttatattctagatacgtcctttattagatatccattttgcaaagcctgtaacttgtctttttatttttttaacagtatctttcaaaaacagaagttctcaatgttgatgaagctcagtttatcaagtttttcctttatgtattgtgtttttggtattgtgtctaagacatctttgcctgagatgagaagttgtatggtttaaggttttacacttaggcctgtggtccattttgagtttgtttttgtacacagtgtaaagtatgaattaaagtttggtttattttttgcatatagatattcaattattccagcaccatttgttgacaggctattggtatggtctaaaagtttgtaccctctgcagatttgtatgtagagatcctaatccccgaggtgattgtattaggaggtggggtgtttggggatcttattaagtcatgagggcagagccttcatgaatgccattagtgcccttataaaagagcctcagagacctgccttgtccgttccacattgggaggacacagtgagaagactgtgagtctatgaggaagcagagccctggccagacaccgaatctgctgccaccttgatcctggacttctcagcctccagaactgtgagaaatacatttatgttgtttagaagggtacagattatggtatttgatcatagcagcctgagtggactcagacaaccatcctttctcaactgaatcgatgttgcacatttgttgaaaatcaatcgtccatatatgtgtagatctatttctggactgtgtattctgtttcattgatctagtctacctttgtgccaatgctatacagttttgattactaaagattataagttttagaatcagctagtgtaaacagtgaaaatcactgagagttcagaagttaaagttgtactgcggtttcaaataaggtacttaatggtcctttttcatcattcagcatgaatatcccctacgtatctctgaaggttgattttgttctttattttaagaataaaataacgttgtgaacagcttgaacctgacaagttcacttgaaagcattgcacaggaagtggatttctcagcagccattggtggggccttgtgatcccctgagagtgagcagctctgggaacagaactgacatgagtgtctgggaggggacatgggaaggatctgcatacaaattgaagatccaattcctataaattttctatacaattgtatattttaatatataattataattgattttaagtctgtctctggaaatataagctttaataatttacatcttcacttaatcacttatgaaatcattttataacccttaataaaattagatagtgtaacttgtcaaa

SEQ ID NO: 625 - DNA, 2080 bp, Homo sapiens
cagtatttgatgggtctgaatgaaaatctgatgaaacagatgttacttgaagctgagtgactttctcagggtcaagcaaataagtaaatggaggagccagaattataccccaggatccccatcacaaggaggggagggctaccatcccagctgcaaactctcattcaaggtttatgctgcagccagcagtgtccttggagtctagttcaaagctgaagagagtgaaccatggaactgggagccattggcggagaggctggcctgaaggaagggaagtgtttcagccagaatgtactgacgcacaaccaggaaaccacaagactggtgagaacctttccaaaactgagctttatgatcaaaagaggtacaggaaacagctctgccaagagtcctttctgctcctggctggaaccctgagcttctgaggctctctgagtcaactctctgaacagatgctgtcacccaaggaaccatcactaaagcatttttttgctttgctctgaggtggcctcactggtgggtgcaagtgagttactgtctctttttctctttcttgtttctttcttttgacagaagttgccatgtgattactcaattctgaattttagaggccataggttactgcatttatgccctttgccaactgactattgtttggtgctgggcctgcatacaaacacgacatccccaaactcttatcaatacctagatcacctgatgtgaatctatcaataccctggacttaacagggtattgaaggaaagagaaccggcaattccttcatttcttacatcccagccagtagtccttctcccaggctagtcttccttttgtttcccctaagaatgactcaactaggaattgcattctgatccctgtcacagatataaatcttgtctggatacaaggtcaaaataattgtgttcctgtggattctttttcttttttcaaccagagtaactaccagttgccatgaaataaatcacatcatcatatggcagatccagctaatagctgagactggcaggataactgaaccgtgtactcagagctaaatgatggagaaattggactggccatggagcacttcaaattgattgcttagtaatgggatatttttcctggaaagacaacagaatacttctgaattgttggttctgtcatgggtacaggctcccatgtacaggaaaataaagaaagtgtgatgaatttttcatctggccttctgcctactttcttgctttctgcatgtctccatttttagtctgtaagccctgcctagatgaccaatcactattgcccatgtggcataaaacctacaatttaactatacttcttaccaaactctcagcaagtatgaggtagccaacagccttttcaagataatgactgagtcttagcttaggtttcagtcattttaggaaacataaaaaattcaatggtgggagatcatacacactctgcaaagatgtcagaagtcaagttttgggagagtccacacacaaactgagcagtgatggtaaaatatatttttgaaatatttctcctctgtgactgttatgtgaagtagagcaaacacattgtgctgcagtgctctttgggacatgccttttttgggaagtgctaactttatactctgctgacaccaaacatttgaatataaaaccttatttttttctctcactctgctccacttttggctcagcttattctaccaaaacacacttcaaaagacttctttatagaaagaatgtttcaaaaatataatatttccatctgttatttcaataatacatgctctgggactctctttatgaaccactttcctttctttgctcccatttagatgtataaatatttgattgtaaagctctaaggaatagtcagccaatcgggtcactgaattgtgaacattcctaaccctataattttgtctgtagcaggcacctcctgctgtggaactaactgctaagggattatagcaatgtaatcctcagactgttccatctcaaggttactctgaagtggagggaaggaagccgttttaattttgataaaataaactttattttgtaacttt

SEQ ID NO: 626 - DNA, 2296 bp, Homo sapiens
aagaataaaagcaggctgcctgaggttgcggtggtaacatgtttcggcgtccttccacactgtcgcggcttatgttgttttgctgtttgggtttgcactgtctttttgagctgtaacacagcaaaggtttgcagtttcgctcctgaaatcatcgagaccacaaacccaccgggaagaacgaacaactccagacgcaccgctttaagagctgtaatactcgttaggaaggtgtgcagcttgactcctgagtcagcgagaccatgaacccatcagaaggaaaaaactccgaacatcagaaggaacaagtttcagacacgccacctttaagaactgtgatactcaccgcgagggcccgcggcttcattcttgaagtccgtgagaccaagaacctaccaattccgaatacgttgggttcaagtggttctcctgcctcagactcccgaatacctgggactacaggcacccaccacgcccgggtaattgtatgacaatggagaggtgattactgcgctgaaaatcagtttcctgaagtgaaaaagggaatcaagttacgtcacagagcctggtgtgagcggcgctctgtcaacaccagctcttcatgggttgtggtttcctccagttcctggatgtgtggagttcatcctccactgactggcgccccggttgacaatgaggtctggcatccctggagttgagtaactagttctggctgctggtctccaggtgacatgtgtcacgtttgagctaagaattgcttcacatgattatggaggctgacaagtcccaagactcacagtcggcaagctggacacccaagacagctggtgctgcacatattaccagtgatgtagtttcagtctgaatctgaaggcctgagaaccaggacagttgatggtgtaaattccagtccgaggtcaggagaagcctaatgttctagcctaacatcttgcagcttttttgttctatgcaagttttaaagtaattggatgggacccagccacattagggaggccaatctgctttactcagtctaccaattcaaatctaatcttatccagaaacaccctcgtagacacatccacagtaatatttgaccaaatatctcagcactcaaaggcttaggcaagtcgatatgtaaaattaatgatcacaaggagggagaatgggttcaacaggtatttaaaagtattcataatagaaaagtatttattgtgtttatgtggcaggcagtattctgagtgctgttattgtatctcagttaaaacactagttaggtaagaaaagcgtcacctctgtgaggtggttactattattgtcctcatttagcagatgagaaaacaggcagagaaaaatttacatgatttgctggcactcatgcaactgataagtatctgaactgggattcgaacccaaactaactcagagtttaagctcttaactgccattctagagtcctccttggggacaggtgattgtaggtagaaaaaagaaatatggggagaggcatgctgaattgaaaaaaaaaacctctctaaatgaaactgagaaccacatcttctagtactaattataggtagagaactctgctaaatattttgcaagcattatccaatttaatgataaaaaccatactggacatgagaagccattatatccattttacagaaaagaaaaatgagctgggttggaattgcagctgggacatttttgatactgtgatcttagatacattcatctgtcagactccagctgattccaaactccttgttcattctattaggttgtgctataagaaaaaattctgtaagctttaaaagtggtaagtcaactcaaggcacagccaataagcatttatatgactgtacattatttacctaactctgcagagggagccagatatcctttagtgtagtaacgaagaatggctcctgcatatccccagcaattctcaggaaaaggtgggtgttatattctcttaaatagagaggcgtttttttcttagtcctattactggcagcttctaaatttaataacaaaatgctcacctacaaataagaagaataaaagcttaacttgccagggggaaaaaaagttctatgatgtaacagacccaggaataagtgatattcatgggaaggtcactgcctgaggctgcttgataaactccagccctttcctatatccactgtttaatgtttaagctttggatgctaagagtggttataataaactgtccaacagtttctcacttagacttcccaagaaggtgacaaaataaaatcaatgtaaagctgtc

SEQ ID NO: 627 - DNA, 1413 bp, Homo sapiens
taaaaggctagagaattcttctaaacattcaaatatggttaccatttagagtgtactgcatattcagatagtttcaactatcatgttaaaagctctctggatgtattttttccctataacattaaagcttgtcaaactttttcactctttctgtttcttccaggaacaggacacactggcacatccttttcccaccaaaccacagaaaaacatttttaagtgaaggttgaagaaatggcaatttacagatgccagaagaaaggataaaaatcaaggcaagataagaaaaaaggaggctgatgttctgctggtccacttggtttactggcttctctgtctgattgtgcctaactctgacactgtgccttccctctagacactgtagatgatgtttagtcctagctcaatcagtctctccctttgcacatttccgttacaaccctgctcatgtgctcaagatattgctcctgctactctcccctctcttctgcatcaacagttctttctcatctactggacaattcgcatcagcctactatcatacacaaatacccccacctttaaaaacccctcccttggtcccacactagtcttcagattccatcccattttttgctccccttgacagcaaaaacctccaaagagtatctgtactcagtgtattttctcttcacccatcagcaaaatttgacttagttaccatctcctcctggaaacagcttcttcacctggcatccaagtacctctctattctcctacctcatcaagaacttctgctttgctgattcttcatccccttgatatccaaacatagcaatgtcccaaggctcagttctcaggtccaccaagcactctcccacttcacagcccttgtatttgcagccctttctgcctgtaagctctctcaaccctcttatcctcctgaccccaggtctcttcaaatatttaccatctcagttttctttcttaatctctctatataaaaaactacatcaaaatctttttcccttatcttgctttattttttctccatagcatttagcaccagctgatatattaccatgtttatttgtttgctgtttgtcctactagaatgctagttttttgaaggcaagggctctgtctgcttggttcctgctgttggccacttcgtaacccagattctggcacataacagacccttgctacatatttgttgaatagctgaactcttagacacaatatcctaagactttgatagagatcttacttctgatagattgttctttcctgcaacaatactgattcctatataaatctggggaaggaagaaaaggtgactgatcactttttacctctcatcttttgccaaggtaaggttttttgtggttgttaaatctgaatataattaaattaaaaactttggatacccga

SEQ ID NO: 628 - DNA, 704 bp, Homo sapiens
gggttcctggagggcctctccgggactcgaggaaaacgaccttttcccttgcagcggcgggagagggcgaagtggaggactgctgctcggttccgtatccaaaagagacccaaggctccaggcaaaatagattggacattttcactttctcaagccagggccaccggtcgcccaaccagcagccactgagggtggtatcggggcgccccttcccctggcagcgtatttcagcccccagagacatcccccacctcggccatccccagcgcctttgcagggacagcagcacaaccatagcagaggtcctgggcatcctggaaataacgtgctggtgatctggctcagaagtgcacgttggcccgcgcgtgcggggagctgagaagcaagagattggaactttgcacgtgtcaagcaaggtttggcctgctttgaagacagtaatttcagagccactccggtctctgcgtcacaagcgggcatcagggcagtggtggggcggcaggggatcctgagacctcccatgccctctctttggccccggtgcttctgggcttcaaaatggttaactgaaaagaacggaggtcacatgacaacatgagtatatcccccaaggaagcctacctgtctatccccaggaatctgaaccagcagacaaagcactgtcgggtccttgctgcaacctcttccccccaccccctttgatg

SEQ ID NO: 629 - DNA, 530 bp, Homo sapiens
gtttttgagtttcagtggaagactctgacgtttcaaataccaaggctctttacgttgttgggacccaatttgttctcctctacggtcactaaaaatataatggctctacaattaactacaaggaagtatgttgcaaggtagtccaagtgcacacactgcaaggcagagatacaaacatcacatccagcaagcaaataagagtgtatctgtgcctgaaacaaggatactaaggtcatccacaacagtggtgtctaatggggtaagctaatatgaaagagtgaagcagcatcaacagtgagtaaaacagagtgactgcaacatgttcttcatttttgtcactgctttttaatacattacttcagatttcaatgtaaagttttgaataaaaggaatcattatatacatgttttatttgtttttgaaacagatgttctctctttttgaagaataaatcacattttatttccctccagctttattgaaatataattgacaaacaaaattaaataaatctaaagtgtgtaatataa

SEQ ID NO: 630 - DNA, 543 bp, Homo sapiens
cttttcagcaaggtgtttggatggtcctgtgcaatgtctttgagggcaagatggtgctatgtggactggacagtagcagcatgtggtgatttgcagctgacccttgaatgcctggacagtggatggcggacaggtgttcatccagagagaaagttccagagaagcagaggactgattaaaacagcagatacgcatcaaaacagggaggaatcagcttgggacagtcaccaggtgggaggaaaggagtccaaggggacagccgagccaagaatctgaaacccaagctgtagagactcaacttgcagataacctggctgcgagtactctgcccccaactggtggaagggaggagatggtggcgagaaggtgcatctacttctgaagtgccttgggttggagtgaaacacctcacgtcctctcacatctcattagcaagaactaaccaaatagccctgctcagatgcaaagggagctggaaaaggtagcccgcaaggagtctacactatgaagggggaatatatggaattgtggtgtttgcctgct

SEQ ID NO: 631 - DNA, 499 bp, Homo sapiens
catctcttgaccggggtgttctcaccatgccctttctacaaacaaaaaaatgaagatgtggagacctggagacaggtggcacctcgtgcttcctccgaagggagagcccatttcctaacagctggatcaaaggcatgaaatgaacatggagtccctgaagatgaagagaaggcatggcttccagggagaaattgtacattacaggaatgcagatgtgattcctatggatgagggtaacctagaggctagaagaacaataggacagaagaagcctgggtccctgaacaaccttgtggagcatagacacctacgtggcctggactgccagctcacaatgggcctctctgtgagagaaggaaacttccctcttgtttaagcaactgtgcttttgagaatctcttggtctataccctaatgaataaggccatcataaatggatatcaaagtaaggaaatttgtgtaaatgatttaataaaacattacctcaggtatgaaataa

SEQ ID NO: 632 - DNA, 358 bp, Homo sapiens
ctcctctgcatggaaccaggtggggagagagcgaacctcaaagtcatgcaaagggcttcttagcctggcttgaccactttggaacaggctgtctgtgggcaaaggattcaacctcactgaacctcaattttctcaaatgcaaaaagggttttaagtgctggctgttgttcaatggaagaggaaatcatttgaacaagaatcgcatcaagttgtgttgtgataaattttctttattaggatgaataacatgcacagatgagcttcaaaagtgaatgagcaaacttactggttacactctgcatccatttactctgtttagtatggagtaatgttaggcaataaatgatgctggcaaatg

SEQ ID NO: 633 - DNA, 5673 bp, Homo sapiens
aaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttacactacccacattatttttaaactttattttaaataaagaatttttaaaattaaa

SEQ ID NO: 634 - DNA, 544 bp, Homo sapiens
cgccacgggctgcatgggcagcgctcgcgccccgccgctgagccgccggggagccgtccagtcttcgaatcccaccacagcatgttccgaagagatgattggaagatggaagtggagggttaaataatgaaatgcagctaacatttcggaaagtttctaaaagttgtacaacatgccctacagctactctttaaatctccaaatcaaatgagtttcaggtggagcctctgggaggtgatgaggtcatgagagtggagcctcatgaatgggatgagcactcctacaaaaaggattccagagagctcgcttgctccttccacagtgtgaggacacagagggaaggctctgtctatgaatgagaaagtgggtccccaccagacattgaatctgccgcatcttgatactggacttccagtctccagaactgtgggcaataaatgtctgttgtttattacctgtccagtatctttggtattttgctatagcaacccaaatggactaagaaaacaccagaggccatacctaataaaaatattgacatcac

SEQ ID NO: 635 - DNA, 671 bp, Homo sapiens
gctagtaactgcacagacccatctgaaagccctttgatagatgtaatggatttgagcatggactgtgtgtcagacgctgcgtcagagactgggataccacagggacctgaccagatataaactctgctctctagaagcttgacagtccaagcatcacaaatatttgattcggtatactttttaatcactcatgctcaactgaactatttggtaaaaggtaaaaaagcagaatcactctacatcctcaaaggaactcagtatacaacagcaacagcaacagctgcttcctgctttacatgctgaaaacaaatggttcagccaaagtttgtttttgcaaaaataaacatagtgcaactgaggagtctttaatagacttatgcagatttcctaagtgattatagaagtgtttcttataaaggatatcaaagagtttgcttggaaattatagcagagttaatattaaatacatatttttaaatgttcttggaaccagcattgaaagcctttttcaggtttgaaatatcattatttatttaatatttctacttgtctgtcacattatggagaaaaaaacgaatgcctgttattaagaatgtggcctccctataatcaatggtgttagtcaactttcagatttcctttaaattacgtttctaagattttaaaaattt

SEQ ID NO: 636 - DNA, 2501 bp, Homo sapiens
gggctgcttcttatttatgatcagatcaagggtataaggtgtcagtgggggcagccagcagtcataggccagagaggggcgactgcccgtcccaagggcttgtcacagggtaagtaaccgacagactgggaaaggaaggaggcaatcttcagccactcggtcactcattctaaattcactctcattttttgggcatctattgtgcaagccctgtggacttaaaaagagaaataagacgccgtccctgccctcgggagctcccggcgcatctgccccaacaactcgctgaagccgcctgcaggacgcctgagtgaggacaaggtgtctcactcagaaaatttgcttgattcttcctggcaagtgggacagggtgagcttcccggaggaggggaccttcgagctgtgtagcggggaaggtaggagagcgatgagagcgcccggaagggacaagcattcggggagactgaagcgcattcaacaacatatttattgagcacctactacgtccaggcactgttacatcggtgatgtaacaaaagccgacaaaaaccctcaccccgagcgcaggcaccgcagagggcgatgacgacccgagaagatgccgaacgcaggccaggagggggctctggggaaaagcaaaggcaggggaggttgcccatcggggagcctcgcgtccctgggccctccgtactctgcacatatgcagaggcccccacccgtcctgtaaccgcaaactgcttggcgtgacttggccagcggagggaggagcccaggctgcaggacaagcaggagtcagggtccctgcagttgctggggaaagtggactcttctggtagctgcttttacagcccctgccctcagaggccccccaggtgggaagggcctgcctcctaggcagtgggtggtcaccgaggactgactttgaacccggggcaagggagccccagaaggctggaggcctgcacacggcactggaagaaacaaactgcaaaggctgtccctcagggctatctccacagccaccggaatgcggcctggaatatccaaacctgtcagcccacctgcacccagccagacagcgaccattctagctgcttccccggaggcctgctgacccagagaggtgtcaaaaagctgaagcacaacagacagacctcccacagactcagcagggagttggaggacagtcggcacaccagcagctgtagcccatcacctcccccctccccattcacctggtatgcagcacttaagggcttgctgaagccccagcaaagcagaggcccacctgagagcttggaaacacacctatgccccagaccaccgcaatcgcaatctccagtcagccctggccaccacagtgaactgcctaagtgccccagatgactgagtcacaagccagggctgggaagcactgcatgaaaggcggccttctctagacaaggctggacacacccctgcaaggcctgtctcctaggagctgggatgaaactctggacgatgtgctgggaacaaagaaaacccacatggtaaaggctcgcttttccttgggaatctgcaatgcttacagaacgggaaaggctgaaagccgcccacagtgccgcacctgggcctgagggctggtgtacccaccctctcccggaggaaacaagacccgtgaccagactcaaaaccacctcacaccctcacaatccttacagaatattcaaagactggcacttcaaccttacaacctgagcacgtctaaatgcctaacacaataccaagcacactgtatgccacgcttttaaaaggtagagatcttaaaaaaacaaaaaacactacctcgggtatgaagacagattttatgatgccagtcatttccagaggggctgcccgctgtggcacagcaccacctggtggccaccccaacccatgcacctccccccatcccagtaccctgacagcaagccaatgaaagaggtgttaatatggctattttccaactgaggaaacaggcaaaagtgtagtcatttctccaagtcagtcaagttagcgagtggtagatgtgctataccttgttgcacccattttgggacctgtttgaatggcatgccccaccatcgctcccacatctgccagttatgtttaaccccacgtgctatttccatcatggcctccccacatcttattttcaaacaggctgaaaacagatggcctcatttgccgactgagatcatgctcaagattagggatgcaccgggcacggaggctcatgcctgtaatcccagcactatgggaggctgaggcaggcagtgaaaccctgtctctactacaaatacaaaaattggccaggcgtggtgatgtgtgcctgtaatcccagccactcgggaggctgaggcaggacagtcgcttgaacccaggaggcggaggtggtagtgagctgatatcgcaccactgtgctccaggatgagccacagagcaagactccgtctcaaagaaagaaaaaaaaaaaaaaaaaa

SEQ ID NO: 637 - DNA, 540 bp, Homo sapiens
agacattattgctgggcttagcacctaaaaatgttttatatactggagcatctgaaagttcctattcagtagcagaacttcagggtagttgaggtttataatctagtcagttataataacattgctagcatatttcagttttttggatttgtctattatttgacaatataatttttattgtctttgtctatgtcatatctttaaattggctattgttttgtgcttatggaaaaatactttaattctcaaaaacagtgatttcttttttgtttttgcctctttataaggaatagcaaatagaagtgctagtatttactagatgcagtgattgctacagttggttttaagtaaaacagattgtttttgattattttgaaatcagcccctaaggctcatacatggatgggcctcagattttgctataagcttcctgtcatctgtcatatgagagggatgctgtgtgaatcagttatgtatattcctgttctttaacattgctaaatttttaccattaaaatttatgttggtttctgttttctt

SEQ ID NO: 638 - DNA, 1572 bp, Homo sapiens
ggacggcaaggcggggagaggggcagcccgctcgcggccctcccgcctggctctcgcctcggcctgcggccgggatcctccgcccgggtcgcgcagcggaggccgagggctgggacgggcggctgggaagtgggaaagggagctccttttgtcttctcttcccatcccccaggtttgggaaagttttccttttgggaaagcccctctcttcagcctgctggcgggtgtcggattggttagcgaccaccggcccccgcctcccccaacaggattctcctttgggccacaggtcttccggaagttgccaaaccccggtagcggcagcgtccggctgggggctttattagggggcaccggggtctgctttccgactcccttccgactccgcgcctgcgcaggaagcgatttggggagtgttgtgaattccgagggctccacacttaagaggttgtacactcacctgtctacctggactccaatttccatatttccagccacttgaggactgagaggtggatgataaaccctgtcatagtggagcaagttcaggtgtttaaccgctgttatgggggatctgccttttctccctcttctttcttacttccataagtatgtatgtgcagagattgaaaaataaccttgagagagtccatccatctaactccagttcattggaaatttctgcttctttgagactgaggttatattccacttcttctgactacaccaccaccatcaatctccttctctgaactcttggatcattacttcaacctgaaacaactcatcaggcagaatagttgcctactgccccaaccccaccaaatgttccagcacctctgatattacctcacatggcaagagggctttgaagatgtgattgagtcaaggatcttgaatggggagattatcctgaattattcagctggacccagtgtaatcacaaaggtttttcaaagatggaagagaggcagaagagccagaaaaggatatgtgacaatggagtcagtgtcagagttggagtgacgtgatgtgagaaggattcaacctgctgtttctggctttgaggatgaaagaaggggccatgagccaagcaatacaggtggcttctttcaagaagttggaaaagtggtaatattttatgttattttggtttgatttttgtttgtggcatatggctctgctgtcctgtgactctaagtagaagagaaaatagtgccaataattcttcatggagatgcacctctctcaagtcttgaacaatgtttgagatttccccaggccaccatcactggatttggctatttgacttgctgtagtcaatggaatgtgagtgaaaagtgactctgtaccagtggggaggcaaagccttaaaagacccagcaaatttcttccagcccttttgtgcttctgccaaaagaatactgtgagcaatcagtgcccttaagcctgggcctcagaacgagagatatggagcaaacctgaacctgaacagcagcctacaatcaagccaggatgaccctgcaaagcccagccaacgatagcaaagccacagcagacttgtagaccaat

SEQ ID NO: 639 - DNA, 1818 bp, Homo sapiens
ctcggatttggatttggatgcctgtcaagccctcactcttcagactaaatgtctgatttgcatggagaattatcaagagaagcaacaatgccaagcagactattccaggtcaaaatagtcaaattaataattcataaattattatatgttttgaaggtattgcaaaattaaagttgcaagaacagtacagataacttttttcctgaaccatttgagagtaggttgcagacctggtgccccatcatttctgaatattttagtgtgcattttctacaaacaaggacattttccagcataaccacaatgcacccatcaatgtcgtgaaattaatgttggtacattactaccacctagtcctcagaccctattcaaattataccagttatcataatagtttcttataatttatagcaaaatgatccaaaccaggagcatgcattgcatttttatgaatttttaaaacaattaagtctgtgtagtgagtgaagccacagtgataggaatatataaaggctttgcatctagaatttgttctgaaaaccctgagattcaagtagtacattatttcatttactattttacacagagaagccctcatttttaagagtttgcctttctgatttccaccggaaatgatactatcagtatcatactcagaatcttaattacatacaaggcactaacctctcacctgttttcagctttgtgtaaagacaagggatcaaaacatccctttctgctatttcatacttaagtgtgggagctgatccaaaggaagaatagtttcaaaagtttgtagcaaaaaaaatttaaaaggtgaagattttttccttgaatgattctcacctggcagatctatggaaagattagctgactctttggatccctgaatatagttaatagaaatttggaaggaccatgtcaaaattaactaatgtgaactgacaaagatttggtgttcaaagcaaaaattaaactttggaaaagtgagcaagtacttaatcagaaacaaaaaaaaaaaaaagaaaggaaaagttaggtgaaaatggtttccaggtgttgttgctgttatagtttgaatcataaaagttgttaaaagtctgctgtaacaaaccatcatagactgggtgacttataaagaacaaaaatgtatttctcacagttccagaggctgggaagtctaagatcaaggcatcagcagattcagtgtctggtgagggcccactttctggttcatagatggcaccttctcactgtctccccacgtgatggaaggggcaagaggtctctcttggtactcttttattaagggcactaatcccatccatggggctccaccttcatgacctattcatctcccagaggccctacctgcagataccatcgtatgggggatttgatttcagcctgtgaatttgggggaagcgggacaaacattcgttttgtagcaaaaggagtagagtaatatctgccaataactggaggaaagaattgttcttttaaaactattaaattgtttaatgggatttaaatgatttcaggaatgaaatggaaatcctggtaatgggtagaaacataggtaaattctccttttccacttaccaccacctgtgtgaacaacaatcatttctcattaatagtcaagaatttgaagagatcatgagtaaaaagtcttgatcagaaattgtgtatagctgtttccagcataaaaccttatataaaatgcatattcatagaagatgctcaagtatgtcatgaaaaatatgaagtttatttaaatatttatacaaattaaagatttactgtattctctaacag

SEQ ID NO: 640 - DNA, 657 bp, Homo sapiens
agagatgggaaagaagcgtcaagaacttgaacagaaatccagctctcagtacattgcaagacgaggtctcactatgttgcccaggctgatcttgaactcctgggttcaagagatccacccatctcagcctcccaaagcgctgggattacaggtgtgagccaccgtgcccagccctgatgcattttctgaaagctcttcagaagcaagtaaattgctaaagtattgtgtctcctaaaacgttcatggaaaggatagaaaggaccctgacatcatttgcgctggaaaccctgagacaaagtcagaaagatctggaaagacctgccagaggaaatctgccacccctctggactaggagacttcatctacataaaagtgggctgtcaccatgctgggagggaccctttaaagtgctgtcgatgacccataaggctatcagtgcaaaaggcaaactgctgaatccaggcttcctatgtgaagctagcaccacaggacaggtggactgtgctttctacaaaggacctaaaactgaagttttctactcaactgaaaagaagtattctagaaaatgtattactattcctataggctgcctggctgttctgttcatgacggtggttattccaattactttgagaattatatttattagaaaacaaa

SEQ ID NO: 641 - DNA, 1739 bp, Homo sapiens
ggaaggcgggggacccgggacttccaagtgttctggccatggaggcatggtatccgtaacatcccccaaaggagctaaagaagaaatccacaatttaccatgagcatttctcgtctgaagattgccaagcgattcctccaggacattcctcaagatcaatttctgttcatccaccttgtcctgggagggacatcaatgggtttccatgtcctttggcttctggttgagttcactcagtggagaaccctggcaagaggcaggaaaaggggaggaaggctttatgatacatgtgttgaatgtgcaggttcgttacataggtaaatgtgtggcatggtggtttgctgcacctatcaacccatcacctaggtattaagccctgcatgcattagctattagtcctgatgctctccctcccccgcaccccctagcaggtccctggtgtatgttgttccactccctgtgttcatgtattctcattgttcaactcccacttatgagtgagaacatgcagtgtttgattttctgttcctgtgtcagtttactgaggatactggcttccagcgtcatccacgtctcagtataggacatcatctcattcctttttatggctgcatagtattccatggtgtatatgtatcacatttttctttatccagtctaccattgtgggcatttgggttcattccaagtctttaataagggtttggtcttacctgatttatgttagaaggaaaccatttgtttggaatgaatagagtaaatcttttgggaaaatagaaaaaaagattattttaaaatcatgtgaatatttaggtctaagagttgtccatgaatccttagctcagtgttcatagatccctacaaacaagatctatgaatagaattcttggaatccttaagttaggataggaaaaaattacatctttattttttctaacctctatttgaaatgtagtatttctttccatcacaagtgtatgtgacaagacacaatagtgttggtcattactaaggctttatcaccgacaaaaatcataggtatttttatatcacactgcagtgttgtaaaaatctcaagatatcatctatactcttcactgcttcgaaattatggtagttggtagacccaccttcaggtcttgttattggcggcattaataaggaagtgtatatgttatgtttcacaattttattttctaaatactttcagattgcaactgcatttccatataatttattttataattcgttgtgtttcaagttatgcatttacacatgtaattctaaaaagaagtccatagacttgaccacatttccaaaagagttcacagtaaacaaattattaaaaatctctgttaattcatagatactcattccagaaaatacagcaatggctgcatatcaggaatatctttttccagaaaaaaaaatatccgaagttactagatattctgtagtttctgtatgtggagtttctggggtaaatcctttgagttcaatatgttgactatgtgctatgtcatctcaaatatttgaccttattctgtttttcttctctgggtcattgtatgttttgtaactagatttcctatttggtatttgtctcccaaattttaagagcaaaacttgtcatctatcgccttattttaattctcactatgtaaacttgtaagaactaactcacaacttggtgtctcataactcacttctgaaatatccaataaaaaactgccaagtta

SEQ ID NO: 642 - DNA, 582 bp, Homo sapiens
aggtttggacacagacactcagaagagcaccatgaaaaagcacagaggcacagacacatagagaagacagccatgtgatgacgaaggcagagattggggtgatgcttctagaagacaaagaatgtcaaggattgctgggcaaccaccagaggccagaaagagcaacagaaaatgggctaagacatggagcaaggggcagaacgactcttgaagatgctgagcaacttctgaaagtttcaactacagtgctgttctgtgaaggggaatgggtgctggagagctaagcaggaagcaggaggcaggagggactgtctgcagcaatcagcagtgaggacaacatggaatgatccctaaggtggagcaggaagctgtcaagagaggggaaaaggtgaaggattcctggaggctgctcagcaatccatctaagacaaaatgcaaaagaacctcttaaagatctttccctacactggtggcctggggaacaaatcacatttggagaattgaagaaatcttaaaatgcaagcatattaagcccttttcccccaaatcacttaagtctcacaagtctacctcacttagagc

SEQ ID NO: 643 - DNA, 509 bp, Homo sapiens
cagtgattccatgtagacagttgtgcaactgtcagaatccctgggagttccctgaaagcttcggggatttcaggcgacttcagacgcctcaaagtcaaacaaaaccaaaaatgtccccttcaggaagtcaggccatgttctgtccttccgttttccttcttactagggaacttggggagggaggctgggcggcagcagttaaacaactcacccaatgggaaaaccagcacgctctgggaccacctctgaagtgatctcacaccctgaccacacactctaaactcactgtcataatccttccccttggtcaaaaataaaagcagcacacccactctgctgggagtgagtcacaaacagaaaaaagtcaatgggtctgagccaagaggatctactaacaaggggaaagatctcccagtggaggtgtttcagcggatgctgcggtcttacccttgtagcctggatgaccagacagatcaaaaaaaatgttaaagtccaggcatctgacacta

SEQ ID NO: 644 - DNA, 1923 bp, Homo sapiens
ctcattagaagccagcttcccctggaaaacaaccacattctgctctactttctcatgtctatgtggccctccctgagtgggaaggcttaagttttgtaagattcatcataagtgtggtgatatttcctaattccagggaatggagctagtcatgccacacatctttgctgttttcacgaactgagattcttcttatgttgctattttaaactcctgaactcaagtgatcctcctgccttggcctcccaaagtgctgggattacaggtgtgagacactgcaccctgcccaagcacctctgctccgtgccatgctcttggctaattggagttgtgaaaggcatgaggattctggtcatggactcagctctcccatagggttctgacaccaaagcaatggtcacaacagtgaaaggaagaatccatctggccaggctcaggtggttcaaggccttcagaatctgccttgagactctcactggctttagactgaaaaccatcttggccccgtccatccgtgtaagcaatttaacgacagcttgcaaagcaccgagctttaacagaaagaagagatgagcacagcgcaagaacttggactccagaagagctgcctaacagattatttttctgtggcatttcatgagaacaaacgaagtaggaattttccttttgtttgtctggcctttggcatcgtttactttctttttattcttctgaaatgtacttcgagccctggcagcatttctgtcctaaaatcttattgtcagaggtttatttttcagcttttcaaatcatatctgatagagtgagtgtactgcctggactcatcactttacttcagaagaaatacagctcaccctttaaatgacaatggtgactgtccacatctttatgttttctacactgaagtggcaggcttcatttaaaaataatgttttccctcatcaaaagagagctagggtagaaccgtcaactctgctgttgtctgggtagtgacctaacacccacgttttggacaatcactcactgtcttatattgggttttcattgcatgtaggataattctttgtcaatggtagttttgtcaaccgtgatctgaggtaatgaggttttctacttttgcttgaaattttgaaaatatgcaagctttaaacatttgcaaagttggattctgttttctttagaaagcaatctgatttgctgatattctctccatctgtcaggggatgcgtgatgtggtgtagacttaatgtgctgcctttctggaacatggacagagtagcagcacagaaaaatgagcatttcagctctgtgatgatttgtgaaaaaaaatctcagatcattgagcaggcattttgctgacacctgtgaaaagtaaccacatgagagagcatggcgtgatggtcggaggccacgtgctggagctggactgcttgagtcaaatcccagctgctcagctgtagtgaactgaatggtggtccccaaaagatacatgtatctcctaatccctggaacctgtgaatgtgaccttattaggcaaaagggtctttgcagatgtaattacattgaggctctcagagatgagaacatcctggattatcagggtgggtcctatatccaatgacaagtgtctccttataggagacagaagaagttgcagacccggaagagactaagtaaagatggaggcagagactggagtgaggctgctgcaggccaaaaatgcctggtgccagcaaaagctggaagaggcaaggaaggacctttccctggggcttttggagggagtgcagccctgctgatgccttagtgttggatatctgggctatggaactatgagagagaaacttctgttgttttaagccacctagtttgtggtactctgttatggcagccacaggaaactaatacactctttaccacctg

SEQ ID NO: 645 - DNA, 714 bp, Homo sapiens
ggagctacggtacacaagcacaggttcacatttatgaagcagccaataagaattcccagcctgagaggaccttggaaccagaaggaattggaggagatttaaacaagctgacccaaggaaagcacaagatctttctatgcattgaagatcaccaaatcaaagataaaagtgctcgaccattatggcctatggcaaactcgggctggctgaagcatccttctcttccatttagaaccctggtgaggccccttagaccaccactgggctgtcctcctccctcctcagagacagagttctgggctgggccatggaggtgtctgtcaacacggcagtagtcctcgttctatggaaaaccagctgttccctgtgacacgactccattcccgcagctgcctgctattcagctgggctgacggacagcagagcacagggttggaagaccaccctctcagacagtttgaaatctctaaaaggccgccgtgtcccggctttaaaaagaggtgaagcacatctctcggcacatgcttctgcataggtgaggcctcagcgaggcgtcctggcccctgagtggagatgctcccctcagccgtgcctcagctccagggcaccatcacgagaggcttcgttcagggtctcctgcctgcggaccacctcttacgtctcctcctcaccttctggtgtcgtctcaaccaactcagaccttcagatcagagg

SEQ ID NO: 646 - DNA, 744 bp, Homo sapiens
cagtcagtgacaccaacagaggctgcgctcagtggggcaacctctcctcctccgcagccccagcctcctccctgactctgccaggcagctagctccagccaggtcctccaacactccccttgtcctggagggccagcctggggcctggcaacgcccagctgttcaacatgaagttgccccaggacccccaggatcaccctggaggggcccccatcaggagacgcaagacccctgggccagggctgagagggcctgttcacttgctgagctgctgatgggcaggtgacggcctatcctgcagcagttagagggcagctagggagacgtgggctcctacctttctctccctgcaccccttctccagcattgttcccagcaggcttgggactccactgaacttggatctctttggttttgttccttgtcctctccctctgctcacacactgggctccaaggagcccgttcaaccccagattcttggattcagaatcctgggatcatcaaatcccagagatgtcaaagctcatttggtctgccccttccttagagctacaccatccggccttgacccttggagatgggatgtccacttggctgggtttattgcacccttgctgtatgcaaggctctttgcttatcaggcttggagaaattgagttaggtggtgcaaaagaggatacagagggaaatagtgcccggcctgccttaggaagcccacagtccaataaaaaagacacaagaa

SEQ ID NO: 647 - DNA, 2896 bp, Homo sapiens
ccatggagggggagcaagcgtgagctggcacccaacacccctttctccacatggagggtggtcacatgttctccacctgttcccctagatggtgagacttctgttgggcttgcttttcctgggccagtgtccatcagccaggtgctcagccatcggtgcgctgaagctccagcccttcctggtgccctgatctcctgcactgagctgtgatgagtacatccgggttccactggatgcatgtgcgggaaggggggtgccctgggttgggtcagtgatgagaaccttatattgtcctgaagagaggtgatgacttaaaaatcatgctcaataggattacgctgaggcccagcctgggggagaattttggaaaaggatgctgggatcccagggtccccaacagggccactgtattttggacctgggacctggtggctctgaagggcatctggaggtggcccaacctgtctctgcactctagtttccctgtgtgggcttggtgtcggtgctccagttccctgggggcagggaatgttgatggctccttcctgagtccctgttctcgcctttgtctttcagtgagctctttcacctaggagggccccttggcattgactggcatagatggtgaccctgaagaaagacttcagttgggcctgaaggccccgggccagtgtccatcatccaggtgctcagctcccagtgcactgaagctcagacccttcctggttccctggtctcttgcactgagctctgatggtgagacttgaggaagacttccactgggcctgcttttcctgagccagtgcccatcacccaggtgctcagtccctggtgcactgaagctccagcccttcctggcgccctggtctcctgaactgagctgtgtgagctcttctgccaagcggttcccctggcattgaccaacatagatggtgagcctggaggaagacttgcgttgggcccaaaggccctagaccagtgtctgtcagccaggttcccaacccccgatgcgctgaagctcaagcctttcctggcaccctggtctcctgcactgagctgtgtgagctcttctgcccaggcgggccccctggaattgatgggtatagatggtgaccccggaggaaaatttgtgttgggcccactatccctgggccaatgtcagtcagctaggcacccagcccccagtgcgctgaagctcaggaccttcctagtgccctcggctcctgcactgagctctgatggtaagcctggaggaagacttgtgttgggcccacaggccccaggccaatgtctgtcagccaggtgctcagcctctggtgcgctgaaactctgacccttcctggcacactggtctcctgcactgagctgggattttccacctaggaggtccacctggcattgactgacatagatggtgagacttctgtcggcctcgcttttcctgggccagtgtccatcagccaggtgctcagccccagtgcactgaagctccagcccttcctggcgccctggactgagctgtgtgagctcttctgccaagggggtcctcctggcattgaccaacataggtggtgagcctggaggaagacttgcattgggcccaatggccctggaccagtgtctgtcagccaggttcccagcccccgatgcgctgaagctcaagcctttcctggcaccctggtctcctgcactgagctgtgtgagctcttcggcccaagtggtccccccggccttaagcggcatagatggtgagcctggaggaagactcgtgttgggcccacaggccccaggccagtgtacgtcagccaggtgctcagcccatggtgtgctgaagctctgacccttcctgactccgtggtctcctgcactgagctgtgatgaccatatccagtgagctcttccaaacaggtgggctccctagcattgaccgacagtgagctctgccacccaggacatccccctggcattgactggcatagtgagcttttccacccaggtgggccccctggcattgaccgacatagatgatgagactggaggaagacttccattgggcccacttttcctgggccagtgtccatcagccaggtgctcagcccctggtgtactgaagctccagcctttcctggtgccccagtcttctgcactaagctgtgtgagctcttccacccaggagggccccttggcattgactggcatagatggtgagacgggaggaagacttgtgttgggcctgctgttcctgggccagtggccatcagcctgttgcccagcccctgaggcgctgaagctcaggcccttcctcacaccctggtctcctgcactagctgtgtgagctcttctgcccaggtggggcccatggccttacacgacataggagcacgcatttcttgaagtcctgcaaaggtgatggtggtccagacaggagagggttccttcagcccaacatagcgcagctcccagctgaaactcggaaggctggtcaggcctcgaggactgcccaggccacatgagggtttggtggccgggagggccaatgatgctctgcgtctgtgttggatcagtgttcttcatggattccatcacatggtgagccttgaggaagacttgtattgggcccccacaggccccaggccagtgtccgtcagcctggtgctcacccccagtgtgctgaagctcagaccctccgtggcaccctggtctcctgcactgagctgtgtgaacttttcctcccagatgggccccctggcattgactggcatagatggtgagaccggaggaagacttgcattgggcctgttgttcctgggccagtggccatcagcctgttgcccagcccctgatgcgctgaagctcgggcccttcctcgcgccctggtctcctgcactgagctgtg

SEQ ID NO: 648 - DNA, 708 bp, Homo sapiens
cggcccctcatgggacagactgtacggcccaggctcctccgggcctggccagcgtggttatttataagccctggctgcctccagtgtgcctggatcagactggcttgtttgggtcaccggtgccaagttttttctttctttttctttttttccaataagaatctacgtctgagcatggacggaatcccagaatcaaatcactggatcaatacttggtcaccaaacacattcgagacctcaaaagctcaaaggctgtagggtaggtacccttgctacctactctacctacagacaaagacgctgagaaatcagataacttgtccaaggtcatggacagctgggactagacccatggcttgtcacactctaccagccttattcttaacctctctgcctgatgcctcttgacccacattcgactttgaaaaagttttcgcacttggttcatcggaaaaagccacacacagctgcccggaggactctgttaatcagtagctggttgcttctggcccagtgggcaacatcagaggcagaaagtacagtacagagagaaccgcaggccagcagttgcatctgaacccacgctcttcctcccagccctttcccttgtcttgactcacaacctagtgtcctcagtatcgcccagcacgtgaggcagccggttcactccagccttgaccagggccatcgcgggatcagagcctcctc

SEQ ID NO: 649 - DNA, 2524 bp, Homo sapiens
gcattgctgtgtgtctgccaccgctgcctggcactcatggggccgtgtgtgtgtgtatgtgtgtgtgcgcgcatgtacatgtacgcataagcgtgtgctgtatgtgagcctcctgggcatgggtgggggttggcattgcggttgccaatctagtgtacaaccagaaggacagagggatggagtggaagaaggaggggagaggcttggggtctgggaggggagaagagggtgcatgagttgcttcatgctgcctgcttacaggcattggcattgtagctgccacccttgtgcccacggagatgggaggaggcgagtggagggcgcagcggcaggagtcctgtgctctgggaggaaggctttgtacatgggagctgttggcatcacatctgtcaggccggtgcccagaactggggcaatggagactgggggatccaggaagcagggaggaggggcagaatgtgtttctgatgttgctgtccctctagaagctcagctctgaaaaatggttggagtatgaggtgattagtgctcttccagcttgaggaagtaaagtggtggagagagtagccagggaagtgccaagaaacagtctacgagccagggaggagggagtgtgccaccgtacccagggagaacttgttggggctggcaatctggccctttgtcagagtattgaaggagacagcaagaggaccagatgtgaggtgggtgggtgctggcactgcccatggcacctggcacaggctctggcattgtgtggaacaggggaggttgacagtgcctcttgccaatctggttgagagggctattgtgccaggagtgagaaggaaggaggtgaaacatttcgggaggtggggtgtttgggagaccagatttttttctgccaggtcctccttccccttccctcttaggcatggggagtggagcaacagacggagagtggcatgaagacacaaaggaggaagcacaccattgccaagaccccaaggaagaaggatggaaagcgctggcagtcctgcctggcccccagccagttccctgctgaagatggccagatccccttgtctggcctcccagctctggcaccagattgggatggtggcctgtccccagtgagaaggaggtggcaaggaggctgtctcttgcactttgcaagatgcttaagtagagacagggtttcaccatgttgtccaggatggtctctatctcctgactacctgacccgcccaccttggcctgggattacaggcgtgagccactgcgcccggctggaaggaaaacattctgagtgaccgtgtatgtaaataagtctttctggttattttattctgtgaacctgtgtgatgtaatgactgcatttaaatagtattacaacaaaaactaattgtaataatagtaaatagctaacatctttaaatgtttgccatgggccaggcaccgtgctaggccctcggcaagtatcacatcacctaatcctccacttcaatctgatgcaatagatgtagctattcattcctattttacaaacatggagactgatttagatgggttaagtaatttttaagatctcctgcttaaaaagaagtagagttgagattggaactcaggtagcctgatgtcagtacctctgctcttgggttaatttgtaagcttctgaactctggctggtatgcattttgaatgaggtcttttgagtctgattgtattactctgtgtgtcaccttgagcatatgtgctatcatgttccgcctgaaggtgctagatggctgtcttccatttggtttgtttcttagtataagatggaccagaagaggagcactgctttgcgcaactccagggtgcgtcattcacactgcagtccatgcaggggcactggccatgccctgtgtgaaggaagggaaggagcgggagggagggagtgggaacaggagggaagggatagataatggcgggtagtgttctttgaatgatatgtgtacccatttgtgacaacatctcttaaagttgaaggtctacacatgtgtatccatattagcatatgaacttcatcagacaagcactctccctccaacagagggagaccctgtctcaaaaaacaaaaaaaaatagcctttagagtcagacagacctggaatcaaattctagttctgtttcttaatatgtaaatgacctcaggtaagttgcgtaaagtctcaatttagtctcttcatatagagaatggggcaggccgggcacgcgcctataattccagcactttgggaggccgaggtgggtggatcattggaggtcaggagcttgagaccagcctggccaacacggtgaaaccctgtctctactaaaaatacaaaaaaaatgagccgggcgtggtggcatgcacctgtaatcccagctactcaggaggctgaggcagaagaatcgcttgaacccgggaagcagaggttgtagtgagccgagattgcaccactgcactccagcctgggtgacagagtgagaccctgtctaaaaacaaacacatcagaaacag

SEQ ID NO: 650 - DNA, 239 bp, Homo sapiens
accaatgtaatttgcttgtattttcatttttatgtatgggcaatataataaaaatgtgtctaatgaagtctaagaaagctttctaagtaagtacaaaattaaattctaagtgatttttcctatgtgtatatttttcttcattttccagactacatatttttgaaaaatgtaccattagtcttttgtaacttaaaacgagttctgttgtttatcatataaaatgaatgcttttttcccaa

SEQ ID NO: 651 - DNA, 563 bp, Homo sapiens
attctctctttgcctgctgccatccatgtaagatggggcttgctctccaccatgatttttaggcttccccagccaactgaaactagtcttttagaatccattcacaggacttgaatcctggatctgagtttgcaaaagaaatgaagctaatgaaagacaaggaacttctggtcttagttgagatgcaaaaagaatttcaaggagaagtcaaggaacaaaaaacaatggccaaaatcatgctcttcctcacggatgactttacttgctttccccaccaactgaatttgaaatcactgttatgtgctcccatgatacctttaactccatgaatttcatccaccatataataaggtagatgatattcatttcccaccaggtgaaagctctcaagtctggaagtcctaaatcaagctgagggctgagccacgcttcttccaaagcttccaggagaggacccttctttgcctcttccagcttctggaaaacatttccatctggctttcctctgtctgacttaaacaatgattttccatcctacctgaacattataatcatctggaaga

SEQ ID NO: 652 - DNA, 360 bp, Homo sapiens
ttctgttttagttttgttttggttctaaaaagttactctgatatttcagctttccaaatttattgagacttatggtctagcatatgatctgtcttgacaaaagtttcacatgcacaggaatatatatttaaactcaaggtgtgcagattttgttcagatagatagtgtctagattttctagattgtcagtgaatttttacaattgttttataagttacaaagagaatagtgtaaaaaatttctgctgtgattatgattttctttatctttagttctctcagttcttcgtgtatttggaaatatcttattgtttatacttttatgaacatcatgactgtaataaattttatcttttcctaa

SEQ ID NO: 653 - DNA, 782 bp, Homo sapiens
agaaatcttacaggcaaaggctattcgacatttgggattcctaagctaatctttttatttttggaagggtgtctttctgagaaaggcagccagaggcacagcaccaacctttctgacagtgtggtcttcacactgttagttctgacaaagggagtcaaggagtcgtccttggaggaggcgatgaggccagtggaagaattgtggctggggacccctccactgctgagggagatgtcgatggactcacagctggtgtggaggctgctgacagactgaaagcccaggccatccttgctaactgcggaggagctgctggcgttggtgccccagggccaagacagccccggcctcttaccagttcctggggtcttcagtgcgcctgccggggctgaaggcttcgtccttggcatggtgatgcccacctgagctgtcatgcctcgccgccatgagcctgtctgggagatgacaggattcttcttgcccgacgtgcttttgtcggactcgtcagacacatcagaaggattccgcctccacttggaacctggctccatttttatgccgctgtctgagcctccgtctgatttcttgacatcatcaccagaccacagggaattcctctccacctgtgagtgcttctcagcatcagtctgtggacagagactctctgaattagtccttccccagtcccaggctgggaagcccctcactccaaaggcaaaaatgccaaaacactggagtagttaagggaaaaataagcattactttaaagatgtttggacttt

SEQ ID NO: 654 - DNA, 2365 bp, Homo sapiens
cacgaaacttttgtctgtgtctccccataatgtgacctttagaagttgccaatggcccacccaatacccaaccatgatttttctgagataatctgcccgaggtgtgtgagaggaaacgcgaagaaggcagtcaggaggattcactcttgggggagctgggtaggatcctatctcctcctacatccagagcatgcaggctccatttagatacaaaggggtgggattgggttcctggggagaaattgagcccctttgattctgcggttctgtgggtctaaatctggcatctccttggctatccacccccaggctttgtgattggttggctgtggttggtgggggggcaggaagctgctggtggagctgcagcatccttcagtctcaggcccctgggagggggaggggaaagaaccagggctgagctgtggagtgaaggggagccatttctctccaccgactgcaacctccgtgctcacagctcacggttcaccagaatccaggggcttggtcggcctaggaatccacaatgctggatattttcatcctgatgttctttgccatcataggcctggtcattctgtcctacattatctatctgctctagtggcctggagctgcggccggagcctgctggagaacagctcagaaggaaggatggagatgaatggccgagtgccctgcttgctgacgcaccggtggatttttgcttctgctgttatctcggctcctggtctctccagtccaacaagaggcctctcatccacagaagcagtcctactgcccagcagacctctttcagagccttccagacatggctgacccctggcaagcaaggggctttttgagctgagaggcacttggctgggacttcaggaattcatggacagggctggcagatactgcatatgtttgagctgtagatgggattgagaacagaaagttgaaatggagacttattaaagttaccgtggagaactgctcaaaaattcattttgaattaaggaaacttaaattcattttaagtttccttagatctaaatgcaactgcacattacactcaaatatgttccttccttctcacacacaggactcccttgtgaaactcaaggggaagttcaagttgtccatcttcatctatgaagtagtcactttatcactgtctttacagattgcacagtctggggttttgtggtttctcttgtctcactctccagccaggaagaacttgtcatttgagtttttaaaatgtatcatttcttccccacctcaaaccacttgtatcccagtttctcatttaaagggagaaatggttatatagtcctctctttgcacctgattgaattataaatgatagaaacaagatggctatacttatttaggaaaaatctcttaccccaaaatgagtgtgtgtgtgtgtgtgtgtgtgcgtgtgtgtgtgtgtgtgtgttttaatcaaagatcttttctggaaaaaactttccacatagttctctgacccattagagttgaagaaactatgtattttgggattcagagtagaattggcctgcaaatctggggtgtttattccttttacaagtctatcataattgttctacatttaattttcctttcttgcttaaaagtaaacaaggagagtcaggagtggtggctcatgcctgtaatcccagcactctgggaggccgaggcggatggatcacctgaggtcaggagttggagaccagcctggccaacacggtgaaaccccgtctctactaaaaatacaaaaattagtcaggcacagtagtgcgcgcctgtagtcccagctacccgggaggctgaggccgaagaattgcttgaacccgggaggcagaggttgtagtgagccgacatcatgtcactgcactccagcctgggagacatagcgagattccgtctcaaataaaataaaataaataaataaataaacaaggagaaagattagtttttagtaataacattgtgtccaatttccatgttttaaaacaaaaattgaggcattatatgtcacaactgaaatggaaaagttgtgtttaaaaattatggacaaggccgggcacggtggctcacgcctggaatcccagcactttgggaggctcaggcaggaggatcacttgaggtcgggagtttgagaccagtctgaccaacgtggtgaaaccctgtctctactaaaaatacaaaaattagctggtgtggtggcaggtgcctgtaatcccagctactcaggaggctgaggcaggagaatcgcttgaacctgggaggcagaggttgcagtgagccgagatcacacctctgcactccagcctaggtgacacagcaagaccccatctcaaaaaaaaataataat

SEQ ID NO: 655 - DNA, 922 bp, Homo sapiens
ggcagtgtgtaagacgctcacgggcgcgcggactatcgggcggctaggctctctgaggaggctgccacagtgaagcaaccgtgacaagtggtgcccgaccagggacctgaacgaggaaggtctgccagagcagagaaagtgaaactgatcagacgaactacgaacccctggacgggagagtctgccggcggagaatataaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcgtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttcaaaca

SEQ ID NO: 656 - DNA, 2177 bp, Homo sapiens
caaattgtgatatattcatgtgttggacggcagtaaataagatgaaacctgaggagtcagatccaccttcccccattcatagaggcttttcagcctcattttgaggtacagttacatatcttttgccttttgcccccgtgcatagctatctacagccaatcacagatcacagagtcactggactatagagctggaaggaagctcagagacaatgccaagggggcagaaaatttatcagaagccagtcccagtgcgtttcctccatttccttctgcaggaagactattttgggctgcctgaacattgtatcaaacctgctacctatactatggtctacctttcctccagtggaattacaaaggcactaactgaaatgccttctagaaacagagaaaacgaaactgtacttatttactcttgatacacagattatttataaaacagattgaagtaacctgttaactggcaaaaagagaatgagatcggatttaaatgtatggcagtaagtcctattgatccctccagttatctcagtatgactgcagtatattcattcactaaaaccactcactagataccaactacacacctggcactgcagatgtaaaggtcagtcacacatgttctgactttacagagttcacagtagcagtggaggatgatatatgtggaaacaaaaaaggcattgattctattcagagcactgttagggctcaaaggagagaggggtctttccacctaagaaatgaggaatagggtcatcatagaagtgaccttaagtcttaaaaattaagaaggggattccaagctgcttcagacagagacacatcgagctaaaacacagaggtatgaaagagcacagggactttaggaattgcacagttcattctaacaggaacaaaaggctcaaggggggcaagaaatgaggctgtatggaaagagattcaatgtaagcactttataaaatagattaatttctgattcaatgaagcatttcttgatcattgtgtacaaggcactacatgcatcatggaaaattcattaggatgcattgccagcactttgcagaactgatattattcagcctcaagctttccagtggccaaagggaaatgctgactgcttttcatatatttgagtcaaagattttttatatggtcaatgaagactaatataagggcagtgggattttcacagatgcatgccatgttgtcgagagcctcttagattttctcaactgtgagaaagaaaaacgaaaatgttgaagacgttgagtctggagaggggatactaatcactgtccagttgggcactggtgggaatggggaaatggcacaggaatgcaagcctctccaccctaccccccgaactccagccatacactcatcgtttcacaaaatataaatgagttagcattaaatgtttcagagtaaataattccttttcccgaaatgcatgaagatagagtaacagacttctcacactgtatttttagggtatggagaatttagaaggttaaagaattactgcttcaatttttcagttaaaaaaaaatcaggaagctctgttcattcaggctatgcaccatgtgcacagtcaagaattagcagaaaccctctgcatttacaaacactttgtgctataaaaaagtaatttttaaaaagccacgtgtgtgtgtgtgtatatatatatatatatatatatttaaagccaaggttttgatacttttttacaaaaactacaagagaaaacaaatatacctgtccaaaccatatacttttaaaagagcatttttttttccatacaagctgttgttaatttgggggtaaagtgctgatttgcaaacttcatcaaattgttcccaagtggattctccttgtttgtctccccctaccaaccccaaagttaccatatttgatgtaagaatcaggcatgttagaatgttgtgtcacactaactgattctgctctttttgtcttgtcattcaagttccgttagcttctgtacgcggtgccctttgcagtctggtgtctcttccagaggcgagggggctgaggatggggtgctgcatctcactagctatactggcatcatcttggtaaactgaaaaccaaatgtggacatttgtaaaatcagtgcactgtttctagagagagattaaattcatttaaaaaaaa

SEQ ID NO: 657 - DNA, 873 bp, Homo sapiens
agtcaatgactcagggtagccaccgaacatgatgctcgggcagtgggtgccacctggactccactctcccctctctctgggatcatagagtccaaggtgttctgtggcctctcggccaatcccagcagctcagcgtgcagaagaccgaggagccattggtcagtgtaggaggtgcctggagttttggagatgggatccacaggtctcttcacaccgaacgcctcttcccctcttgtgccagcttgatgctgacttcaatatgtttgggctgctgggcccatgggaggagaaaggctgggggaattcaacacaacacgaaataatcaacaaattcggggaatgttaatctgaccatcaccagttacaaatgatgtttcatgctaccttctattcctgccttcataaatcaagctctaaatctccaggaaaaaatgtgctcaggatggccagagaaatgtccttccaactgtgcatggaaaggtatgattttgtgcagcaggtgaaggactggttagagtaagtgtgtgctgagcttttgtgtttgaaagcgagcctgtgcacttctaacgattggaaggtttccttgccttctccgatcttacacacagcaaggacagcaaagccttccagacctgcctgtgacatgcactgcacattctaaagatgcctatgcaatggaaaacaccactgtctgctccagcacagctgccattcttccatcttatcgaccttaatgcaacaactcctcacaggcagagattttaaaatgtgttcttggcagaagagagactcaaagatgggacaaatgtgtcatttaaatgcctgttaaaatggaaacagacatagtatagtcagaggattgtggcagctaag

SEQ ID NO: 658 - DNA, 174 bp, Homo sapiens
gaggaatcctgagcagagccccagctcctgtgactgccgtagcccttgcgtgcaagagggctggccagggcttgtgggtggacttcaaaccaacacttgagtgccctcaccaagtcttggcccctgtgtgaattcctgcctttcccagaaatgagtccagggtgtctgacctca

SEQ ID NO: 659 - DNA, 3505 bp, Homo sapiens
agcggagccctccctgctcccgggcggctctggaggagctcggtgtttgcctctagcccttcgctaccggaggatcaggttcctcccctcctccccctccagctccggccgccgccgccgccgccgccgcctccttcttgcatgacacagcagaaccgcagctgctgcagcaatttcaagccatccgcccaggaagcgccgcaaccgggactcgggaggggtggagggggcgaggcagaggccgcggccccaggggatccttggccccactgtgcaccacacactcctttcccagcccaggggcacgcgaacaaaatgaggctcaagctgaccaggccgagccggaggaacgctggggcttggcagcagaagggatgggaccagagagaagggtgtggaggagaccccagtgagggccaggacatttcaggtaaagagaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgaagacagagtcttaccctgtcacccaggctggagtacaatggtgcgatctcggctcactgcaacctctgcctcctgggttcaagtgattcttctgcctcagcctcctgagtagctgggactacaggaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttaggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactgaagtctaggcaagtggctgagctaggtttgccatgaatcaatctgctgagtatatttcttggtaactagttcatctttccttaattcagtcaacaaatatgatatcaagtttagtaagatgatgacagttgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattaaaggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatc

SEQ ID NO: 660 - DNA, 837 bp, Homo sapiens
tggtttagcatgctggagctggttttctgcttggtagccctacaactttggcccaactacttggcctctgggactcagattcctcctctttaaaatggtgctaataatagcacccaccctctgtgaggaggatgctgtgaggacaaaatgagatcatccacataagccgtgaaccctgttcctggtaagctcctggaaagaagtctatggattatactcaacctacactccagttaaaggaacatctacacacagaggaaatgaataacatgaagtgaagtcttcatctccattcccaacagtccccattctacttgcagaaaggttgcttacactgaaaatcagtttattttcccctggtgcaaagaacagtcgtttctccaaaactgaagctggaaattatctgaaatatcaggtcctccggaaaagggacgtgaagccccctttgtaatttctgcattagcgtgctctcctggcaagcaggaaacctcatcagagaagtcagccaaggaaagtctttaaatggaaattgtgcaaacgaggagcaaatgcattaaaaagttgctgacgggcatgaaatgctttgatgtgaagacggaaaactccaagcaggaaggattttaacattttgaatctgattgactctgtggtttctcagcacagttattccatgggctaaaataaatgcagaaatggtactttcagaccacagctgcagaggggatcgtggtgaatttcaatgaaaatccatttgaatcttgaggttcagatcttaaaaaagcaaaggacatgagagaagtaatattgttgcttgaaatttcattgcttatatctaaa

SEQ ID NO: 661 - DNA, 238 bp, Homo sapiens
tggcaagaaaaagtttctgtgaagatggcacttcttagcatagtcctcgcccttattattaaaagatgcatttccactttgacagtgatttccccacccgagagcctggttgggcagccctgagccccttagccagtatctttcccatcagctagcattagctgccaccagtcctcccttctcctccctcacctcttcagggtgtacctggagcagctattaaaactctttaagccgt

SEQ ID NO: 662 - DNA, 3482 bp, Homo sapiens
gtgctgaccgtggtggctgagaggctacaggaggcactgaggggtgctgggggcttgatgccaccaaggaccccagaccaagtcatcttttttttctcgctcagctttgaagggaagttaaagacaaagaggaagaggctgtatttcattctcccagatggctcctgccagcctccagagaaaaggcagctttcttctttagaaaattggcaggacaaaagaaggaagtcgacttggaaagtccagcgacagacctcgtgcccctgctctgggaggccgcaggtcaatggctccccctggcttcaggggacacagctcaagcctggaaggagcccatggccagcctgaaagccttgctcacacccagcatccgcagctggggcaagagcggctactcccaagacaggaaaagacacacagcctaactttgccactgtgaagggagacttctctctaatgcctaactagacacttatcttccaacctcctcaaaatgccttcaatagaagtcccaggaagacacggagccccagccgcccactgactcctacaggatgcagctgcgccaggcagcccatcccagggggcccaggccaaagaggggccagggtgcttcccctgagaatgaaaagggatgtcgggtagagggggagggtgatgtgggactcgctggtggctgttaaaggagctcgcgtctcggttcctgcaggaaaagtgctttgagcactcgcctggcctggtgaagaaggaaggcagttggcgggcatttttggaagctctcaccccccatgctggtcctggtaccccttctccagggatgcggggcccacattcatcacagtggggttccatagatgatggtcctgtcatatcagggttcccattgaagggggccctttttggcactttcttttattccattagtctgtttgcctggtcacacattttattgctttttcccgcaaaagaatcaatgtgggaatttatttatttatttattgagacggagtctcactctgtcacccaggctggagtgcagtggtgcaatctcagctcactgcaacctccgcctccctggttcaagcaattctcctgcctcagcttcccaagtagctggaattacaggcatctgccaccatgcccggctaattttttgtattttttgtatttttttttttttctgagatggagtctctctgtgttgcctaagctggagtacagtggcgtgatctcagctcattgcaacttctgcctcccaggttcaagcaattcttcctgcctcagcctcccaagtaggtggaattacaggtgcccactaccatgcctggctaatttttgtattttttagtagagacgggatttcaccacattggccagattggtcttgaactcctgacctcatgatccacctaccttggcctcccaaagtgctgggattacaggtgtgagccactgcacctggctgattttttatatttttagtagagacgggtttcaccatgttagccaggatggtcgcaatctcctgacctcgtgatccacccaccttggcctcccaaagtgctgggattacaggtgtgagccactgcgcccagccaggaatttatttttaaattaaatttgatttatttagtttcctaacccttttattgtttttaggcaattttttgaagtataatatgaataagaaaattatggtgaattgttacagcatcgagacctccaagaccaggacatagaacaatcccagcccccagaaacctccaccccataaggctccacaacccctcttctaacacacagattaccttcagctcttcttgaacttcatataagtgtgaaactcacccatgctgttgaacacagcactgtttcattcatgtaagcggccttatagtattccattatgtgaacgcagtttattatccgttctgttaatcacagtagtttttacctgttgtgagtaagggtgtcacaaacagcctcatgtgtactttgtggcagatggaattcttgtacagatgtggaacatacactggatttgaagtgctgggttatagagtatgcacatgctcagctttatcaaacagggcttaacagcttttcagagtggctgtgccaactcacactctccaacagtctatgggagttccagttgccccacacccttgccaccacttgcaattgtcagctgtaaattttagccattttgtcgggtgtatattggtattttattgtgtttttgatactcgttgctcccgcaatcgttgaagttgagcacggttgtatatgcttattggcaatttggatactgtctttgcgttttcaaaaattgggtttttgtcttttattgatttgtagaatttctttattctgaatttgagttcttagttgtgcttgtgtgtgtgcacatagtaaacacacacacaggttaaaataattgggagatcattagaatgagatgaccccagcgccttgggtttcaactcaagcaaaccaaagtccatctcagtgtacatggttatagttcaggtaagcagaaaccaccggctgatctctaacacggggcttttgactggaatgatttctttccctttctttctctttctttctttctctctttctctctttctttctctctttctctcttcctttctttttttctttcctatctttctgcctttctttccttccttccttccatccttccatctctttctttttcttttctctttcttttctttctctccctctctctttctttcctccctccctttcttccttccttccttctttccttccttcccttcctccttccctccttcccctccctccctaaaattcatagaataaaaaaatgcctgaatagccaaagtaatcctaagcaaaaagaacaaagctggaggaatcacattacctgacttcaaattatcttacaaggctatggtaaccaaaacagcatggtatttaggattgttttcccaattctttgaaaagcgatgttggtatcttcataggaattgcattgaatctgtagattgctttgggtagtgtggtcactttcacaatattgattcttccaatccatgatcatgggatgtatttccgttggtttgtgtcatatacaatttctttcagcagtgtttgctaggtctccttgtagagatatttcacctcttggtcaagttatttctagttattttattttactttttgcagctattgtaaaagagctcgggttcttgatttgattctcagcttggtcattgttggtgtatagcggtgctactgatttgtgtacattgattttgtaacctgagacttcactgaattcatttatcagcaattcattcatttttagaggatacttggtccatgcacatgtcagagattgttgtaatgtttctttcttgcaatgatctcatcacattttaatcacaaagtcaggctagtcttttaaataaagttgcaaagcattaatc

SEQ ID NO: 663 - DNA, 637 bp, Homo sapiens
agttctggaggctggaagtccaagatcaaggtgctatcagggttggtttcggctgtggcctctcttcctggcttgtagacagctatcttctcgcagtgtcctcacgtggcctctttgtgtgaagttaaaaatgaacagatcaaccttttactcttctctgaaaaatatagtgaaattaataatcaagaacgattttctgaaatgaaaacatccgaacagcatactgcaaagacattcaggggaaaataaaataggttttggcaaacgtctaatgacacagagccaccattgccaatttcaccactgtctttcaccaagttgattcattttgaactggctccagcaatctactcagagttgacctcagagcaaaaaattgaagtgggaagctgctaaagaatgtgcttgactaaaacaaggcaataagcaaaaggaagtcatagcatccagaaaatgggatccatcatgcgcacaaagaaaaggtgaagaaaatttccaggatgttcagaacccaccaaaaacgaaagattctggtccagatcagaagagagggaaacactctgaaaaagtccctcaaatacaaaattaaacagagtttaaatgatgtgcttgaccacaataaaaggcttcttgctct

SEQ ID NO: 664 - DNA, 525 bp, Homo sapiens
ggagttgccagtgcttacctgttccctcggtatacagggcagggaggtcctccgatgggacttgctgctgcagccggacatctcggcggacacgacggagctggaccgcctcctcctcttaaacaccgggatatcttccttggtcccagcaatcagctgggaccccaaatgctcccttggagccgcctccgcggactgcggcaagatttgttccacgtacctggccaagaggatccccagcacgccggccaggtacgccaggtaaggtctccaggcgaccttgaacctctctaaggaaatgagggacacggtcctgaccgcgctagtcaaggcgatcatgaggacgcccagcctcagcctcagcaccagccatgtcgcggcggccaagcagctgagcaccacccccgcggcggggagtgagaaccttactaaaaagtcaatattcctacccaactggatcaagattgtagaacacaaggatgcatccttaaccttataaaaatgccttggaatttttaatgagca

SEQ ID NO: 665 - DNA, 646 bp, Homo sapiens
gagaagcatgggggccttgggatagttccagaatgaggatgtgcgtttctagctgctttgcgccctcctcccccaaaaatctgctaccacaattccaacccggcggcacgcccccaagactcctttgtcgccccaggggcgggacctgagctgtcgatttcaggagcccttcgtgacttcaaaagtcctgggcactgttgctcatgagtgctgcacaactgtcgccctctaaagccacctccatccctcactgggctggcctcctgagccttcgaaggaagcccggtgccagccagccttcctgaaagaccaagcccgcgccatccggcttcctccagtggacgcctgcaggacccaggtgagacacggaaccggttggggacgcgagccagggatcctgaccggttgggggcggcgagcaagggatcctgacttgggggcgttgcctcccggaatccaagcggccttttgcccgggtctcccgagatgcatcgaaattgagctcgtccacacagccccctgactgcgtgatgcccttttctgacttaaaacattccttgtacctttatttacacgatccaagttgcagtgtgcctagattttcctccaaggacaaaaatgtgaataaagcaatattttagccaaa

SEQ ID NO: 666 - DNA, 1704 bp, Homo sapiens
ggaggttcagaagaaatagcacagagtgaggacagcagaggtaaacatgcctgcagaaacctttctcttggcatgcagagcaaatactataatccaggtgtctcagccaatgaggcatttaaacagatacagaaaaatcattaaagaggatttcagaagggtatgctcacctggacagattgcactccatccttccagtgtctcctgaactgctctccaggaatcattttcatcagaatcactggggcatttatgattcaaaaatgctttgaatgtggcagtgcctgaatctacagttttccatgtgatttttagatatactaatgtttgagaaccactgctgtcaacagcataattctgtaagattcaaaatactagttgtaaagagttaatttagctgaaatgcaaattttgatttgacctgctcccaattccagacctctgaaatcagtaatgacaagaacctttgggcattttcaggctcagtcttcagaggcttatcctatagagaagaggaataatttctgtagccacatcccaaagtaggggagatgggccactaggtacacagctgcctttgtgaagaagcagagtaggaaatatctaccctgcaatgattggggcacaggaaagctggaatccaccttattacaacagctggttaatgtcatactgtgaactcattgagcacctgctttgtgagtattcattttctatttttaaattttgcatcaaccttgtgaggtttttggtatgtttatctccattatacagatgaggctgctgaggctaagagaagtcaagtaatttgcccaaggtcatattggtagttaatagaactaggacagattccagggttgtggtttgaatcaggggttggcaaactatctggcccactgcctgtttttgtgtggcttgcaagcaaaaaaaaagatgtttacattttttaattgttcaagaaaatcaaaaggagaataatattttgtgacaagtgtaaattacataaaattcaaatttctatgtccatgtatttagttttattggaacacagccatgtccatcatttatgtattgttaatggctgttttcatactacacagcagagttgagtagttgtgacagtgaccttatgctcttgaaagcctaaaatatttggtaaatagccatttacagaaaaaagtgccacctcccacttgaaccattatgcctgcatttctcaaacttcagccatttgaattctactccttcatgattcttgccaccttttcataccatctggaacattaactgtgtgacatttttctttagatcaattaattttccttaaataaatttattttataaagaaacaaaaatgaaagcgaaaaccagtaccaattgcaagaaatagaagaaaactgtaaaaacaaatacaatataccaagaacagtgtattcatattagatttcagctaaatagctggaacagacaatgttggtgttgcttcatttccctgcagatcccctgaccatttctctgtaagccatcagacttccaatgatggacctgaaacatttttggagggctgctctcagtctactggaatcccctttgcacacaagcacaataaattgggggtgcctgagaatccaagttccactgtggatagctctaaccaacaaattgtgggtgcgggagtatccacatcccaccttcctatcccct

SEQ ID NO: 667 - DNA, 533 bp, Homo sapiens
tcatgtagcgccagccacaccaggaacagaagggtgccgggtaccttccgcatgcttggtattctccccgcggggctctgaccgctgccgctctcaggcacctgtctttcctctccgtcccagaatggagccaagacaagggaataaacgaaattcaatagtacacggagatcgggtgtctgggcagcgtcttggaaaaactatccactacagtacaggtcaagtgaagttcttctgctgatatgttctgctactgcataagagacggaatctatgttgcctcgactggtcctgaactcctgggctaaagcgatccttctgccttggcctcccaaagtgcgaggattataggtgtgagccacccaacctggcctttgccagtatttttaaatccaaacacctatgcatggtgcttactaataacacagtggtattctaaacatttttcacctattatttaatctttattattatcaccatgttacagataaggaccctggctaaatagcttacccaacattactccgttaata

SEQ ID NO: 668 - DNA, 539 bp, Homo sapiens
ctggttctcctgcaccagacgccgcacctgcgcccgcagcttctgcttctctgattctacagcccccaggtggctcgacaatgccaagatcacctgtgcaaccagcccagcctctgctgccacagccagtaggttactgctccctgcctcagggctagcgcttgcccacagaactctgctagatggctgaaggaccacccaaagactccatccccacttctgctgaggggccacagcatcccctgcctttctgcagctcccaggtcttgctggacctacctccagaacatccagaactggtcccttttctccaccgtcatagccaccccttaattccaagcaccagctctcatttgaattccagcagtggcttcctaaccactcattggagagtgattccatcctcgacccactgaggtttattctccacatctcagccagagagagtttttagaaactcaagtcagactgtgttgcctgcctgcttaaagccctccagaggctttctgatttcctgagaataaaacccaaaccaacca

SEQ ID NO: 669 - DNA, 478 bp, Homo sapiens
ctccccagctggatgaggcagtggctgaagcccacctgggcaagctgaatgtgaagttgaccaagctaactgagaagcaagcccagtacctgggcatgtcctgtgatggccccttcaagccggatcactaccgctactgagagccagccctgccaagcaccaatggccagagacctgggggttcttggtaaagctcatccctgtgaaggacagtgaacacagatcaagaagtatcagctggaccccagcatggaggagcaactgcagacttcagcagactcattcaggtcaatcacttgatgtggcctcttactggcaacattagccatggattttgtacccttaggagctatgatgaaaaaaacaacacaagattaaatcaaatgcgagagaaaataatgtgcaaacaagagatgcggtaaacatgaaatatatgaggatactgtgggtataacatgacatactgttttacagtaaa

SEQ ID NO: 670 - DNA, 930 bp, Homo sapiens
atttgcttctccttctgccatgatcctaggatttagaacctggacctggacgcctcactgcttcctgcttccttagtgccttgtggcctggagtcagaataatctagctcaaacttgggagtcaaatgctccagggtcttgaactggtcagagctctcaatgccgcaaagacactttcagaagaggaacgaaggcctggaaggaaaagcatcaggggaacgacgcttacgtctctcctcctccctccggtctcccaccagtgctcccattggctgaagccaaccagaagccacaggcagacttttcaagttgtgctcccaagactggggaagactttgatgtagatccagcatcacttacctgtgcctccaggatgaggcatctgcagaaccaacgtcaattgacctggatccaagaacagttatggtgattggaaattgatcaaaatacggagatcaacgatgctcaataggaggaagagagagatggcaaggtctgggaaagctcgttcctttaattctcagggtcttaggatggaggagaaggagcctggagacaggactctggaagtctagaactcttcccaggggtatctgggcaatccccaacagagcacttggtctctaatttctcagagtggccacctgctttggactcactcaggaaacttattaaggatacagatgctttggtgcccttgtccccaaccaaccagggtcccagggtcaggactcaggggttttgtgagtcacaaggtctccagatgattctgagactttcaaccagagactttaaagtagggaggagaaaccaagatgcctgtccttcggctttatgtgctaacacttgccaaatgccttcaaatctgaggaaatgggagggaagagttcagttcaagaagggaaaacttcggcgatgacctggggtttt

SEQ ID NO: 671 - DNA, 2610 bp, Homo sapiens
cgcgggggcgcccccctcggccgggcgctcgggtttcagccgccgctcctccgcgccccgcccgcgcctggcccgctcgccggcgccgggagagacctcgtaacggaactgggacgccagcgctgcattgtgggagcttttaaagcggcggggagctcggcgcgaccctcgggcccaccgggccacgctcgcccggcccgcgacgcccccccgctgtcgcctggcccgcgacgcaccgaggcctgaggacccgaaagccgggcgcggggagatgaccggtggctcgtgacggtcccacgggcaaaatcttccatcgcccggggctgagacttgtcaaactgccctctacggtcacccggaaagtaggaggctttttctgcagaggggaaaaaaatcaaaaagagccgttccatcccccctccaaggactgggtttgaattgcttttcatctgcagtggctgtgattcagcgtccctcttagcagcaggcaatgacagaggcaggagaggggaaaaaaaaaaagaaagaaagaaaaaacacagcaaatgaatcaaacggacgtagcaggcaagagtgtggttatcgttggaccaggattcaggatctgactgagtagctgactcttaatccagtttgtgttgatcaccaggaggatctggacctcagtattaccacatctagagctataatcacatccctgttaagccttcctgagatcacaccaaatgtccttgatgggaattgtaaacaacccttacttctggtttctaatgatattccaggaaaggagcctaactagagtcagtgatatgccaactccacctttgccttccaccatgtttggaagctccctgaggcctcaccaggagcagatgctcgtcccatgcttcctataagcctgcagaactggaaaagaaagctggataaagtatttatagaagatagaggacctgtggtggctcatgcctgtaatccaaggtggaaggattgcttgaggccagaagttcaagaccagtccaagcaacatagcaaggccccatctctacaaaaaatgaaaataaaattagccgagcgtgatggctcatgcctgtagttctagcttctagagaggctgaggcaggaggattgcttgagtccaggagttcaagattacagtgagctatggtcacaccactgcactccagcctgggtgatggagtgagactgtctcaataaaaagacaaaaaggctggccaggggcagtggttcatgcctgtaaacccagcactttgggaggcaaaggcaggaggattgcttaagcccaggaatttgagatcagcctggacaacatggtcaaggaagcttttcctgatccactaactaaggacaatcaaacccttcatgatctagaatctggagactgtgtcttctgggaatagtatcagagaaagactgcccttactgcccacatgtagcaaaactttgagacgttgaattatgggtccataatctcacaactcagaggggcacctctagactcttggaactgtatatctattggagactttaaggtaaagctgaacagagagacgtttttctccagaagcagacagcaccatagtcatggacagctttcccaagatcacagatcaagacttctctgccgtcatgagactcataacctcttaattttttcttgcttatgcttctgtgaacaatagaattggaaaaggggtggtcccgcgtgcacccatagggtatacttttatttgtggaggattttgctgccaaccttatacatgggcaaacttatgccttcatggatggaagataaagggctaatatgggttagaaattttaatggtacctttgtttctccataatcattcagaaacagaacactggtccactcttgttaacctacatcataggttgaagagaacattgccaggaggccttcatccttccagatgggcaccatttgttgggtctttttccgtggtatgaagaaaatgaagcaatgattagaaattggtccctcggccgggcacaatggctcatgcctgtaatcccatcactttggcaggccgaggcgggtggatcacctgaggtcaggagtttgagaccagcctgaccaatgtggtgaaacgccatctctactaaaaatacaaaaattagctgggtgtgatggtgcacacctgtaatccagctactcgggaggctgagacaggagaattgcttgaacctgggaggcagaggttgcagtgagccaagatcaccccactgcattccaggttgggcaacagagcaagactctgtctcaaaaaaaaaagaagaaagaaagaaattgatccctcataataggctgtatagcagattctactgcaaaggctatggttgcacaacagacttctttgaatttgcttgctaaacttttactggataatactgggattacaggtgtgagccactgtgcccagcctctcctgtttaactgtattcattctaatgtttacttacttctttaatttgtaaaattgggtcacttagagtttttttagcctatcttgccatttagccactgttactgataatttggatggaaaagaaaaataaattatatcacctctc

SEQ ID NO: 672 - DNA, 874 bp, Homo sapiens
cagaaacagaattccactcttaaccccctcagtttgcagaatgtctaagtgtagtgactctagactcaatgtgagatgaaaagggaaaaaagaaactgcgtataaatagtactagagatttgggttataggattggtaattcagcgtgaagttcacggatgcctcttcaagaaacagaagcttcactcaatctggctttcaaaatggtgagaaaagaagtggactcacataattgaagaggcttgagttctggaagcttagaagtccatgactggggtcccagcatgcttggattcaggtggccttcagacacttcttccacaaggaaattgggcagcttcctgaaatgaacaacccgtaaagccatgggaattatggatcagctcccagaccttccgcttcatgactgcaagcctttgtgaaagtttctgacctctttatgcttcaggaatcttagcaatgaaacaaggataatggcacttgctgtgacgatcatgcttccaacagttcaaaaagccaagggaagatcagaagcttatcttccagccaactggggtgggttggtgggggttggtggaatttgacagaagcttgtaatcagccacattggaggatgaggggaaggcctgtcatctgttttgaaacgtgttacgacaagatgttacatttctggaaacctgggtgcagaaaaagatgcacttttctgagagtttgtgcggattgagtgaatctgcttcatttcagcccgaagttgctggagggtccttcgtcaggagacagtatatatagacttgccagaagtgcaataattattcagtctctttctcagtattaagccaatgtacaaaataattacacatctgcttctatagta

SEQ ID NO: 673 - DNA, 5278 bp, Homo sapiens
ggataatgcaagtgtttaacagatgcttcactattaaaatattttccccccaagtctcaaatattgaagaatctctaaccagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaaggtacatctcagatcagatccctctgggaaaagcgcgggaatgcttggctctagtagttaggagctctggtgagagcgcccctagtgccattttcccatccctgcccttgacagtcccctttggtctaaattcacggttctagacagtcaaagtctacctgctgggtgtccactctcaagccataggttttcaatcctaaaagggattaggaccttggctcaaaatgtggtcaacgcagtgttcaaattaggagggcagctgggagatggcagcaggggatgaaagtatgactcctacttcgtccgcaactgtgggtctggcacctcttgacttgccagtatgctggcaaacaacccatctctcttggagaatccacacttcgtttcttctaggtccagcctaaatgttacctcctccagggagcctttccagatactgcttctcctctctcccccaactccctcccacaaatgaagttttctcttctgaattccttgctggtactgtcacttatattcttttgggtagatctctgggcatgcatatgtcacctcctgtgactgtgggtttcttgacaacctaatcaatgcattgaacaaaggagatgtttagacaacccatataaaatgaataagagaaatagggtgaataccgtctaccccaattgcaatcagattagtttcctttattttgaaaacgattagaactagtagaggagttagatgtggcccactagggaacaaattttcatctccaagccgtcctctggctcgatcgggtctgcactgggtctgcatcaacttgcgctggctcagagggaggctcagccccagcctggccttcctggtgcccactcccaacatcctgagcagggccgactctaggcaccccacgattagctgagtgatctagggcaaggacctaggcgtctctaagtcttagtttccccatctgaacaatgtggataatgacacgtacctggggtgggcaggctagagtaaatgggaaaatcaaagcgccagccagagcgggtcgcactgttagttcctgtattttctcctcctgcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggttaaccatgagcctcccaccctcacctcccagaccctggtgccgggctaaggcctccgcttccctcctgaggtctcattaggaaaccctcaccgctattttcaacatttcctcaatcaagtgcctttaaatagagctgcacaaacagattggcggcaaaagcgtagatcttgtcacgattgagaccaatccagtatttcagccttgtttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtgcatgttagcggtttgctggatttcccttctccctcgctgttcaactgctagcatgatttgttacattttccacagctgtttattcttgtttgactttttgtacaaagtcactttaaatctgctgcagaaagaataaagcacctagccctttggatggactcctgcaggcgtgtggctgtccctggcccacttttaattctttggagatggctcttctgtgtaaatcagctgctgggtgcgttcggtcacctcgtaggccagcctagtttgtatcagcagaacagtagtggactcgactcaggtcgtaagccttatatttcacagacaattaaatcttggctgctgttgaacaaaactgtaatatttactttgttctataccgagaagcacttttaaagtaaaaaagaaaaaaaaaccaaatactacacttcaaaaagaaaatatgacaatgaatctctttttatggattctctctgcataagtggaaacaatatgatttaaatccccaacaccccatcccccttttcagacacagctgaagtgatacagatactgtcttctaacacataatctccctctctcgggagaggcacctgcctgtgctacattcgatttagtttgtaaggtttcaggcccctccccgacccatgtaatatgtaacaaggattatcaaataataaggtcttggatgtgaagtctgctttacacaagaattcaagaaagataggcaggacttgagtaattatgttacaacttcatattactttccaaatgaatacccattttcttctcatgtcaacttctagagatgggatgctgaggcagagaaatatttttatgagactctggagtacatactaaaatgtgcttccttattatttaagaatgtgtaaggtatggacctacatttgtttgctggtggtcataaaataaattcatagccattgtggccaataagcaatctccttcacgctttaaaagtttttggtttataatcccacctggattgtattttcactattctgtatcaccctcctattgcaatattttggttctcaatcttatgtaaagcaaacctcagaaatgatcgtttccataaaattgtgcaatggcaaagccacagaataatattttgagtccatatagccgtgcatgctcatctatatagctcttatacagttttctagctgattgctttggtatttcaagaaataggaagcagtagctacctattttaatgaaagggtaccatttcataagaattctattttcactgaaaaaattggtctggcacattattcaatgcaaaagattataatattactttcacgtgtgttaatctgtttagtataaaactgctagggtgtcttaaccattaacgcgttttgccacactactttcaaatggtgatctgagataattacgaagattttgatgttaatcccacgttaaatgaacaactatgaaaataatcttaaagcattattactcccatatacatgccagcaaacccaattgtggagagaacatgattactttttatctgacattatcctataaggatatggctacatttatttcttttaaaattggagcagttttcaattactttttaacagaattgttttcaacacagcattttgcagtgcccataaaccatagcaactttgtcctgatcgatacatatttttctgcattattattcattagcctctttgcaaactcactaaaatagaatagtattaaagtatgaatatatagagaacaattattaggttctacatatttatttaggtaaaccaatgttattaaaattaaaaacatgtgcctggcatataagtgcttcttcaggaattcttttttggatgcatagttattattttttaaacaaactcagattttcaaacactgattttcttctctgaacgggcattgcattgttttaaacagtagctcctggaataatgccacctttagtattttagactttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaaactgttttttactggatgaagaaactcaaccaagaaaatatatgtcgattcttgtatatgggacaatattagctgctgtgatttttaatactagcataaaatataagaatctttttattactgtgatattgttttttcctaaatgaatgcatagtgtaacaattggtgtcaaaaagcattgaatttttttcagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttctttacatttctagtaattttttctgcttttccaaacattgttaagttctatgcaacttgtgctattcaagtaaagatgatgtcagtaataaaattacagaatcta

SEQ ID NO: 674 - DNA, 547 bp, Homo sapiens
aatcttctctcacctcctagacacacacacacagaggcacctccgggaggctctggccaggcctgggtgtggcaggatagaaatgaaagttgtcctggcaacacacaagatttcatcaacatttccatccccagcagctcctgggccaagcctcatcttgcccagtgtggcctgtcaagatgacggcctggaagagaagccagactgggcagccaggcctctgcccctccccttgcctggtggcacagccagcactggctcactggtgagttgactaatttcctccgccaccattagttgtccatgttcattgctgcctgacacccaacaccagtctgcaagggcaccaggaggggatggaagagacagggtgtctggggaagggtgggtctgagtgcgagggggtgggtgagcttgtctcagagcctgacgctggctggtggtatctgcgttacccaggctgacccagctctctctgatgcagacaggcgagggcctcacacacttcagagaattcacacccacatgatgaggctgagaggagcag

SEQ ID NO: 675 - DNA, 493 bp, Homo sapiens
gccatctttgttaagggagagtgggcctgtctcatccattgaattcacaaaagaaaaggggcgtgagggaggaggtctttagctgcaaagacagagactctaacacgcgtaacaaaggcccagagatccgatccagacacagagcaaggcagagacccacagaggttggatgaggcaataagagagctgggaggagagggagagtggggaaagtgaaggatacttttttttcggacagttacagagtcagagagacccagagaaaagcagagatataaacaagagaccaaaacagtgggattgagaatgtgcaaggctggagtgcagcgcgatctcggctcactgcaacctctgcctcccgggttcaaatgattctcctgcctcagtctcccgagtagctgggattacagtatgaggatcttggcttttagatggtcccttacctggtcctgctgctcctctgcttcaaggtgtccattcatctgctggtcct

SEQ ID NO: 676 - DNA, 200 bp, Homo sapiens
ggcccactgctggataaaaggtgcagcacccactggccacttccacggtttacatcttgcttcaaggccttgtgcccgatcagctgagcccctgtgccaaccctcaggttagaagctgctaagacaaatacgagatcttctgagcgtgccagcccatccatctgcaccagtaactctgtcttcatccgcaggcttccttc

SEQ ID NO: 677 - DNA, 459 bp, Homo sapiens
ttcaactcctcctcctcctccctctaatgcctgtaactcacatccgaggctgggcgaggaatccggaggggagattttcctcatgctcacggttgttggaaactggaagagtgagaggaaggaggaaggggatttgtggcgctctctacctactacaagactgacaaggggagggggcacctaaatttgcatcttttcttcgtggtgattgagaactgcaggttcaaaccgatcccactgagcactggcgattgattataaaaaaaaatcgacactgggagaagggaggctctgtcttcggctgtcagactcaatctcggaggtggtattgggtgtctaagctgctggattgcttttcgcccaaatcaatgtggtttctttggaacattttcagcaaaggaacgcatatgctgcagtgtctttgtggcaagagtcttaagaaaaacaagaacccaactg

SEQ ID NO: 678 - DNA, 4733 bp, Homo sapiens
tctgcactacttttatcttttattttctttccttttcttcttaccttccttcctactctcctttatttttggaagctgcattcaccctactggaagaacctattctgaacataaagtaatttgcctcatcctgcttatccccatgacaaatagtttaagtagcatctggtgagacaagagaaaagagtaactatacatttacccttctgcaccctcatcttctacccagctgtctctcctcccttttcctctttatcaatattttccccttctttggaccaactatttaaactgttcttaaaatttattaaatagaagtggacctccagcaatttttcttgctcctataatctaaagtattcaaactcctcacttgaaacatgaaagaaaatcaggatgtaaacgttcccctttttaaacttttttattttctaaaccatcttcctctgcataaagtcagtctgccactctaaacagcacttgtcaggaatgtgtgaagttattaaaagagaaggaactttagaagatctaaattcaaattaccttgactaccattctttagtaataaaaggggagatagaaagaagacagaaaccaccagattttctaaaatctccagcaatattcatccatctaaagcatctgagaaacaatgacccaagttatattgggagagatattttagctctcttgcctgaatctaactcacagaaactggggaaatatcaaaaatcacttattctaaatgtttcggtcaagaagtgttttggatttcagattttggaatatttgcatatacatagtgagatatcttaggggtgggacccaagtctaaacacaaaattcatttatgttttatatgccctttaaacaccatagcctgaagttaatttaatataatatttttaatagttttgtgcatgaaacaaagttttgactgtttgactgtaacccattacctaaagtcaggtgtggaattttccacttgttacctggagtgcatcatgttggcattgaaatagttttggattttggagcatcggatttcagatttttggattaaggatgttcaacctgtattagatagcctggtgcttttctcctcataatcactccaataataatgaaaggataatcataaagatgacaacaattacaacaaagatgataaaaaaaattaagccacttggcaacactatttgtggcctcatgaaaatgactcccaatgtcataattccctctgagatccccacaataaaaaactattggaactagaactgcataccgcagttattggtcatttcacatggtgccatgttcaggcatagctggtatgagtgctatttgctttcatccaggggagccattctcagtaagcttcatctctgtgctgatgagagcctgggtctgttcttctagcccaggatcttcacatctctcaaaggactgcagctctccttagatattctgtgtaccacaggaaggggctgtaccaatttacagcaatctcttttcaacatggtaactaatgcaagtattagaccacaaggcttctctttggaaacttgtccaaaggctgtcatctctgctattcattcattcattcatttagtcaacaaatatttattaagcaacaaacgtgtgcaaggcactgttcttggcatagtgaacaaaacagattaaaattctgatcttgtggaacttgcattctaataagggagacaatttttttttaaaatgaagtaaaatagatagggcgatagggagtgctgggcccaggaagaaagggttacaatactaaatatgatagttagggaagccctcaaatttgaacaaggatctgcaggaagtgaagtatgttgatatctggggaagagggaacaacaaaagcaaaggaattgatacaggaatgttgctggtgtctgagatatggcaagcaggtctgggtggccagagaggagtaaagtaggaaaaaaggaaaagtaggtggggttggaaaaataatggggagccaagactgggtaaggttttgtaggctattgtaagtacttagacttctactaagtgatggaaagcaactgataaaagttgactttcaattggaaagagccatgaaagttgatggatggtcaacttttgacctgaggaatgacatgacctattgtaggttttagaaaagtccttccggtagatttaatgaacattcactgaaagataaaaaagagggtaattgaaataatccatgcaagagatgattgtagcttggataaggatggtagtagaggggtggtgagaagtggtaagagttttgctgaaggattatacatgggttgtaggtaagaaacctcaaggttgataccaggatgtttgatctgagcagctagatggatgaagttgacatttatcgcaggacagttccctgaatggccctggacccacccagttctccccctttcttgtttacagttaccaagaataactgtaaaatgtgctgggaatgcaatgtcctgagataaggaagaactgcctgaaacagcctggatcttattcctgtacttcctagggaatgtaacatctcaagttaaagaggaactgcccggaacagcccggggattgttcctctctcctgagaaggaagattacctccaaagctcatccactgagtcacactgcccctgtggtggagggcgggctgcctttccaggttcctcagctgtggtgtaactgaagcaggcacaatcaagactccatctgctcgaggcagctttctcgaaccttggggaacctactcacaatggatcacaggcttcttttgttttgtttcttgctgcctatctgtaagtaattaacttgcttcatgtaacgtgttgcatatgagtgtgttctgtctcatagactcagggaattggtaacactgcagctgaggacgcagtggacagaagtgttcagactcctgttccttgtggttgacacagtgatgatgatctcttctgtcctccacagagtggaagtcctctcttgggattggttattggtgaaaccacttcgcaatttattaagatggcaaaagcttacggagggacagatttgaggggaagatcaagatttttctgtcagtattgcaaatagtcaagaatatgtggtccaagaagtgatcattatctttggcattgtgcaagtcattagtgaccttcacatgaacagtctcagtggagtgttggaggaaaaagcctaactgaagaaggttcaagagtgaatggaaaaagagcagtagtatgtggagagtacagacaagtatttccaggagcctttctgtaaagagtggtagagaatgggacatcatttttggatgggggaagagttatttatagcatgttcatatgctaatggaagtgatctactcatggggaaaatcttgatgatgcaagaaagaaagggatttgttggaatcttgtcctataacgggtgagaggggatgggttctagaagaaaaggcatgggtctttgtttgagatcaggcaattcatctgtaggaaccagtaggaagatggttaagtgggtacctgtggtagtggatgtttgtgaacattcttttcttttccattgtttctattttctcaataaagtgggaagcaaaaatcagctgagtgaagatgaggaagaaggtgttaaaggtttgaagaaaaaaggaaaaggatatactaatctaagaggacaagtaagtagaacatagataatgaaaatgctggcccttaggactgttgggcctaaatgctcatattatattggtagtcacaaatttgaactttctctagagccaatttttgcatgtgtgtgcaggcctggagtagttggagagttggatttaatagaattgagggtcaagcaactacaaccagggaagagtgggacaagggagataaaggatattggcaggggagcaattataaacatggaccatgatcaaaactggacaggaaggaaaatagagataagaggggtggaaggttaaaaatagtgaaaatgagatagaatgaataggttgtaggtccctgtaaagttgaagaagtattattatgcagtactcgttattgaaatgaggtcactatgcttaaggcacagtgaatcctagaaaatagtggttttgtttctcattaggcaatacattcctccttgctccagaatgcaacatacatgtatccttttctgtactattttttattaagaattcatacttaattccactgactgccactcaattttaatgtacagtagggaattcctgtactatgtattatgaatccattcctttgaatttcatttataatacttcatgactgacacctggctttccaccaagactcaattttcatagcaagcctcatcatcataagcccccaaattaacaggatgaggaggaagaattggcaggctaaagaagatgattatatcaattaatgcagaaaaagcatttgataaaatccaatattcatttgtaattaaaaactctcagcaagttagggataggaattacttcaacttaatgaagagtgtctttaaaaaccttattttcatcagttataacaaatgtaccactctggtggtgaatgttgctaaggagggaagctatacatgtgtggggaaaggagatgtgtgagcaatttctgtaccttctactcaatcttctgtgagactaaaattgctgtaaaaaataaagttcatttttttaaaaa

SEQ ID NO: 679 - DNA, 2843 bp, Homo sapiens
aggctctggggcactccctctgttcctagttgaacttgggtaaggaacaggaatgtggtcagacagggtcagtgggagggctttggccattctgagccaacggtcctttgttagttggcctgaaagaagccatgacttagaacctgaagctgtcaggtggcaagaggccttagtcctggtgtttgatcctggcatagttctgggcctcagtctccccttctgtgaaatgggaataataacctttctacctctgacccttctcctgagtggctatgagggttgtgagagtgaggtgggccaccagagctccctgtccaagccaccgggagcctctcttctgtaggctcttcaagaggtggacctagagtatcactgtgccagggggattcctaagctctgaccctgcctgtctctgctgctcctgccccatctccctctgatccttctcctctgcactgtcttccttttccccttatgccttttctaccctttctgctctggcttttccttatactctgaggagccatctctggaaaaggccccactttcccagacccaggtgtcctaccaggccccaagttgtatccctcgtgctgcttaggccacgccctgcaggatgttctctgcggcctcccagcctttggaccccgatgggaccttgttccggcttcgcttcacagccatggtctggtgggccatcacttttcctgtgttcggcttcttcttctgcatcatctggtccctggtgttccactttgagtacacggtggccactgactgtggggtgagtgccagctccccagcccctgggtcagggccaggtcaggaggtggcagttagggtagaattagatagtggagaggaagtggaggatcagagagagggaaagggacaaggggatgggggaagggtaggtaagtcagagtcagagataattcatggggggagactcagagagaatagaatcacagtcctccctgagttggaagatgatgatagaaatgcaagggagatgacgggcgcagtggctcatacctgtaatctcagcacctcgggagggcgaagccagtggatcactcgagttcagttcgagaccagcctgggcaacatggtgaaaccccgtctgtacaaaaaatgcaaaaaaattagctgggtgccctggcatgcccctgtagtcccagctacttgggaggctaaggcaggagaattgcttgaggctgggaggtggacatttcagtgagctgagttcacaccattatactccagcctgggtgacaggagtaaaaccctgtctcaaaaacaaaacaaaataaaaaaaaaaaaacagcaggctgtgcactgtggctcatgcctgtaatcccagcactttgagaggccgaggtgggaggatcacctgaggtcaggagttcaagaccagcctggccaacatggtgaaaccccatctctactaaaaatacaaaaattagaggccaggcgtctgtaatcccagctactcgggagactgaggcaggagaattgcttgaacctgggaggtggagtttgcaatgagttgagaccgcaccattgcactccagcctaggcaacaagagtgaaactccatctcaaaaaaaaaaagaaaaattagctgcgtgtggtggcacctctagtcccagctactcagcaggctgaagcacgagaatcacttgaacctgggaggcggaggttgcaatgagccaagattatgccactgtactccagcctgggtgacagagcgagaccctgtctcaaataaataaataaataaagagaattcataaacaccctgcaaggtaggtggtgttatacccattttaccaatgaggaaattggagctcagagaggtgaagtgacttgctcaaggtcacccagctaataaaggcagagctgggatgcagactcagctttgtgcagttcctgagcctctatgctgccccttcacattactcagagtgcatgtctgagcctggtctcaagctatgatatctcaagctatggtatctcaagctatggctttgagaccagcatcttctctcccagagctctacatttagcttcctctgacagtgcagaagggaatccatctccttttttgtggaggctgtgaagccccatggctagtcttgccccaggcctacctgtgggctgccctatgagccgcctgcagcattgctcaccttctcagcagtctggcatctcattgaaagaaaggaatgatggtccttaagaactccacttccgaagactgtccctccatagttagagcaaattcattcccttgctgggttgctgggctctggcactgcgctggccctcgttggaggtctgcagaagtgcacagaaagtgtgggcaatggactggccatttccacagttttggaaacttttaaaaatccatattcttgctgggggtggtggctcacgcctgtaatcccagcactttgggaggccgaggcaggcagatcaccagaggtcaggagttctgagacgagcctgcccaacatggtgaaaccccatctctactaaaaatacaaaattagctgggcgtggcagcaggcgcctgtaatcccagttacttgggaggctgaggcaggagaattgcttgaccgcaggaagcggaggttgcagtgagccaaaattgcgccactgcactccaacctgagcaacacagcgagactccatctcaaaaaaaaaaaaatgcatattctggcttggcgtggtggcttatgcctgtaatcccagcagtttgagaggccgaggggggtggattgtttgagtccaggagttttagaccagcctgggcaacatggcaaaaccctgttgctact

SEQ ID NO: 680 - DNA, 470 bp, Homo sapiens
ttttttctttataattattcccctatttgaaaaatcaacttgtatatgaggcagcaaacaccttgcagagcagcattcccttttagtttcaggacgtggtggtggatggaaccactgtaacctggcctccctccatgagaggagggaatccaggtggccatgttgaaatgtgcctgtgtgcagcaaggcttctgaaatgacaagagagcccagcagcttccaaagcagctgtgactctggatctcacccatcatctctgcttctcactgttagaggagtgaatctgtgctgccttaggaggcatggaacctgggacttttcttccttgtttaatgtttaattttattaaaataatttgtaagtgatagatgttgatctcgtgacaaaagagagattccctctttataaaactattctaactaaagatcttttgtaagcccatgtgttagaaataaaacttgaatatcccc

SEQ ID NO: 681 - DNA, 556 bp, Homo sapiens
aggtttaacagtggattttgtacttttacagctgctctttgataaaagatgaagatgaaaataaatttatattgctagcttgatgagctcaagagtctaggtgaagatttacaatttctctgggccaggaatccaggcacacttggctgggccctttgactttcaaggtgacatcagggcatggactcacaacatgcatttcatcagaacagcaagtaaggagaaccagaaagagagaatgctatcaagatggaagtaaccatcacttacaacctaatctcagaagtaaatccatcacttgagccatattttattgttagaagtgagtcactgtttctagccaacacatttaagaggaggagattatagcggggcaggaataccaggaggcgtggatcgttgggacccagcttagaaggttcacaaccacactgtctgatgaattcttggtgctctaaacctgattttatccacctctctgaaggagattctgagggtcagctacaatatggcattgggtgttttagtgtgttaacgtcttaaatttacactttat

SEQ ID NO: 682 - DNA, 543 bp, Homo sapiens
aacaaagggttgggacacaaagtcattctcagaagaaggaaagcctggaagatctttcaacagacttcctggtgctgggtctccttgttctctctttagtgtgaccgagaggccagatgaccacgtatatgcctaagaggagaagctgccacctgttgctgtaaatctggtggagaagtgaagggccagaggaaggaagtgaattataatcgccatcattacaagttgctgagtgctggctaccttgtgacaactacctctttcaatccttgcccttccaggggactggaggaggaattctctgaaaaatgatctaagaagatagcaccttggcagagatctggggatcctgatcatccgaaggccatctgctctatgctttcagctggtcttgaataagcagcctggacaccccgatgatgtttgggacccattcactcatgcatccattcattcatcctacaagcatgtgagcatcgtctgccaaacactgactgagcctgtgctgggagttcaaacagcatgaagcctctgtccttgccc

SEQ ID NO: 683 - DNA, 495 bp, Homo sapiens
accccacccaaatctccgcaccgaggaagctggaaaaccaaactgtgccccagcagctccaggtctcgctgaacctgttactatggcagcgtctatgcttcacttttgaggattgcttctgctttgaaatagccgtgtggaagaaaaactacaaagttttgagggggaaaaaacccacctaactttagctgccgttgtgtcttcatctgtaaaaatcttcttcatgtctcatggatttcaacatgcagtttatcttggtttgttccataaaacatcagatgcaactttaatggcctaaccccaaaaagataacttggcagccatcaagcattcagcagcgttccaaatgccctcttgctggagccagccttctacggggccatgtggatgtcaggcacacacaatttgagtcacgctgacatagctgggatgcctggattgcactggaatctggggggtaccaatcacaggccagagagaagccattggctggaa

SEQ ID NO: 684 - DNA, 1494 bp, Homo sapiens
ggtagcgacaagaagattaaaagagggaagcagaggagttgggagctggcggtcgttcccggggaagaactgctaaaacatgagaccaaggcacagaccttactgtatgagaagcaatgctcctcaaaccttctgcgtgctgacatagaccttcccagaagcaaaactgttggcggcgacctgagcgctggaagccgaaggggaagaggaaggagacgcgaagccagggcggccggcacaaaggcggcggactcgcggcggcagcgcctgcccggccgggagcacaacccacggccctactccagcgaagtcccgcaccggcttctaggaataaagtttacgttctcctgaggccgcaccccccacctcccacccaggacggcacatctccgtgtcctcctcccccaaactccactcgggaccccgagaaccaccccagccttccggccaccacaacaaagagccgcaccgaccggcgaggataaacagcggcggagggcgagagggcggcggggcgagcgcctccacgcagcaactccggagtcccccgcttgcccgagcgcagtttctccgctgctgtttccaccggctttgtaacactgggaatttacatcctcacccgcacccctcacgcccgaggattttaaactcacctttactctcgaactgagagttgcggtagatgggatttttgccttttccccagatggttgaaggttaagatttttggaaaccccaccacctccttatttctattattatttctgcaagaaaagtataaagagagttgtagtggaggtgagatttgtgatcgggaaagccttcgactccctccttctccgtcttccgcctctctctctctgattagttcctatccagcagcagattgaagcaggagatgattcttctcaaggtttgttcagcagcttcacttctaggcgaaggcttcatgaaccaagtgacgtcaaccaacaaggcttctctctctctcctctctctaacaatgaaagttgctgttaacaagggaaaaaaagagagagaattgtttataccatttcagttccaataataaatgacctatcagctcctaaaggagccaagggagggggttgcttcttctttccaagaatactgtagctttgagtttgcaccgttccttgtcccaggaaaaagttaagaaacttaaaatgttttgttttgcttttaaagaagacaggacagaaaacgggatttaaaacttagtttttaaaaaaacaaaagctacagagtagggagcataggtcaaccatctccacctaaattttttttgttcctaaactcagaattctacaacccaactaaattaatatgccaagattttgcggatgttaaaactcaaaaaaagcagtatgcaagacggtcccggggtaaaattctactgcctttccacggacaagttaaactggctgtaatgtttatgcactaagttaaaataaaatttaaataaaagacgtt

SEQ ID NO: 685 - DNA, 846 bp, Homo sapiens
gggcccccaggattcctgagaaccctccagctgtgtgcggggcagaggtgggggcctccacacctctgctcagggcagcctggatggctggaccagctcgtaccattgaaaaacttgatgatgtcagtgaagtccatgttgttgtcacggatgatctctcgcttacgcagcccagtcccatgtcccgccatccctcaccattgtcgagggtgaccaggagaggcgccagcagatcgcacatgccctgcacatagcccacgtccaggtgctcccacacgtagctgaaaggcagggggagagtcactgtggctgtgccccattcttccctccctcgggatccctgggaagacgtcctccagagccacctgccgcccagaagtcagcctttccacgaccctaaggcttgactggatgcccgaggccacggagtaattgcgagaggagggcagtcctgagtctggagagtcgaactccacggaatgctgctgctccaccacggcggtgcccggagtcccgggtcctgcttcctgctcagcctccaacactgtggccacggggcaccaagccagcttctgacccagccagccaggcggagagaaacaagcctctggccaaacatgaagacacgtcttcagccctgcttgaaggaacagccccaggtcttcctgtggctactgaagggaagtaggggagccagggggctgaacgctcaatggccagtttgaactcagtctcattctagaaacgcctgaagtcatgagaccgggagaatggccttagtgttttggtgtggctgggtggagagaagcctagaggttttaggaaaaacaagttttgccttatttt

SEQ ID NO: 686 - DNA, 745 bp, Homo sapiens
agacagagagggcaggggaaactgccatttttaagctatcagatcttgtcagaactccgtcactatcacgagaagagcatgagggaaactgcccccatgacccaatcacctcccaccatcccccgctcaacacgtggggatgacaattcaagatggaattgtgtggggacacagagccaaaccatatcaagtacctacaaaattatggtgactcttcactaatttgcaaactgattatctgcaaatcttaaatagggaataaaacacaaaaatatcattatccctccagaactgaggacgcaaattggatttagaagacttagctttgacacctagatatgttttcattgatttgacctaacttgatctcagtttctcttttatagagttagttctttagatcagaggtccccaaccccaggactgcggactgccactggtctttggcctgtcaggcacccggccacacagctggagtgtgaaaaaaaaggaaaaaactgaaaatctcaagaggattccaggaaatcaaaacaatgaattattgaatcaagaatttgaaagagaaaatagatgcatactgaaaaaagaattttgtttagtgagatagatgtaataatgaaggcatgttgataacgggggagctatgtatatatgaggggagggatatattggaaatctctgtatcttcctctcaatcttgctgtgatcctaaaactgctctaaaaaatattttgagaaggaataa

SEQ ID NO: 687 - DNA, 1609 bp, Homo sapiens
aacaaccaccggaaggcagaaagatctaagcagcagtctcagcagttgcccagcaccacaaacacagaggtcgaagttcaaatttggaggggcttggtaaacactgttaactttatggtgagatccaagaagggcatgtgtagaaattaagaccatttctaagaccttagggctgtttctagagccaactacaaaatggaaattgaccacatctaataaagtggctattttattgattatttttgaaaatagtcaataaaaagcagacccactagtgacctagatgttggaattggcagacaaattcttcaaaataagtatcagtgttttaaaaatgtatacagagaaatgtggatataataagtataataatgggaagtttcagaagaggtctgaaaacggggaaaaaaatcctaaaaccaaaaaagtatctaaaatcaaaaactcattgggatttacagcaaattggacacacacaagaaaggatcagtgaacttgagcacaggtcaataaaaaatgtccaaactgaaccacagagaaaaaagataaagggattaaaaaaaaaaaaacagccttgatgatcaaatacatgcattgacctggaaggagagaagatagagagtggaggctctgaaggagactcttattttctccattctgtggttgctggtaattcttggcttgtcagatgcctcactccaatctctgccattgtcttcacttggcattactctctgcatgtttttgtgtctttcttctctgcctcctcttataaggacactagttacattgaatttatagcccactttaatccattatgaccttatcttaactggatctgcatagactccgcagtgagtcgaattgtgtccacaggtaagaaagacatgtttagtcctacccactaatacgtcagaatgtgacattatttggaagtcgggtctttacagaggtaagcaaattaaaatgagatcattacggtgaaccctagcccagtatgactgatggccttattaaaaggggaaatgacacagacacatagagaaggaagatgatgtgcagatacagagaaacaccatccacaaaccaaagggtgtctgaatctaccacaacctaggagaggcatgaagcagataacccctcacaatcctcagaaagaaccaaccctgccaacaccttgattttaggcatctaacctccaaaacagtcaaaaattattgtggtttaaaccactcaatttatagtactttgttacaacagccccaggaaattaatataaatcatatttctaaattgagtctcatgctgatattctgaatagatgaaattcggatacactattcaacctaatacatctactaaacgtttaaagaagaattaacaacaatcattcacaaactcttacaaaaagaagagggaacatttctcaatttattctatgaagccagcattagcctgataccaaagccagacagacataacaagggaaaacaaaacaagctgaagaccaatatttctgatgaatatacaggtataccctcatcttattgtactttgcagatactgtgtttttttaataaattgaaggtttgtggcaacccagcatcaa

SEQ ID NO: 688 - DNA, 3793 bp, Homo sapiens
gcatttaaagaaagtcagaggcgagggggaggctacaggaaaaagtggaacatctcctgaaaggtgacaagtcgtgatcaaaggcaagtctccaggcagagagttggcaggtttccgaagcaaaggttacttagaagtggaggctccactgccagcttccccccgctgcaaaatctgacactcctcaccctcagggttcagcaagattctcggaaaggccttttctgattctaggaggtgctgcagcaggagctgactcggccatttcctggcctctttagttggaagatgacagaaaggcggaagcagggactgctattgtgaggcccatggcagccttcctgtaaaacaaattggcaaattgtcaccttcagatggaccacagctggccctctgaacagccctccttggcctttccagagtgtacatgattgtgtcccatgtccagggagaggacagagccaccaggagggtcaaggtcgtggagggaaacatggcttgtttcccattgcaacaaggcctcccactgcaagacagagaggaagagctctgccacccatgtgtgtaaggccatgtggatacctcatgacatcctggaaggccacagggctgtggccgccattcaacttaggttgacatggccaagaccatagagctaatgagtggcaatgttgagcctagaccctaagtctctagattcctcctgcagggcgctgggtgttgtgggggcgtctctgaggtgggtcagagtgaacctgcaggggccacttaaaacccttgcaggccttggctccttctccaaagaagcccaagccagaatggcagtagaagtatctcctgtgaccgcaagccaggcactgattcttaggttgcttcctggtccttctgtatgtattgctaagagcagcagtgttctttcttgccacagagtgagtcctggtgcataaatctgtgctcatgtcacccagtgctttcacctgcctgttcgtgataatcctgggacaagaccctcacctgcctgcacgggggcggggggggcgtgaggtctagagacccaaatgaaggcctcactgaatggacttccctgaggtgtcggggccactgatgtggtgccagggcctgtctattcttcctgctagccaaaggctggcttctcaagccgctggatgaatggggagcctggagatgttgaacaagtcacgtacgtctctgattgcctcgatttccccattttggccgatggcatcgctaaagcatttgatgattccaccgtcaagtgtgagagctacaggagataaaaattttaaattactaatcacccatggtaatgcatggtaatgcatgctgaacaaacagtgaggaggccagacgccaccgcattccaaaacaggaagcactcaggaactctaccagagcatggctgccctctccacatctgcactactggactgagggcttagttgatccatctcttccacagatttgcagagatatgctcaagcgtgacttaagtgacttaaggctcatgtgttgcctccctatgtcaagcttttcacccagtgagctctttgagaacaggggctgcattttaggacatctcccccagtgtcttcgtagaaccaggcaagacacacggccttgttggaagtgccaaacatctattcttcatcagcagaatggatgagcccctgaaaggcatgagttgagctgcgcagtctgaactcagggaagtcctcgcagcgggctcccaattcctgcctctcaagaagcaagctgagccttaaagatggctgaaaatgtgaacagtctcagggccacgcagacccacctgagcagttgctctctgatgtctcaccgagccatccaccatcccagcgaagaaagggcctgcaagcagaccagaaaatgccccattcagtcatgctgcttagtcatggcccaaacctgcagcgtttaattctgctcactgtgactttattgcaatggcacacacatttacatcactttatgtgcgataacagtagagaagttagttaggtttttctgttttttgtttttttaagataatgagaaaagtctgtaatattcagccaaaatgtatccttgtggctggtgtagatttttggcgaaatgacactgtacataatcagaagaaggcaaacatgcatattatctccatctccttataactgcacgagataacataaaactgcaggaagtatcaagcataagaataaaagccgtctattgaagtctacgtggcatcccctgcgtgccccaggaacacccttcggtggattaggatgagcacgctggaaaatacacaccctgccgctgcatctggctaatgccaggccccagcccctgttccttaagccacagatcccctgagtgtctgtgttgtgtctgctggaatttagtttaggcaggtgacgtggctccaaagaaagtcacaggctggtttctgctgcagagatttgtgtccacttcatgcatgtttattgcccgttaactctatatgaagccacagcaaaggggaagtgatgttagagaggtcacaatctagttagtggggtcaagacaagagatggagacagcaggtcttgacactctggaatcattctgatttgtaaatatgacaattgatgaaggggaagagtgcctagtctccaggagggatttcctgctgagacccaccaggtatacagtcggtccttgtctgcagtgaccccagagacatttattgcaacacctgcacatcaggttgcagcaactgtgttctgcctggcccaggacagactctgctccacctaagagtcagcctctccaaggcagcagtggggttgggaagaggggaggagggacctccatgctgcaccagctcctacagagccagctcaagctacatttcaggacatcttggaggctacttctggacaattgtggattagctaagtgacagtccaggaacctggatcccatcctggccagggagttgtggcttctgagataaggactttgtgcattggagataaactgaagtgtttctgcctctgctccctccaggggcggcttatggcacaggctcaccaaattgcaggccccagagcacctgcaacctcagggagctcaggggcttcccagcatgggcaggggaagccacagattcacttctcctacagatgcacagaccctggggtggatggtctaaagctcaggatcttataatgcagagaagatggaatagagcaggaaccaggcccctgtctggaggaaggaaccaataacaacaacaacaaaactactgacaatgtgcgcgctttacaattttcaaagcgctctcatctcagtcaaggaaggatgcattctttccacaggctgacgttcaaaacccaaccaccagaaacatgaagataaaacaaaaggaaccaccagaaacaaacaagacacctgtccatcctccaggtttgcaaatcagatcaagttctgacaactggtaaagaggaagatgagaagatcctgccagataaattctctggtaccttcattgatctcattctttcaccatcaaaggggaatgcagtagtgccagcaggagcagaaaaaaaaaaaaaaaaccctaaaaagaacaagagagactagtcaaagctagtacagtgtttccctggtactgagtcatacttttacaatgacccaggcccacggcctcaactgatgacaaataatgagaatccaacaatcattctttctcgcatattcacttgtgaataaatgcaagaactggtgtatttgt

SEQ ID NO: 689 - DNA, 234 bp, Homo sapiens
ggacctcgcgctgacatctgggaaatgccattcatactggaacctccgacacactgccatgaatgtgagggtttcgtgactgatggggagactgcagtcaaataaaacagatactacacgcactcgtcggggcagccgtactgcagaagcacgttgatgcactcctggctggaggcctgccgggcgtaggtcagcgctgtgttcccgtgggcatctcgggccatgacgtccacc

SEQ ID NO: 690 - DNA, 4656 bp, Homo sapiens
ggtgaggatccccagtttgaagggaggggactagggtcaggtaggaaaatggggcctttatgaagaaaggggaggttatttgggccactcctctggagggatagagggctccaggaagatctgcatccccaaaacctggaaacaagactgttctttaagaataaaaatccacatggggcttgaggccaagaacagcccttgttgccaccaacatggagactttgtaccatatcccattcttagtgctcgagtgttccaacctgaagttgaagaagccaccctggctgcacatgccatcagccatgactgtgtatgctctggtggtggtgtcttacttcctcatgactggaggaataattatatgatattgttgaacccccaagtattggctgatgaacgtgggcatcagaggccagtagctttcttggcctacaaagtaaatggacagtatattatggaaggatttgcatccagcttcctgtttacaatgggaggtttaggtttcataatgctggaccagtcgaatgcaccaaatatcccaaaactcaatcgattttttttcttctattcattggattcgtctgtgtcctactgagttttttcatggctggagtattcatgtgaatgaaactgccgggctatctgatgggttagagcgcctttaagaagaaatcagtggatactggatttgctcctgtcaatgaagttctaaaggctgtaccaatcctccaatatgaaatgtgggaaagaatgaagagcagcagtaaaagaaatacctagcgaaaaaaacaggaagcatattgaagctcggactagaatttcttcttggtatcagagagacaagtttatcacagtatttttttttttcctgctgacctattgataataccaacaatgttgagtggcattttcttcttagtttttaatttcttaaagaaaatatactccatatctgcagggaaaaaaataaaaatccacacctgagaacagatccatacaacctgcttacaaagaacagctcctgtgctacctgaggctgatttatttgaagaacaaaaggaagagagacaatttagtgtagacaagtgctattcaatagaactttttgcagcagtggaaatatccataaatctgcagtatccaaccaaactagccacagacagctgctgagcaattgaaatgaagctggcacaactaaggaactgaagttcttattttaattcaacttcaaatggtcacatgtcactagtgactaccacactggacagtgcaggtgtagacggagttcagatcagactcctgaaacttaatggctctaaccttaggcaagttacgttaacatctaagcctcaatccctccaagtagaatgggtgcacctaaatcatagggttgtcctgttgtcctgagcaacattatgtaaagcacttagcccagagcctagcacatagttatctagagttgggaacgtcactcctggtgtgcatgtccagaccctacccgggagaagggcctaacctatgactttagaaccctcagttgcaggtgtgcatgttccagccaacactccactctgagtgcaggctcatcaggacaccatatggttgtaaactggctgccatgtcccaatccttccagctcttgagggtcagttctcaccttatgaacaaattaacaggctctggacctataagatcaaggaccactgcgccccctggccaccccaccgcccccccccaactttgatctgattgactttggcttccacctactgtttaaaatgtgtatgttgggggagtagggacagcacgggggaggggtttactttcctgactctagcccaggacatttggtgtttttgaataggcaccattcagccttgcttcagtattaggaataagatactttttattccatcctctatggagacaaaaagctgctcctcctttgagtactgacctacatagatttccatttctctcttcagcctcaggccaaacaaacaaccggacagggcagcagaacaaggctgtctcctcaggatcctgccaaaggcactgtcctctccaacctggacccagccccacttgcccttattggttgcttacacccagagtgcacactcacaggaaagggcctctgctggctgcaggtgatcatcttgtcccttctctgccttagtgtgtgttattgccatttcaatgtcagtggttttttatgtattttcttccagtctttgctgctgagatctgactgtatatactattttgtatcctttcatgtatttctttcatgtatttcaatgcagccctcaacatcatcatcataaatctctccagcagaatgctggaggcctccctcttctgaacctctacatgctgctggctggcatcaagcagaggtcatcactgggtgctgaacaggtcagctccctagggcaatgtgagcaaagtgttgtggctcatcctcgatcctttatgcccttttggcaagattcctttctcttctcagtcacagcagatggacacataatcttgttctcccaggggctgcattctcagtagtcttttccctgctccttgggcgcctggtcagggaggtttgtacaagcctgcgcacacacagcagtctgtcacgaggctgggccaaccttttttttttttttaaacagactcttgctctgtcattcaggctggagtgcagtggtgcaatctcagctcactgcaacctctgcttcccgggttcacaagcaattctcatgcctcagcctcccaagtggctaagacttaacaaacaggcacacaccatcactcgcagctaagtttttgtatttttagtagagaccacgtttcgccatgttgtccagactggtctcaaactcctggcctcgagtcatccacgcacctcagcctcccaaagtgctgggattacaggcgtgagccatggcgcccagcctgggccaaccttttctgagccatagtccagctgtactacagctgtatccaaaaggtaccatgtatctcccagggtaacctgaagacctaactgggcatactaactgtcctcagatttcagttctttaaggcccatctcttctagatcagtgtaaatatctgaactcacttggtgcttcaacccaattggtcttgggattcatcctttacctacccagctctcattctcttctaggttgttccatggcctcttccatatattacatttgtggtcttgagcaagttagttagttacaacaacactgagcatcttgaccaaggtcacttggcccaaccacaggctaatcccaggccatgtgcacatcccaggattagcttgtggtttatcagttgtcaatttttttttttttttaatacagggtctcactctgtcaccctggctggagtgcggtggcgatcagagctcactgcagcttcaatctcctggctcaagtgatcctcccacctcagccttccaagtagttgggactacccacatgcaccaccatgcacggctaattttttggtttttttgggttttttgtttgtgtttttttttgttttgttttttgagacagagtctcgctctttcgcccaggccggactgcagtggcgcaatcttggctcactgcaagctccgcctcccgggttcacaccattctcctgcctcagcctcccgagtagctgggactacaggcacccgccaccacgcctggctaattttttgtatttttagtagagacggggtttcaccgtgttagccagggtggtctcgatctcctgacctcgtgatctgcccgcctcagcctcccaaagtgctgggattacaggcgtgagccaccgcacccggcccttgtttgtttttttaagtagagacaaggtctcactacattgcccaggttggtctcaaactcctgagctcaagcagtcttcccaccttggcctcctaaagtgtggaaattatagcatgaaccactgtcaggctcttttgtcagtcctatcaacctctaacatcctcgcaccagacaggacaggtgtctgtattgaaactttattacaaaattataaagcagagctctgtaacaaaataatacacatttgggtttgctttaacctccaagtaagtctgagaaaatcttaataaaagccacttgaagtaacaattcacatccaagagatttccacaaatttatacaatgtatattgagcactagttcctgtacagcttattcttattagtttggatccaactattccaatgtattatgaaccagtcagctatctgtcttttgaaacaagtcttaactgaaatctcagagtaatcagcaaaagctacggaataattctaagaattagatgtttccatatcattaaaaccaaggatccatgaggggcagaagggaggattcaaagatttaaaaaaaatcaaattttagaccttggttaaatattaactggaatgggatcttggaactcccaactttaatttggtgtaataaaaatgatgcaaaaaaaaaaaaaatcagggttgtttgacaccttttttcctaaagggaaaccttcaccaaaaggggataaaagatttaaaggcaaaatgagtaaacaacctcagttttaattcttactgaggttactaaccagctatcagtatattattttcgattt

SEQ ID NO: 691 - DNA, 229 bp, Homo sapiens
tgaagatgaatcctgactgcctggacatgcctgggcgggtgtacccatggcctgtggttgaaccagccacaccttgtctcttggccagaggctgccctgaggctgagggctgtgagtcctgggatctgctggggaagtccaaggcatatcgcaccagctgcccctagctgctgcctgcagctggaggccacaggccccccatgttgaagaagtgtcaccttcaaaggga

SEQ ID NO: 692 - DNA, 130 bp, Homo sapiens
atcctcctgatccctttcccatcggatctgaacactggtcttggtggtcgtaaaaggaggaaaagtaatagtgaagctggcctaaatgttgtaatctggtatatggcatgtgggctagtttcagacaggt

SEQ ID NO: 693 - DNA, 470 bp, Homo sapiens
ctttcacattcgggaagcgtcgggattaggtgaaagtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaaccgtcagtttgagccagatggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggc

SEQ ID NO: 694 - DNA, 612 bp, Homo sapiens
cgtgtctgcgtcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacagtttccatcattatcttctatggagttcttcattcccacatctgtggaccttaaaatcctaccgttgagtgcctgccttggatcagcagtcagttcgttaccttggttctcagacgatgcttgcaacaacgccatgcgattcgcccactcttgggttacattagttatacactctggaggtgacttgacctgtcattgtgaacaattattgctcttggacgacccaggacataggccagccagtacgtaccccagtgtgttggagaatcgcgctcggcttcttcctctgtgctgagtcatgaaagttgccggagcaggtgcagttacacaacctccaggtatgatcctgtttaaggactggatttaggataactacttagaggttaaaagtcacaagggtgtatggatgaggctggagtgatctgggaccaaag

SEQ ID NO: 695 - DNA, 1574 bp, Homo sapiens
gggaggacctgatttttcttcacccatagttagggaggcgcaatcgccctggctttggggctggggcctccggggaggttccggtaggggcgttggagaggccgctctttttgcaaggcccgagacggcgggccctgcgcaggccgccctattccgcgccctcagggcgtcagtatccgcctgaggccggataccccagctgggcccggatgccgtcgatgggcccggagcatcctcggcgctgccctcccagagccccgcagaggctgaggtggcgcggggggcgggcccggctccgcgagaagcagcggcagcgagggctggaggacccgggctacggggctctggggcgtctggcctgggtgggactgagcccattcggggggactccggggttctggtgtaggtagatccggggcaggctcaggaccaagtccctctccttccaccaaggagcgcccagaggccggcgggagctccaggttcacctcctcctcctccaggaaatcccacttccaactggatgtctggatgaactactgaaagctgctgagtgtcctgcagcagggtcggtggacctgggtgtctgtctggacacatcctccagtggcctggacctgcccatgaaggtggtggacatgttcaggagctgtttgcctgcgtgtgctgtgaacttcaagtgagccaagagctggttagagctgcaaggacaccgcctgcacaggatgcccggggctgggcattacctgctgcaatgacaacatctggctggatggcagagagctgacagaccgtcgcgacgtcccagtccagctgggccactgtcaccctggggctgtctaagttggcagtgatatctgcacctaatgagaggccattgagaaggacattccctcagagctgctagaggacccagctgtgacagtccctgaagatgtatgcccgggggtggcacatcttgcagatggccaggcctgtgaggccagcaccactgccaagctctaggacagtcctggtgggaggaaagggggtcatgtctgcgactgcaccagggtaagcctgcctcggtgccctgccctgtgccctgaggtcacctatcagtgaaggctgctgggttctcgatggcccattctgcaaggtagagggcggcatcccatgtgaccaggactgtgatgccgtgggagatgatggctgtgctcttggagagtgtgactgagcctcccgagggcagcaccaagagaaggcgagagagtcagtccagcgatcagaaggcaagtggcttagaagacaagcagccatccaccacatggctgaataaaccatgacaggacaaatcgccactcagcaatgagaagcagctaactgttgacatgccaacagcttgcacaggcctcaagggtgtcacgtggcatgaaagacactcatctcaggccacacaggattccattcattgaacattcctgagacaatggaattctggcgatggagcacaggtcagttgtggccaggggccgggtgtggctatgaaggggtggctgccttgtgatgattcaatatgctatgtttttcctttg

SEQ ID NO: 696 - DNA, 559 bp, Homo sapiens
tttttggatgcacaacagctgaagattgtgcctggattcccctttgcaagcattctggagtcacaacatcggcatagaaggtggccagccttcggcttttgcagtcgtttgtggagtctttatggaagagcagcgtggtcaagagaccacggctgcgtaaccccgtctgcagtatgtgaggccggagtgctgaccctggacctgcccagtcatgccttctcggtcagctgttcatctcatctgctaccacgttttgtgtagatgaacaacaagcctggaatcacgcgtgggaatgccagcctcacatgacatagaagacagagaaggaggaggcgggcacaagcgggaccccacagccagcagcccccttcagactgctgggagatagccaatggtttgcagcaaccaagtgaaagcccagctaggacagaggcgaccaagaccctcgctgcagcctcaactgccctccttggcgaggtggctgctcccatgcctggggcaaatacttggactcaagagcaaggaatgtcctgaagacttgcacagggaaaagtattgg

SEQ ID NO: 697 - DNA, 1060 bp, Homo sapiens
tggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagcccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaaggtgccagggactcccaaccccagcactccccagggaaggagccctgggaccccactccagcctggagagacccagaggaatggctccctgagactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccgtgagtgcgggagtgggtatggggttggggaggg

SEQ ID NO: 698 - DNA, 1616 bp, Homo sapiens
cctccgcgatgcttcaggcacgtaccagggcagcctgggcagggctggtcactgtgatctcatgaggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagccttgcaccacgaggaagtggcagtggcattcgggatatggctccctggccagcttgtgaagttcaaggggctcgttacttcttacagctcacagtccctcccgggtccagcacacctgagggctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgaaggacgtacttctttgatagtgcctccatgcatgcagaagatgacgtggagagctccgcgcggcacagggcaggaagctggtgtgcactctcatggatccgaagccaacacacgcctctcaactgaggactctgcccctctggcattcttccagccaccagccctgggggccaggagccactgagtgggtcacacagccttagagggcaacgagggcaggagctcgccctggcggtccccatgcagacaagagggtcactggcttccttgctttgctcttcctggacatcttcctcgacattcatctttccatcctaccaagagcgtggaaaccacagggcatgaggacaggcggagacaacgctggaccatctcacagccacatcaagaggctgcccacatcagggctttctacgtggttgcaaggaacacaaacctgtgtgctccatttgcccactggcactaggcctcctgcccaccacccgcttctaggctattcgagccgcaggagctacaggctgctagagaaccctgcggcaggatgctgggcgcggttcagcttttgccagggagcagcatgggactgggatttggaaggtgtacagtggctgcgggctttagcaggaggagtgtctacagcaccttctgctcctccagaaataaggaaactgaggcacagctataaagcaatgtcctgagactggcacctgggggctgccctcttcctgccagactgagtgcctcagagtgctacaactgaccagaggggagaagccaactgaggcagcctgtttacttctaagggactaacccacatgaaaagacccaggcctcctgcgccggcctcacggcccctacacgcgttatcaagcttggagtcaactggacgacctgctgtccctcagacagctgtgagtgccacacttcaccataccgggacaatgtgcctttgcatgtgtgtcctctgcccaccctgggcccatgaacagctcactccccttgcaaaacttgactgtaactccctctagaagaatttttggac

SEQ ID NO: 699 - DNA, 1284 bp, Homo sapiens
ggatcccagcggtggtcgtgtagctgagcaggcctggggcttggttctatgtccctgtggctatgtttccagtgtcctctgggtgtttccaagagcaacaagaaacgaataaatctctggtgactttttgaaaaaatagtatctcttgttgaaagaaatgctccatctgtgatttcaagtctctcacttgagtgaattggatggaagtggtgaatttcagccaaagtggccaaagaaatcctgttcctgtgataatgacgccatcagcctctgcacctctgtcttcccttctgccacatgttgtctgttctccgtgactttggctgtctcttcagtgctggtgggatatatcagaaagtgatggaagatgtggcactgtgccctcacccagaagctggccatgtggttggctcctccaccagaatggatgctctgggtgctctttgagccagcttggctttgcctagcatgcacaggctccgggtaccgaaatgttgctctgagtgagcttgtcctgccttgggccaaattctgttaggccagggccacaaaaggccgagtcccacgggtggtaatcctggctgctttctgcacttccacataaagacctcctgaagatggcctgtggtctacctctttgcaaccaagaagcccgcagtgccatatgaatcctcaggcatggactggagcccccgaggaagcacacaccctgctcctgagcctgctgctcattttctctgtgtggctccatttgtgtcacagttgttgcacagacttgtgcatgctgggcaaggccaagctggctcaaaaagcaaccagccacctctgcaaggttgtgccaggagccggtggaccggccaccaacctcactcactgctggtcaggttacatcagttattctaccctagaggtagggccccagtgccatatgcttttcctcaggcctctgctctatcagtcatcaggcggcaaccactcaggctgtgggaacctggccatccctccttccttgagtagctgaggttgctggcttgtccgcctactacaggcacagccttgcagatgtggctagttgctctgagccagcttggcctttcctggcatgcctaggccccaggtactgacactctgctccgagtcagcttgtcctgccttgggtcaaattctaagtctggccagggccacagaaggcccagtcccctgggtgctaatcttggctgctttctgcacttgaacataaagtcctcctcaagaaagcctgtggtctgcctgttggcgaccaag

SEQ ID NO: 700 - DNA, 503 bp, Homo sapiens
tgggttagtgaaatggctcctttgccaagcgtcaacatgtggtagatctaatttgaaatgagttccagagctgaggcaaggctatgatagaacacaaggcaaacagctgaaaactgtagtcaaaaggcagggaagctgagaaagtgattcaaagaagcccatctgaaatcggaagcaacagggacgcttttagggaggtcctgggtgcttcagaacacgggccttcagctgagacctctccaactgcctggaccctggctgctggcagaccaagttgctcaacacccagaattaacttgggactggagtccccatgtgaggccacgacaggaggcacacagcaggacctctcagaagggcctggaggggaaagatccctcagctccagcctgtaaagaaggtgcactgggatgcccacacaaagaggattcccttggcagcaaggaaaaccattagccctgtgctgtttatagatagcagagaataaagagaaataagaagca

SEQ ID NO: 701 - DNA, 2339 bp, Homo sapiens
gcagttggtggacctggtcgcgctgtgccgggtgtgacactacggagagcagattacattatcaaaagcaccaagttgaaacatttgcaaggtaggtgagaaaaaaagcattcgtcagcatattttggattttatcattttgactttattgcctatggtcagttctgccagtttttgtctccttctaaaaattgtttcaatctgctgaatctatggaaatttaatattttccatagtgaaggctgataagacatctgaggaagaattaaaaacagatgatctctaatttaagaaacatttgatgctaattacttcttaccttttcacacaacttaaatattggttaatatataggattacattactttttaagtgagattttaaagctaaattgataaagtagagatctagtgagataattagatgttcatacaagatttgaaaaatacagacattcttagtcacacaaaaataccaaaaagcattgtgataattcactttttcttattctaatttgtaacagcattttaatatggtcagtagaatggcttcagcatatttacaatcttaaagtttttaactagaaaacagtttgatgtatagatctgttactcagcaacattttagatttaaaacttaatttaattttatagctaatttaattttatagcaaatttaattgtatagcatgtaaggcagtttacatttgatttaataaaattaacacttaggcttttatgatagctttctaactcaggtatcagtgattttcagaatgcagagattttcaaactgaaattttttttgtcatgatgctcttgtggctaagtttatacttgggttatttcttctttacacacacacacacacacacacacacacacacacacacacacaccccataatatgaaaaaataaagtctgaaagaaaatatacaaatacattactattttttggacagtgtatagatttgagtgatctgtagaaccttctttattgtattatacaggcttaaatttttaatgattactttataattcggtagagtatagctattttcattttcaaaaacatatatatgacaatcccagtataggtgatacattgttttcacaaaaattttataataaatattgacaataattttttcctatcctcttgaatctgtaaaaacctgccagagcaaatatcctgttctttccttggcattactaatttgttcatggtattgatataaaccactcagtggaagttacagtgtaataactgtaaactgcaaggggtatgttatgcttaaaggatcccaggaatgatccaagacaaaccacagacatggtaaacagaaattatacctctgcaggatcttaggactcctctacactgttaacaattattgaagacccttgcaaagaactttgtttatgcaggttatgttggtatttatcatattagaaattgaaacagaaaaatttaaaaaatatttactaaatcatttaaaaacaatgaaaacatattacatgttaacatatgtaatatagtttttctgaaacaaaataaacaaatatgtatgtatacatatatagcgagaagagtggcactgttttacatttttgtaaatgtctttaatataaggcttaatagaagacagctgaattctcttacctgcttctgcattcaattggatgcaatatggtattttgtttaaagtaaaatctgtctttacacaaatatgtaattatagaaggaaggagtattttaataactttttcagttgattgtggatattctttaatattacagtgaatctcaacaaatgatagtctgttacagattagttgcattgtgaaatctgaaaccatataaatcaacttttcagacttttgaacctagcctgtttcttaaggaagatttctgaaaggtgtctaacttttgctttaaaaaaataaattgtaaaatttaaatcatagtaagacaatctcaagcacattctgaaggatattttaagtttacttttcatcaaagttactttataaaatattcaagcactgcttaagtctctgatcctgatttcttaatgtttagattaattgaatttaaagtttattatttattagatgttctagctcttaaagtctttgctttgtgactttctggaggtaagtttttgtatattaattaagcagatgtaaacagcataggaaaaaataaaggtttgattagtgattttttggcatggtgctccactattctagatttctgttaagtactaaagaaagtaatttccaaacaaaacctttgcttgagcttgagaaccgaaatactgatttcaaaaaaaaaa

SEQ ID NO: 702 - DNA, 723 bp, Homo sapiens
gggaagcagactggacagaaaggaactctgagcagctaaactctgactaatcccagggtatacctgcgttttctcttcaccagatttttcctaccaggaagagcatgtgctgaccaacagacatgaatttcagcctggtagttacaacattcacaggagtttcactcgttgcccaggctggagtgcaacggcgcgatctcagctcactgcaacctccgcctccccagttcaagcgattctcctgcctcagcctcctgagtcactggaattacgggcgcctgacaccacgcccagctaattttttgtatttttagtagacatggggtttcactatgttggccaggctggtctcgaactcctgacctcatgatcctcctgcctcagcctcccaaagcactgggattacaggtgtgagccactgtgcctggtccattaaaaacatttgtaaagctatggtgttgataaagtattatgaaagactgcaaaaaaagatggctaatttttagttattattgcacatgtttagaggagctaatgacattttctatgattaataaaagacattatttatgtttttatttatgtattccacaacatttattttattttctccatttcaggaaaaccactatgttgttacaataaagattttcatgtaatttgtgttcaattgatagtaataatgtaacaagttaaaaatgaaggtaattgtgtttaaaattt

SEQ ID NO: 703 - DNA, 1654 bp, Homo sapiens
aggcgggcggatcacaaagtgtcaggagtttgagaacagcctggccaacatggtgaaaccccatctctactgaaaatacaaaatcccagctacttgggaggctgaggcaagagaatcacttgaacctgggaggcggatgttgcagtgagccgagatcacgccactgcactccagcctgggcaacggagtgagactccatctcacaaaaaagagaaaagaaaagaaaactttgcttcactaagtttctcttgccattatctcattaattcagatctgtacctcattgctgctcacacatatatgtttcttaccttagcctgaaccttctcaggccttgaagtcattattctactctttttttttcttttccttttttatggcactagagaatgaaaacctaaggtcttagaaaatcttaacttgaaaaagtctctaactggcatgatttgattacttttttcccctgtggacaaataattttctttcctatataatagatttttagtaagtgaaacctttgctgctgctttcctgggtttacattagttttttcctgcccttaagaataatttatctgtgcttctctgatgactgttaatttctaatagtgcaggaagggatgagcttttgatttcttctcactcccctcctcaccctacttccaaattacacactaacttctaacccttacagcctgttggcacatacacaagatccacgagaccatgctcctcagaagctacccatgtcctttctcaccatggtgtggctcttggagccctgagtatctgtgactacccactccaaaggttgactgtaagaggagagcggccttcttaattttgcatttcttaattttgtttttctccattcctgttttatgacttggccttcagatgcttcctactctggcctcctccttttttctcctaggaattgtttccaggtaacctaccatgtgcacttctcagctgctctgctcacctttgcccaccttcccgtgaccctgagagtacagatccgaataatgtggcctgtgcagagctcagagaactgtgaggactacccatgcctgtcagactctgctcagggacagagatggatgggtaaatggtgctgttggagacatttttatcttcataccaggctctgtttcatccctgcaccccgcacccccactcactcccctgagggggtaaaatgcagaggtggttgacctgaagggtctgattccctccttcccaagccttagggcctaccctggagtgctgcagtgtgtgagagctgctgcttgcttgtttctccactaggcctgctccaaatgcttagccaatctctggagccgacacagttgcctacggggtgacttagcaccaggttccattagctctccaagtgactgtttccacccagtacttttggcgcttgaggatggggggagggggattatttaaaataaataaaatccgaggtggcagtagaggattccttttgctttaaaaatctttggactaaaaaaaaaaaaaaaaagttttttatatataaatatataaagtaaattgttatgtaactattattgtttcttgtatgttctaattttgttttatgatgtaattaaagaaagtaagctgtgaagacttttcattttcctgtg

SEQ ID NO: 704 - DNA, 487 bp, Homo sapiens
gagctgcaagagaaagaagactgaattcagtctctcttgcagaaaaattgttttccgtcaagttgataataatgatcacactgagaatgaatgactcaagatgaatatccaaagatatatcaaaacctggtcagcagtcgtggggaaaggaagaaagcctgagttgagtttatgaaagttttccactaaagtcagcaacagcttaaattcaaaccaggcacaagacgcttgaatctccatatgagttgttcatcaaagggctgaaagaaaagaaatctgagcccgagcacggtctggcctaaaagctttcaagtgactcctttctgttgcaaatgaaagaagtcctgctactctaaagaataactaaaccagactggagtcactgaaactgatggaagaacatctcaggcatgagtgccatggtgacgtcatcagctccgttcacaaccactcaccatgaggccattgctcctgtggaggacactgg

SEQ ID NO: 705 - DNA, 444 bp, Homo sapiens
atgaacttcctgagcaagaaggccatccaccatgcagtgtaatgtcttgctaagagaaattagtattcagtctgctcaggttccagcaaggactttcttcatgaagatcttcaagtggaatcaagcagccttgcccatgaagtcatgcctgtggctccactgagaaattcgattaagtattccaatactgctgtgaaacgaagtgatctgattccggtgagacaatttatcttgcaagcatagcccatctggattctttacactaaggcaagaggcaagcagaagacaaagagagaaagcagaggacctccgggaaaggaagcccccttttcagtcggcctaggcagaagtagatttactctgaggattcactccaagggtgaagttttaagggtgcttcacttgctctggtttcataaataaattttgatcttcttaaataca

SEQ ID NO: 706 - DNA, 627 bp, Homo sapiens
caggatatcggccatgttaatgagtctgatgttgctagtatcacaggcaccggaaaatatgcacattatgctggagcattagaatgcaacagaaagagccctgggcttggagtatgcagaactggttcttgttacaactcctcttactagtgggctgctatggacctaaagtggagggctttgaaatttcctgcttaattgggctgcatgtcattgctgtccttagaagttgctctgggatgcaggtgctggtttcttggatctcctttgctggaattttgcatgtcttgttttgttgttgtaccagctttgtggatcagccaacatccttggcttgccctgtggggagtggggtgggacacatcttggattgctctattccagggatgtccaacattttggcttccctaggccacattggaagaagaagaattgtattgggctacacataaaatacactatcactaaaatagctgatgagctaaaaaaaaaaatcgcaaaaaaaatctcataatgttttaagaaagttgatgaagttgtattgggccacattcaaagctttcctgggccacatgcaggctgagggctgtggattgaataaacttgctctattccctttgcagtaga

SEQ ID NO: 707 - DNA, 1515 bp, Homo sapiens
gcgggtctggctgcgagagaccatgggggctcagctaagcggcggccgcggcgccccggagcctgcgcaaacccagccccagccccagccccagcctgcggcgccggagggcccggaacagccccggcatccgccccagccccagccccagccccagccccagccccagcccgagcccagcccgtgggggccgctggacgacgtgcgcttcctcatcgcctgcacttcctggtactgacggcgtcctccgcaggatgtcgcccgtctgtccgccgtcccctgtggttcttgcctgccttgtctcctctccccacgtccctgcgtctcttacaccccctcccacccgaggctccccagagatagcagagaattcgaagaggtcgccggggactggaaagaagtcccggcagggccgccttcgcagtctacaccccagcctgcttcccagcctacacccagacccagctcagaccttcgtgaccaccccatccctttctccggctggctgggtcgggggcatccctctctgtcgctggcttccagaggcaggacaggcctcctggtcatgtcccaggtcatggagaagcccgtgccacagtgaccctccccatactcctgggggggctgctctccatcctggatcgtaaggaggcatcatcaggctgtgttcctggaaccccaataaccctgggcccccagggccagcctgttgtagagggaggctatctgaccgccggtctggcagaggagatgggtgggcagctcccagacaccccaaaggacccggttctcttcccagagcgtcctaaggttactcttggaacctgatctttgttccctcatcccagggaaatgacacactctgtatttctgttttatttagaaatgatttaaaaaacattatacaaaggctgatcagtttaaaatgtgactgacactgaaatgctgtgatgtcccccaggctgaggggaagctaggctctggggcccccagtgctttgcccctctgtctgccctgtcctggggtgatggacaaacagatgaccacaggcaggagaatctgagattggaagcctctaggctgagccctctgggcctggccccacatccctcacctctgcagcctgggctgcctgcctccatctcctgttcattctcagctggcctgccaggagccaatggggagcctggcgggaggcgggggtgcctagagctttcaagaagtgagagcaccaacctgaggagtggacagggaccaggaagtgggggaagggaggccaggaagaggtggatacaggagacacttctcatctcatctcagaccctagaggggtccacagatggggacacaagacccagccagcccactggatggcccgggcaagtaacaacctctctgtgcttcatctgagggcacggtgagagttaccgtcggcctcccagggcctaacacgagtttcatgtgagtggacaggtgtgagctaataaagtgctttgcaaagtataaaacactgta

SEQ ID NO: 708 - DNA, 2494 bp, Homo sapiens
aagactaatgaccgaagcttcaagactttgacatgtgtgaaaacatgaaatgacccttggctcttattgttcttgctggtgtggtatgttcacggctgaaaagatggtcagaaggggaaaggaggaagtgagaagaaagaaacagggaaatgacagagtgttgctcagttacccaggctggagtgcaatggcatgatcttggctcactgcagcctccacctcctgggttcaagcggttctcgtgcctcagtctcccaagtagctgggattacaggtatgcaccaccatgcccagccaattttgtatttttagtagaggcagggtttcaccatgttggctaagctggtcttgaactcctgacctcaggtgatctacctgcttcagcctctcagagtgctgggattacaggcatgagccaccaagcccggcctgaaatacatttaaataaatgaagatggagaatcagacattactttcatttatctgaatctggtgtagtttaattaatctgtaattgtaagtctttgaatcatatgtcaatattctattttgttagtcatgatttctaagtgttacataactgtggccccagccactttatattttggtatcatgacagaagactctgattgtggttattttctacctatgcatttattcttagtgatatatgttggttaaattatggcatagttttaaaatacatgacaaaaatagctaacagtaaagaaatgtctttgtttctggttgaataaactgaccacgcaaggttccaatttaaaataaattctaaacgaatcatgttattttccaaaactgttcctcctctcagtaaatgaaatcaatatccacccggttaccccaagacagaaatctcaagatcatctgtgactccttcctcttcatctgccacaagaagagtagcttctatctccaaagctagtctctgatcagtctacttctcttcctatagcctctgctttagttcaaatctagaatcctgctgtggtggtgctgtggcttccaagttcatcttcttccaatccgttctctaaactacagtcttgctctttctaagactcagatcttataattttacttcccttcataggttgaatttaacctgctaaatcacataaaatttttctgaagataccagcctttctgccttaatcaaacacattagccaaatccatagcattactgggataaagcctgaagatcccaaattgataaggcatctggattccctttgataacagtattcaataacaatgaacacctactgagtatactattccaagcatttaaagtgtatcaactcttttcacaaaatcaacaataattattattgctaccatttattgagagtctactttaatccaggtgttacatattcatgtattcattattattacctttttttttgagacgaaatcttgctctgttgcccaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacaggtgagcccagcctattgttacctttaaaaccaccctgcagggtagctcttactgtctccatgaggaatatcagaaaagggaaaggacttcctggagggctggttctgcctcaagccaatcagctgacactaagcagtgaagccggaatctgaggtccctctgcctgccctggtctttgctcaccctgacaaccagacacctcactgtgtcctgagcagcatagatgccacacgcacagtgccacatagagaagggtgatgtaaatgaaaattaaaacactgtgacaaagtcaagcagggcatttgtttttgttgttgttaagttatttttggtagatacagggtctcactatgttgaccaggctggtcttgaactcctgggctcaagcaatctgcctgcctcagcctctcagaatgttgggattatagacatgaaccactgcacccggccagtgtcagtctttgttccctacaagtgaaatcaaaacagcctcacgcctgtaaacccagcagtttaggagcccaaggtggaaggatcgcttgagcccaggagtttgaaaccagtctaggcaacatagtgagaccctatctatacaaaaataaaaatagcctgggcagggtgactcatgcctataatcccagtactttgggaggccaaggtgggtgcatcacttgaggtcaggagttcgagaccagcctggctaacatggagaaaccctgtctctattaaaaatacgcctgtagtcccagttactcgggacgctgaggcaggactgcttgaacctgggaggtagaggttgcagtgagccgagatcgcgatactgcactctagagcctgagtgacagagtgagactccgtctc

SEQ ID NO: 709 - DNA, 2472 bp, Homo sapiens
cagaataaaaaaaattagattggatagaaataagaatctagataatttctattcactcttcatgtctctaaactttctcttatcgtggtgcttaccaagctttatattgtaactacttctttcattgtatgtcttccacaccagactgaacttagtgaaagtacagacgaaacatgtctttttcacaactgtcaataacctaccacaggatctggtgtgtagtaggacttagtaaatatgaaatctgaatcagaaccaccccatccccagtggcatttgtttacattcagaataaaattcaaggagtcattattactatggcctacaaggcacagctgtcattgccccttctttggtctcatttcctgttactgttcacctccggttctgagctccagtcacagggccttccttgctgtttctcagacttgccaaacacatacattcccctcagagaggagtcataggtcccctcagagaggcctgtcctggctacccccatcattctctttctgtaattctgctttttcttcatagcacttactttattgtctcctcacctcctatcaccacttgaccataataagcatttggtttttgtttactgttatgttcccagggctttggacggtgcctgagttctagtaggcactcagtaaatatttgttgaatgaattaatgcatagggttgttcgaacactgactccaaaagcccctctggagagtagtcttatccaaatcataatatcagtagtaatatcaaataattacatttgtttagggcttttgagtttataaaataatttcttttttaataggtttattttttgagacaggatctctgtcgcccagccaatatattttttaaaaatatttcaatttttcagtttttatatttttggcgacagggtcttgctctgtcacctaagctagagcctagtggtatgaccatagctcactgtagcctcaaactcctgggttcaaacaaccctcctacctcaggctccaaagtagctaggactataggtgcgtgccaccacacccagctaatttttgtatttttagtggagacggggtctcgtcatgttggccaggctggtcttgaactcctggcctcaagtgatctgcccgcctcggcttcccaaagtgctgggattacagacgtgagccaccgtgccctgccagactcttgtattatattattaacatgatctaaattatttattcatcaaaccacttggttttatatactttttttttttttttttttttagtgtagagacaagattttcatcatgttgcccaggctggtcttgaactcctaggttcaagcaatccgcctggctctgcctcccaaaatgctgggatcataggcgtgagccatcacgcccagccatggttttatgtagttttgttatatgagttattgtgaaggtgaccaagtcaaatgacttttaggtgtaaaagggtgttttgatctactgtagagtttgcttcctattccttaagtaaaataagtttgatccaggccagtgtttttggattaaacttctcagagcatcccaaagagcagtttgataaaaccctgagtctaaattatagaaggattaaaagttgaaacttgctgttttcttgagctgttgtggaaggtgaaacctggcctggcttcatgtgttggcaaatatttcctctgatctgcccttccaccgatggatgcaaataacttaaattttttgagcaccagattcattcaatatatttttttaacaacatacttaaagcctagtttaccctattcccctgttgtaccacctgctagcagacatactaagatcgtttatttaactgaaggaaaattaatttacagtgaaaaaactgcagcgttagtgaaggcatagagatctcttgtggacaatatttttgagtctttattgattagacttcattgtgacttaattaattgtaatactgcatgagcattttattactgggaacgcaaaacccaggcttacataatgcttctgatggagaatgtaacctgcagctactgccaaaaagcttctacttagaggcaaacaactctgccctgataggcttactcatcaagaaccacacagcatcttgcttggctaaaagcactttgtttagaaccaatggggcaagggattaaattggctcacccaccaagtctccatataccgaggggctcagagtcctcaaagcagttttctcataccttttgagacacactgcaccgccagagagaaaaatctatgtagtgctttcatgtcagtgaatgtagaaatcacagctgatgtcagaaaagaggttaagaactacttcagagtgaaacaggccagccgtgttcattcccatgacctaacataactaaaaaccagtagataaatagtggtactgccctatttattattagccttttcaaaccagctgtctcctggcttatggcaaccc

SEQ ID NO: 710 - DNA, 553 bp, Homo sapiens
gcattcccgacatcataaacgactcagacggatgcggaaaccgagacggcctggatggaaaactctttcaaggaagaccccagggccctgaacggaattccggatattttctctaaaacgtactacacctgccttttcccacgaagtatcattccttgattcaggatcaggctcaagagttaacccacctacggcagaagatgaagcttgggagagtggcctctgctcttctcatccagcatgtcaagaacacactaaagacctttgaggagctactccagagcaataactttgaccactatatggagcagcactactgcgagcagctggccaaaggaagccagctggcagagagccttgccagaaaattcagcacaggaagtggaacacccatgtcagcatacgatgactgtgaaagcaaacttgaaaaactgggctctgtgtgaatatccaatgttgaagcaccttcctggaatgagtgaacaaagttaaggacttgcagagagagttttctactggaatgtaagaggttttgaaggctctcttttctgca

SEQ ID NO: 711 - DNA, 524 bp, Homo sapiens
ctctgtctctcctgccaccatgtgaagaaggtgcttgtttcccctttgccttccgccatgagtgtaagtttcctgaggtctcccagtcatactgctggttaagcctgcagaacggctggtcttgaactcccagcctcaagccatcctcccgccttggcctttcaaagtgctggattacaagcgtgagccaccgtgcacagccaagacacaattttaaatcgagcggtcaggaagcctcctggagaaaatgacgtttgaacaaagacatgaagaaagtggagaatatttggagaaaagcatttcaggcagaggaaagtgccagggcagaggccccgaggtgctgctgacagccatcgtgtgctgcggaggaagattgcctgagaatggagccattcaggaggaaatggggcagagaaataaagagaaatcaaatcccatcttttcagtcccgcttccctcactccctcatccattcttcctggcagactattcagttgtgctttttaagatttattctgtttttg

SEQ ID NO: 712 - DNA, 479 bp, Homo sapiens
caaacacttgttgcttgactgatacattatggcgggcgggcaaggcccccgatcacgtgataccgccccccaactccgggcggaagaggccagcgacagcgctgcacgaagcgagtgggcgggcgctcgtgcccggctaaaagatggctgctggcgcctggcagccaccgcctgggaggttactgtaaggcccgcagctcccgccagctcccgcggactgctgccgcctccttaccatgaagccagtaagtcgtcgcacgctggactggatttattcagtgttgctgcttgccatcgttttaatctcctggggctgcatcatctatgcttcgatggtgtctgcaagacgacagctaaggaagaaatacccagacaaaatctttgggacgaatgaaaatttgtaactcttctggatttaattatctgaaaatacagttctttccctcatgcttatgtagatataaaaataaaattcataa

SEQ ID NO: 713 - DNA, 553 bp, Homo sapiens
gtcccacggtgggggcgcgccggtctcccggagcgggaccgggtcggaggatggacgagaatcacgagcgatgtggccctggcgttgagtttgtggctgtggtcgcttcggggccccggtggcgggaccaggggctcgtgagaaatactaggctttagaatttcaccatatgaattttgggagagaggagcacagttcagcccataactaacacacgacggaatgaagttgataatagtgagaccttgttggtacaagactatgtaacataacctgcgcttctcaacaaagaattgcttttctgacttctgcactcaatagcaagacaaatctctcctctgccttctccttatcagactactcaacatgaaggcaataagaatgaagacctctatgtataataattgacttccacttaataaataaggttacttggtacactggtcgacaaaaccttgaaatgttgatgtttaagggctgttgattgctggcagcaaagaagtccaactgtgctggtacccgagatagcgtctccacattttcttccaggatc

SEQ ID NO: 714 - DNA, 695 bp, Homo sapiens
tacgcttgatgcaccactacctttctaacctcacaccctcacctgtttacccctacgtcctcaagacctgcttctttgtttgatcaccaataaataatgtgggctcccagagctcagggccttcgcagcatccataccagcgttggccccctggacccaccttatgcactcttaacttgtcttttctcattcctttgactacgctggagtttgtagcccccacggcctggtgttgggtctgatcaccccaacatttctggcacccaacgtggggctacgaacactccggtgaaggaacactagagtgtgcggaagcggaggacacattgtcagaggacacccaaggacgactgaaagaagcttggtggaattcatataaagttgcgagtttcaggttggttggctctgactgatcacctgtattatggaccatctgtgtgattatggggaaaagttcaggacaccagcaacctacattggataggaccacctctgactccagggattgccactcaatctttctgagattagcacccacatccaacaaggtgtgatcctggtgatctttgaaaaaaaggcactgaaacaaccatgatttaagtttttggtattatgaatgcatgagaaattttctgggaaaaaatcataactatattaagaataaaaaataaaaaattcctaaggaaaatacttga

SEQ ID NO: 715 - DNA, 526 bp, Homo sapiens
gatcacaatcaagagtttaaagacaaccggtctctgctccagccacacaggacttcttctagtacctttactacatcatgcctcccctgcctcaggcttctgctgggatggatcgagcacattcaccctaaaattctgattcagaagatctgagccttctgaaaaaaaagcattgagagcataaaccactcagaagatttatagcttaaagcagatcaccttaaggtactggaatcagtcagtgcttagatggaacattttttgaggcctacatcttcactgagtgcccttcttctctatttcctatacttccttgtttctttctgttcccactgcatcccttatggatttgtacaaataatgctgggttcttttcttcacccacatgcagcagttgctgctggatcataaccattccttctattggttttaaaatctgtttttctcagattccttacacttgaaggaaaaaaaaaaaggacatttagcctgtttttcttttaagcaataaaaattcttctctcac

SEQ ID NO: 716 - DNA, 3533 bp, Homo sapiens
aatatccagtcagtgtaaactcgtttataatttggtcctttgatttcaaggagctatgatgcagttcgttgtggggatgtgttgtctccatgtcatacatgtgactttgtccatgtttgcacccagttcaaggaagacacaaccctagggaaagacaaccctccccgccaagcctctcttcccattcttaaacatagggtggcgttattcaggttggaccagtttaaaaagactaacgcatttgtcctcgttgttgggtgttttttttctttaaatttgtaaaacaggaataattgtgttaggatgaagtatgatactaggagaacagggaaaactaacccatcgtgttaaaagtcagaatagtgcttaactctggcaggaggtgagatggttagtaattcagaagggggtgccaggagagcttccagagccattgaaatgttcagtagcttgatctgggtgatgatttacatacataaaaacatattaaactttgaacttaagatttatgccttttactgtttgcaccctataactccaaaagaaaagtagaggggaaaaagagtccctgcaaaaggcagtcttgaaagaaagcaagtctgtgatgtggagaatgcattggacagctctcagcaatttgctgtagcttgggcagagagataaaagctaatgccagcatcaggttgcccaggcgagagaaggcctgaaagaagacagcgtggagaaagtgtcagcaagcttcagcaacagcaggaggcagatggtaggagagtgggcctcaggtgtggtgtggcagagcagagtagccacacttaggccccagagacagtgtcttctcaccctcagttgaaggggcaggaaatcaatcgctctagtcacccctaagctggaggacggacctaaagttgccacagctttgagaggcaaagaagtttgctcagtggcttttagagacttctagggccctgggaccctgacactgaggaggagcaaactgaaggggagagtgggcacattccttgttggctgctgtggtgagcagcagctggtcgttgtcagtcaagctccggaccactctgatgatgctcactgcattttgatggagtaagccagggacattaccactgtgtttgagccatctgaagtattcctgggtgggtctgcagttggcagcccgtgatcctttttccattcaaggatgatgcaaaggtaaggggccaaggctgagctctgtagatgcctgtgagagcctcctggtctcaagaggtcataccaagggccttggccaccaaggtttcgtgaggaccttgaggtggtttcgccatcacaatgtcagacgtgtcacacaccatctggtatgtcctcactgtatagaggaagaagggcccaagtggtgaattatctacaagtttgtagcaaagctaatactcagactccctctacagccttgctactcagtgtagtctgtggtccggcagtgtcacaccactggggtacttagcagaaatgcagcttctcaggctccactccagctctcctcaatcacagtctgtttttttgtttgtttgtttgtttgttttgagatggagtttcgctcttgttgcctaggctggagagcagtggtgcgatcttggctcactgcaacctccacctccctggttcaagtgattctgctgcctcagcctcccaagtagctgggattacaggcgcccgccaccatgcccggtggcgtgcatggtaatttttgtatttttagtagaaacaggatctcgccatgttggccaggctggtcttgaactcctgacctcaggtgatccacccgccttggcctcccaaagtactggggattacagatgtgagccaccacgcctggcccacagtctgtattttaacaagatccccacctcagtcttaggcacatggattctcctcaacccccaataccacagagtctattaatttttacccaatagggaaggggaaaaagtcaagaaagaataatgaattaagtaatctttccccctccaggaagctctttatttaatttcgctcccatgaaacacaatttgaagagtctctcaaataaacaaattccattttctgataattatttaattgccccacttttgaaatttttgtcaaagacgactgtcactccctgtcagaacttctattcagcacagtataccaagcgtttctccatcgagttgttataatatgatcaaaaagcagggagagatgctgcttggttaccctgtggggccttatcggggctcagtgcagtctttccatgtaggcattctcaaatactcaattgaaacctgattgaggatcatttgatctctgttggccctagtgcagtaggctgctgagaaccactgatgcaatagactgagagactaactgcctgcttccctgtcagcccaggctctgctaaggccgtcttagttacagaagaaagtggggcagagagccctgcaaggattacattccattcctaacggagacaggcaagcgttcagtgcccgaagcagggcaggcctttgtatggctcacttttccctgtaccagcctcagccccgtacattcagaaagccctgtcgggaacgtgcgggatcacagcacaagacagtcattcactgattgattgacgacgtcaacattgcggaatacctatgttaagctgagtacgagggatataaaaagtaggccctggagagtgcctctgggatgcacataaccagacaagataaagaaaaggcagatcacgagatcaagagatcgagatcatcctggccaacatggtgaaaccccatctctactaaaattacaaaaatcagctagacgtggtggcgggcgcctgtagtcccagctactcaggaggctgaggcaggagaatcgcttgaacccgggaggcagagattgcactgagctgaggtcatgccactgcactccagcctggcaacagggcaagactccatctcaaaaaaaaaaaaaaagaaaaaaaagaaaaattagggcagcttttagacatgaggccccaaagtgccaactagtgcacctaaacttcaactctcttttgagtgttttatgtatctactcagcatccagttgtaaatatgcaaaaatcaatgcctactgtatttaaaaattactaaattcacaataaccacacagaatctataataaatagaatcaatgtaataatgactcagatccaggggaagaaaattataaaattttggaaaaaatgatgagctattaattaagaaaatagtttgttccttggtgagaagactcaatgtaaatatgtcagttttctcctgacttaagtcttcaacacaggcctaataatattgcagtggcaaatgattgccaggggcaggaggggatttggggaagtggtaaaaatgatctgtgtcttggtagtggtcgctgcacaactgcatacatctgtgaaaactcactgaactgcgcactttaaaagggtgaattgtaatatacatacctcaataaaccttacttaaaaatta

SEQ ID NO: 717 - DNA, 708 bp, Homo sapiens
aactgacataagctgacactctgctgtatatcttggcacaatattgctttcatctctggagtcgggtgtcttacaaatttaacattgtcagttgggaccgtccaaagatatttacagtaatgctgaggtcaagcaatggcagtggaactgtacaggatgtgggggctgggccaaagccgtgggactccggatttattttgtgagttggagaattgtctagtcatcagaccaacagaggagcaaacctctaacagcatctccctgcttcttcccaccctctcaacaggaggcattggagaaggtttatctaatgactgacatctgacgcataaggtgcaggcacacttactcagggtgcgaatatttactgagtgtctctgtggggccatacactactctaggcactggacatacaccagtaaagagaagctgtcctcatctgtcttattttctggtcttaaatctaaagccaagaggcatttagcagcacaaatcctcttcagcagtcaacactcccaaagtttcaggcactgaggaaaataaaaacaaaactgtggccctttcccaagaagcgcacagtgtccacaagaatgtgaaagccatctggaaactgataaactgcaaaaagctcagccatcttctgttggcaaaataaaagaatggatgtccttggaagaacgatgtccttggaaagtcatcaaataaaaa

SEQ ID NO: 718 - DNA, 2282 bp, Homo sapiens
aagagcaaaatgctgtctgtgtctcactcaatgtggtggctgctacaggaggatcttcccaggccttctcagggaattcccatcaggatcacaggaatggtacctggcagacacaacccagtctgcaccttccatgggccacagctgatggtacgaggagaggtgtgacatctgcctgacctcagaaatctaaatcattccttttgcaacaaaacaataacagtggagtgcgttccctgagtttttggagagaaaagaaaaataaagttcagaggcaaaacttggtagaaattctgaagcctggatgacagtgatgactccgcgcagcaggaacgtcgcgggccttgcctggccacgtcctcttggctggaggcatgagtgtttatgccaggctgaagaagtcacttgaactcatgtcctttgactgaacattttttatgagacctgcataaatcatttctttaaaaatggcatcctgggcatggaggcagtctgctttttgcaagaattcttatgggcaaagtctcttcagatgagaatgattctgctttaattccctctgccttctgcccttgggtaagctcactgtgtctccttaaacactctggctttaaccagtttctgcgtatcattcagaccaacattcctctcagttatcagtcaactgagagactgagaaataaagtcaatagaatgaaaagaaaatagtcatatacagtaagctcgattttcttcctaccgcttcctcatatctttgccaagtcaaaccaaactacctccttctagaaatttgtcttataaattatcttcatgaccttcaggaagctaatatattttaaggtgtacaaagcactaaaaatactgattaaaagatcaattggacttcagcagaatttagaacttctgttcatcagatgacaaccttaagaaagtgaaaagataagtgctttcattagttcccacaacacaggaggaagccctagaaaatcaatcagaaaaacacaatccaatttaaaagctgagcaatagcctgtgtgggcacttcacaaaacgggatatcccaatggccagggagctatgaggaggtgatcaagatcatttgttttcaagaaaatgaaaattaaatccacagtgagggagaattgcacactcaccaggatgcgtaaggctaaagagactgaaaatgccaacttctggggaggacttggtgatgagaactcacctattgctctgggaatataaagtggttccaccattctggaaaaattcttcagcaatatttactaaatttaaagatatgcctatcctatgacccgaaatcctgctcctagctctaactatgggaaatgagtggcgcagtccacaaaaggacatgtgcaagaacatccatagcagctttatgcacagtaaatccaaactggacacaacccaaatgctcagaacaagagaagaaataaatacatttttatagccttgcaatggaaaactatagtgtgataaaacaataaaccacgagtgtaccaagaatattgatgtttgtttcacaacaaacatgtgcgtgaaagaagccagacacagaagagttcccactgtctggttccatttccacaaagtccaaaacagacacaactaactgataatgacaaaaatcagaagactggtgatctccagacggaggtatagacttaaaaggggccaagggaaaataaggggaatatgaaccccactcaaaggtttcacacacaaagaggcagagtagatacagagtgaataaatacattattttcatgtgcatacaatagatcaagtaataaaattctgagagccgcacatatgttatttagttcatacaaaaaccctgggtttattctgaacccacctatgagatcacatggagagactggctccacctgtgagatcacatggagagactggctccacctgtgagatcacatggagagactggctccacctgtgagatcacatggagagactggctccacctgtgagatcacatggagagactggatcctgaaacacaagggtgtgctgcatttctggataccatcgcagacctttgcaagcagttccatgaaacaagaaaggagcattaggatcaatggcatgagatttaattaaatttgcattggtttttctacgttgactttcactttgcaaccaaagaacaccattctccctggcattgtggtaatttaaaagtgccggggaggtgtggctcactaagctaaactcaacctcatcagataaaataattagttttg

SEQ ID NO: 719 - DNA, 1519 bp, Homo sapiens
aggaggcctggggaacaatgagtaaggcagagagggaacagaggcttgtaggccactgtgcggactttggcgtttagtctgagctggggacccactggaggattctgagcagagcagtgacatgattgcgcttacatttttaagacttactctggctgctgtgttgagaacagatgaccatggggcatagacagaagcagaaaggttggctggaggaaacggagagaaaatttacatctggtggagcataaagaaaccagctagaggactggccttgtcattatctaactgtgttgtgacgaactggcacttcctcatctctaaaagcagggccctgaactagaagaccgccacgtcacatgatgaaaaacactcaaactaacacttcttacccttgtgagcagccctactagcagatttaatgtgggaggaggttcacactacgggataaaaatcaagttttaggattccattttatctaagctgaccaccacaaggcagaggatcaagacttagctaaatacagccctcaggcaagcttcacttccccatctgtgaagggagaataaatacacatgttaagataaatgagagagctggtcaagtgtttcgagctctttggcagacaagcctgactttccaaaaaaagacaaaccacaacttcggagccagtgctatttcttctgtgcatggtgaggtgacttccccagttgtaaaggatttagagctgaaattccatattgtctggagctataattacaagtctcttgcactaaaacagaggtcagctggcctaaagcatgctgaaagaaggtaaatgtctggtcacatttccatgtggtatactcctttcctaactttttggcacaaatttcatgttgatagaacattcattcactccacaaatatctggcaagtaggtgctgagtgctgtgtatagacgagtgaacacaacacagaccctgccctcattctgtgtagaggacagcagaggagtaggcacagggctctcagctagggcagtaccaccctatgtctggggggcatttcggacatttgggaggtgctgtcaattgccaaaatgaatggggaaactctgctagcatttaagggtgggagccgtggtgccacaatgacctgtatgaggaaaaccagctccaggcccgcatgactagtgagtgtactgctagacattcataaacatgaaaaactcttttgtgggaaaacagcctgttgcatagcaagagtgatccatcttgaagtaaaactgccatgatgaccaatgtttgacgcctacaattcaaggtggtccagtagcacagataagccctcacaacctccccgtggtcatgagtttctaaaggaagtcagggatgatgagcttcctgtgtctttaccctaaaagcttgctatataaaggatactttctggaggttggttgtgagaatccaccatctcttggcctacctagacatcgtttctgtttctaagtctctattaaatatttctttctgagaaa

SEQ ID NO: 720 - DNA, 1922 bp, Homo sapiens
atcttcttcctgccctcgccgtggcgggcgacggtttctcgcgccgtggctggctcggccggccggggcaccgcgccgggctccatgcagccgggctgcgcggtcccgcagagcgggcgcctccggggctcgagtcggggacccggcaggagcgggccggggatggcggcggcgggcggcgggtcggccgtggagccccggagaggcggccgccaccaccgctgcccgcagtctgcgaggtgtccggcggtccgctcagggcctcttttgcagactcggtgcccggagtgcgccggcgccgcccgccaggtcttggcactgctggcgcggccgcggcggcgggggcccggctccagatcaccgacccccacgagcgccggccctgcctgcccgctattttggttccatctcttctgcatatttatgcttgcctgttacattccctggcctctgagtgtcctttggcagtttccaaagcatttgggcaagaaggagcttgggcagcttcacaacaggtggggacgcgcaggggaggggccgcggccggaccggcagagtttcaagggctggcgcgccggcggactttccacactgtctttcgggactggggttaggagacagcccttggccaccactgtgtccttactttgtcgctttacttggggctggacctcccctttccagctctggcgtgtgaccccgcaacgagcgtggtgtcgagaccaccaccagctggggcggtgggagcgaaggtgccccaggctcggggaaggtggaaaccttttccccgctccccaagtgattgttgcgcgctccggtgaggggacagtggtacctcgatttcccgtgtgccagcttcgggactcagctgtgcttttgtgtctctttgattagcaaaagcaaaacgaattcctccccgaacactaagcttcctggaaacttccctagacctaaacttgagaaccgcatataaatgggccttgagggttctgtcgtcagtagcgggttacgtgattgcaaacgagcaagtttaaaacggagtgggctttgggctgcagagccgcctggcattctgacagctgagcaggaggcagaggtgagagtccaagatggactaaaaatgtcccagcagctgggagcccaacctcggcccaacctcgttgaaaggaggaacattcggtgcagccgtcggaaccttattatttatgaaaggggacagctcacaggattacatttttctaagccaatcctgtgaccatcctccatgaaattctctattttggttgcatgtggtcaaaactgagcctcactgaaacaattgaaaacaaatactcccgacaaatcttaagaatcgttttgaaaatcaaaaggtggggaaaatgttgtggcttctgagctttcttcagcccatattctattattctctgatgttttatggtgtaaaatcatacccattccattatgtattgattgtcaagaaggaagtaggcttttattgctatttttatgtcagtttccatttactgtctcaccacatttattgggttattgcctttgcctttgactcaacaggagctggaagggtaggaatcccaaattctgttgcctaaggcagccagttgtcagaatggactttcctcattttctattatgaggcctgaggaaagacattcagttccaaaggctgtgcctatccttttaaatagaagagagagggcccggcacggtggctcacgcctgtaatcccagcagtttgggaggccgaagggggcgaatcacgaggtcaggagttccagaccagcctggccaacatagtgaaaccccgtgtctactaaagatacaaatattagccgggcgtaatggcgggcgcctgtattcccagctactcgggaggctgaggcaggagaatggcttgaatccgg

SEQ ID NO: 721 - DNA, 594 bp, Homo sapiens
cacgtgcgaatccacctgtggagtgcgtcccctctctggggccaaggcctaggggaggccgaagcggagaagttgcctgaagactgggaagtaagagtaggggcgtcggaggaatcgaagttgcagtgacatcaggctcggacagccggcggactcctcgcaaggcctcaaacttcttcatgggaaaagatggcttctcttttttaattgaatgaactagaagaagttcattgttattcatcaacttcaaagagactatatgaggccccttggccaggactacagagcagtattttttaatcagaaattatagccaaaaagaagagaccagaacacatgggtgagtgttactgaattattggttttccttaaatagtctagttttggtgtgtgagaggaagaaagttgcaagtgcttatgtgccaggtactgtgctaggatctgaggatgcagaaatgaagaaaatgcaatccctggccctcccacctgttgggggaagtggacttcgcaccctgtggataaggagtacacagtgtagcactgtggttagaagcaccagctctgtcatcacagggcttggcttgtttcctggct

SEQ ID NO: 722 - DNA, 513 bp, Homo sapiens
ggttaaaagcccagagaagaccgccaggggcgcgtggaaatggtgtccctcgtctccaaggcccagacggagcttagcttcctcttgaaggagccatatctgtatttctggtgaacgtcgtgtttgacatcaaaggaatgtttagagacatgatttcagccttccttacgcagagaatgctcatcaaaaaataaaatggacacaccatacactgacgtcactcagatttctatggctggaagttaacaaatattgttttcaaatgcgtgtagcctgatgctccagagttagtttggcgagcctcagcattttctgtcaggcacaagaaagaaaagactccagacaccatgatgtggaacgtggagtggggatgtttggtggccttgaatgcctattccatattgttatgcaggctggatgtgatggctcatgcctgtaatcccagaactttggaaggcctaggcaggtagatggcttgagctcaggagttcaagactagcctgggcaacatgg

SEQ ID NO: 723 - DNA, 591 bp, Homo sapiens
ttgactgctaccatgtaagatgtgactttgctcctcattcatcttctgtcatgattgtgaggcctccccagccatgtggaactcaatgacattctggactctatgcctgagcctaatgccataaaggaatgaagctttagcagtcttctgggagaggcaatggaatattagcagacgggacatgaacagaagtttataaagctacttttgaacctatggtagcacaagaaggatatgcttagactagtctgctggtcccacaggaggatatgcaacatgtgaggcagagccatgcccaagtgaactcaactggttccagagtatgaatgagaagaccagtagaaccatccatgcaagactgacttggacaaatgtcagccaatctgaagatctgttggataactgattcagcgttttaagccactaagttttgggatactttttaatgcagcgttattttggtcagagttaagtggttaaagagtcaatattcttatacatattacacacagtcagatagacagaccgatacacacatgtgcacacacacagagaataatataggtctaatggcttagaatttacacttta

SEQ ID NO: 724 - DNA, 2566 bp, Homo sapiens
agtgctcctgctgaccttccctgtctgcagcccagctttggactgtggagatgccctcagcctctactcagtggctccagcctcatatttgcgtgctatacctttaacctcaagttctcttgctgctaacttaagctgtgactgtccaggacctgcacacacacatatatgcacgcatgcacacacacacacacacacacacacgcagaaggtgaacacacaggatgaggccctgaaaactcatttcacccgtgtacctcacccaaaaattcccctttgtactcctatctttatctctaacagacagcatgaaggtagcccgaagtcccctcaccctgtctgtcctcctgattctctagcccagttccctctagctccagcacagactcttatctccagccctgactgctgaaaccctccagccccagctccagcccctcaggaggggactgcgtgggaggaatgactccagcaagccggcagctgacccgtgtctggcctgcatgcctccccctgtggtccactgccggtggtcttcagctctctcctcgtcccacccccatggtctgctgacagcccagcccagtgcatccctgccatctctgctctaccgctggtcctcccaacaaccaacttacagcttccaattgtggacaagataaggaccattgcccaggctgtctatggagccaaagatatcgaactctgtcctgaggcacaagtcaaaatagatcgttacactcagcagggttttggaaatttgcccatctgcatggcaaagaccgatctttctctgtctcaccaacctgacaaaaaaggtgtgccaagggacttcatcttacctatcagtgatgtccgggccagcataggtgctgggttcatttaccctttggtcggaacggtgcaccactgacatcatggctcggctggactctggaaagcaggaaattgctggagcatgtttgggcatcaatgatgtcatccgctacgaatgccgggtggggttactggactgagggccatgaaaaaagaaagctgcggccctgccccgtggactcactgccattctgttctttctcacgtttcagttcagctcactttgttttccgtccccctccctctactgtaaaagtatgtactcagtgtttcatttcctgctggatctgattcaggtcagtgatgaagttctttgcgagctcagtggggaggcgtttcctccctttcataccggccctgcttagggatgcatggttggttatatacttgcttcactcggttaggcatggaggagaattcattcagacctcataggtttaaatcaaatgcatgacccttcacattttccagagatttagacagttacagtgagacaattaaacattcaccccccaagctgcacttggagatgtgtaagcagtaatgtagtcatgcgctccccatgatatgagagtgtgcagaatgccactccccacagcaggtccaccaggacctcctcagggagcatcttgcctacaaaatcacccatcccttttcccccactttcttcactttccctacgtttccactcccacacccacaaataaacaaagaaactttgagcttattttacaaaagtctttgaaatggccctcctctctccgatgctcctgggccctggtttggccccatctgtgcagtctctctgatgagtgtgaaataagccaggtttggctcatgctctccctgtgagcttgctctccccgtgagcctgccctctccatctggcctcactttgtttgtgtccctgggtcctttgtctctgatcctgggatcctggtggtttcctcctccccgcccagcttgggtccttttccccagggttcttccctatctctacatcagaatttcctgctttctcccaaatatgcatttccctggcccaggcatccattgcttcctctcatcgtgaggtccctgcagcagactgccaatggtgttgtggccatgccttcctccacaacccagggaaagctacatgtgtgtctgtcccatagggaaggagtcatccctgtctcttcagtgtggcatgttcaggaggaaggaaagtaaccagcgtcattctcaatttacggaaactgtttatcatattgacaagaagaagaaagctttgcgactcatgagaatgatgttttcttctctggtacataaggttatgtaggtccaatccattgtgtagaagatcttttctcccttaatgggatgtacacttatttttagcacaagtataaaactactttaaatgaagtcagcctcagccagggaaatatgctgagtaataatgttgccaggtactataccactgagttgagtttgcaattcactgctattaatccctgcatgttagttctgaatttttactctttgcatacgtagaaaaaatggtgtttctcttcagagtcaaggagggaaaaaagaaaagttaaaagacacttataacacttttgtgtccacccctaaaatcagcatattgatctactatttttctaggtattgatggaatattgactcatatactttcatacaactg

SEQ ID NO: 725 - DNA, 1031 bp, Homo sapiens
aaaaaaaaaaccttaaatgcccatcgctaagtgaaagaagccgatctgaaaagactacatactgttatcagccttttgccaagctgaacacaaggggatgaaaagaaaatctgggctcgaatgtgcaatttcatattttctgttaaggcaatttacaacatatcataaagctgcattaataaacagatgttccacagtctgcagaatataaaataaatgtcttgaataagctacgaagaccaaggcacttttcggagcagatttttttgtcttaaagttttatctcatgcaaacactgcgtataacacaaacttatataatcaatgcttttagcaaaatgtcatagtagaaccaaggcccagttgttagctgaaatctatataaatataggcaggagtagggctgattggagccattgtacagtgtcgggaacataccaggacactgagaatagtgtcatgtcataaggacccagagcagatggaccctgctgtgatgcacaaagaggaccacgcaagatatgataaagatctacatcactgaattttggttccatttttgtatctcagcttccaggaaataaaaaagaattctaacattcatactttcagtattttatgtgagaggttttgttgtcaaaatcaagtctgagagcaatgtttgttggggcctttaattggagtcaccaagcgataaaggggacattgtcctcaacaataaccctataataaacacgttttggacaataaatatatgacaatttcttaaaagcaatttcttgggcaatcaagacagtatggcttgagtatggagttatacgatggtttggattaatccagtattaaatctttggttattacagaaatcaatggagcctattcttccaaataatccttaaatattacttatctcaactgagattttggtgaaaatttagctttagagcttttattgacctgccaatgacctgaagttaagattattcttttctactgaatgaagacaaactaccttataaaaattaacccaga

SEQ ID NO: 726 - DNA, 3597 bp, Homo sapiens
gaattcctacacggctgtgcctctcccaccccgtcctctttgctcggaagggagacctggtttgctctcctccatgacagcccagcccctgctgtgcacaggggtggggctcgggatccctccctgcaccctgatgtttattaactgtagatagtgaatttcaagttgacaggtaccttctcagggatttatatataaatatagttagaggaaaagttgaagtctattttactactttttagtgtttgagtaaattatgctttaactggacagaagaaatatttctcagacaatgtcgatgctgctgatgacaactgagatgcctggagctcacccttgatggagacttccttggtgattggagatgggggactctggtggcagaaatggctttggggtaggtgtgaagttgcttcagtccctctgagttgcctcttctggatggaacgtgtgtatcaacaacaatgaaatgcacctccgtgtgcatggaggcggctgatgagaatacagataggccagtcctcgctcttccctccagaaccggccgctcccggtctgacgttggagcacgtgaactaagagtgacaattttttctacttgcttctgtgaataaagtgttctacagtcagcccagcactaaactcaccagaaaagaggagggaacagcacggagccattcatctggaattactcgatgtgcagaggctgccccttggccgcacttgggaacatcgtggacatcttccttcctctcaggctcctcctgacagactcctggcagcactggagacctcaggactatggagatcagaattgtaatggctttgtcatctcagtgtggccactcctgaggcaagaggctcctcctgggagcaggagagagagagtttgtgatgttggttggaaaataggatttatggatgcaggagggccgtgctaggcccctctgcccgcttctctccctgctgttggcggtgaccaggtctcaggagcggagacgaggctgttgtgagtgaaacagaagcccctggcatagggccagaccctaggcctgaaaaggatgcaaagcctgctgttttcaggctgttgggaagaatcgtgcgtaccgagtgattatgatgaaacgtatcccagagaggaaatgaatgggacctgaaaagtgggtctgccacatccctggtagcccgcctccaagagcactacactccccccagccccaccggccacactacatgacgtgggaaggctgtccgttcatccttaccctggggactcaagtgtgctctgcggagtgagtcacagccctgatgtgcaccctgcactactctttccccaggtgcgccggagacgcaggcttgctcatttccgtcctgacacagctcgctgttcctgcggtggtcagagtccccctgtgctgtgtcagctcctggacactactagtctttcacatgataaagcgcgagcactttttcgcttttgcagtatttggggaaattctaacacatttcccggggatttgcccaggtccctccacctcccacggtgggtaactgtgtggattctgcacctggcaatcggcgctcccctttggaaacacctgggggccctgtttcttccagcctggtccttggtttctaccccagccgctttcagccggcacctgcatgggactgcctggagggccacggtccagggaaggacaggtgggaccctgaccatgacagatctttctaaaacaataaagtcccattgatgacaactgcagtgggatgaatgccattgcagcggtcatgctgggagctgccgagagcttacaacaaaagcagttcctctcaagacactgcttgcatcttccctccacgcctctcggtgcatttggaacttgtttatgcgctggtataactcgagtcagctgcttatttctgtgcccttgcactcacaggttccttcattaacattttaaataagtggctaaaaaaactcctctggaggttgtttttgaaagagacaggaaaaagaaacacacagtacctggattgttttgacttattttcaagcgactcagctgaaagccggtgttgcatacacaatttcctcacgctgacccagcctgactaagacttgataaaaggcacagcccttggcagcaggcagtgccaatgtggacagtgtacactaagctgtgagtgtgtgcacgggcgagcacatgtatgtgtactcatacatccagatgaactaaagggacactgggctttgtgctggcaaaggttacgatgctgctgtagcttggctgtgggccccaggcagtgtcagatggaacctgctttgatggcgtgttgttcagtgtactcagtggggtctcacatggcccgaggacccactgtgagcactccgcccgctgtggcacagaacacggctggggtcatcacagcccaggtctttattgaaaggcggctcatatagaacccatttggccaggtctgggccatctctctgcctctgccctatcttggctgcctggaggggcccaggcccaagaggattctttacccctggaagagctccccaggcattcagcctatggcccttgacatttggctgcaggttaccgtcagaatcaacaccatatcctgaggaagccctggtatttccccaagtctgcctatgtattagacactctaatcaatgctaacacagttcagtttttgagggaactagttttgtcataatactacacccctctattgtttttaaataagaaaaaaaaaaaccccacgaaactttccatcaaagcaatggtccgtgttggcctgatgctttaagaagtttgaggaggtaggtatggaggcaccttaacaccagtttttgagcagaagttctagaagctgatttagaactacacagctatggatacacctgatgaaaaccgcaaaaggcgatgacaggcccagaaatatgaccagcaagcccgtgagcctttggggcatccgactgaatttgaaaataataccccattcagatgaacattaaaagccaatgtactggaattctctttgttctgcccgacatttgggggtgtccaaggacctgtgtttttaacaaagatgactttatgaccgttctaaggattgaacagattcctgcacagggtgccaggtttcaagttaggtcctcttagtataagctctctttttttctgaatgtaaacctatttgcattgtcatttctaataatccagtaggtttctggatattgtaaagatactgagtacagatataactgtgtaaatttcatagtgttttattttgaggtgagagttttgttatagtttataaaagatattttcctattcagacctcagggctattttgggacctacaaataaatgtgattcccagcagcttcaatttttgatattcaaaaagttaataatctttaagctaaatataatgtgatatgattcagaaaaaaatgtttttcccttttaacttctaacaaattatgtatctaatgtttaaaaaatatggaaaaaagggataatgtaaaaatgtgggagaattgtggctaaagaataaaaaatcacttgttaaaacgca

SEQ ID NO: 727 - DNA, 134 bp, Homo sapiens
ccctgtattcgaaagtgatcgtgggctgcctttgccctggtcattgatagtgcagggagaggaatcaatgaaagcgcttccccgtgtttgaagggtccactcctatcccttccaaactctggagctttcgtaca

SEQ ID NO: 728 - DNA, 322 bp, Homo sapiens
cccctcccagaactactgttctgtggctgccaatatgaatgcctagaataagttaagaggaagatcagtacaggtggaatagcaggagatattttagtaacagtttaattattaatttttgataaaaggttctgattggtcatttctcctacgaaagtcataattacaaggacttatacttttccaaaagtacctttttaaaaggtagagacagtccaggctgttcttgaactcctgacctcgtgatccacccccctcggcctcccaaagtgttgggaaatacaggcgtgagccaccgcgcccggcgagaccctgtcttaaa

SEQ ID NO: 729 - DNA, 895 bp, Homo sapiens
ggggacagaagagggtaggcagcagaggccaggtctgtggacaaaagccccacttcagagtggttggaagccaggacaggagggactcatggaggtgaccgcttcacaggagtcctttctccagtcgtgctagggaggagcccctgcctgtccagcactgcccctgcctcttgctgtaccttgccagtgtgccctccccccgcccactaccatagtaggcatctggcttttcccaccaacccatctacctttttggtggtccagacctacagtctccttgcagagcactcctcctcccaccctcacttcaagtgaggtttggatgagattgaccacatccccttggtcacaaatattggctcaggaatggacatgtggccctgttcaagcctatgagagccaggacccccagacttatgttagaactcttgagagagatactctgtcttctctgaaccttgcagtatatagaaatgagcctattgatgcaacaatataaatggcactgagaggggtgtccagagctgctggggtcaggggagggaggtcagcctggcagaagccatcttgtggagcatgaaaatgaaagagaccttgagaaaggccagaggaatccaggcctgtggtgacaacatttgagctgctggatcaaacctcacctgaagtccttcctattcctactagatatttttttccactgtgtgggccaatgcattccctttatactgtgtaagccaggcatggtggctcacacctataatcccagcaatgcaggaggctgaagtgggaagatcgttgaggccaggagttcaagaccagcctgggcaacctaagaagaccctgtctctaaaaaagaattaaatataaataaataaataataaaaatataatgttt

SEQ ID NO: 730 - DNA, 697 bp, Homo sapiens
aaactaaatcttttgttcaccagctgctcagcttttcagtctgggtctgagctgaaacctgctgcaagtctgacggtaccaaattacatatatatctgtcaaaatgatgtaggacctaaagtctctctgtaagttgatccttttgaccccatgattaggagcttcacaatgtggtaccacacctggaaacctccagaacaagatctcaaggaaacacaggaaattcctgaaacagcaaaaccccctatgtgaagacgtctgttattcctttgtgtatcaggagcatcactgttaattaactgttgatacacttaaaacagcttggttggcaatgtcctttttgaataaagaagagccaggtgtgtttttcaggatgaactagacaatgctgtcacaagtttacctctacatcttattgccttggaaaaatttcctgcatatcgtggcacaagatggttggctctccaggcagcagttggcgttgtgaatcagtcatctcagcatgtgtctccaagatcccacagcagggggaaaaagaggtggagggtcacatgcctggtgttacatactttgaggcagaggtggtaggtgccatttctgctcacagctcatggaccagaacaaagccatgcatacctgagagaggaccagaaaatattctgaagcagatggctatttggtgagcagtaaatgtttc

SEQ ID NO: 731 - DNA, 547 bp, Homo sapiens
agcgattctcttgcctcagcctcctgggtagctgggactacaggcatgtgccaccatgcccagctaatttctgcatttctagtggagatggggtttcaccatgttggccaggctggtcttgaactcctcacctcaagtgatccaccggcctcggcctcccaaagtgctgggattacaggcatgagccagtgctcctgacctcaacttttaatttttatctatcgatctagtctattattacccgctacttacctacccatccatccattcatccatccatccatctgcccatccttttttttgtttattagctctggtctttgttatatttgttgataggcccaagtaaattagtatgtgtaaaactcacttaaaacagtgcttagcacatggtaagcataatatgtgatagcccttatgatctagtaactcaccagtatcttgtgtgtattagaacaatgtgtctctgtaatattttaattatatctctataagagcatacataaatgacaatatataaatctcaataacagaatgtttctaaccc

SEQ ID NO: 732 - DNA, 529 bp, Homo sapiens
caattattggctcatcaaggagtgtgccacatgccagatgctctgcagaacccaacagaggggttgctcctccatggaaacaacaagaagctttgatcaaagagcctgtattgactccttcagtgaaattcttgactgaaataatcaccttcttaaaatacacacatggtgaggtttgaagaggggaaattgccatccaggtaagaaaccttggccttgtcccaatttagtagtgctgaaggtgtgttcatttgaacatagatcatgtgctaggtactgggaggatacaggaatgagcatgggaataaactttacatagctcttgttcaagcaggaactttacaatctagttagaataaagaattatctgtgagtcctggttggacagtgtgtatcccagcactatctaggggtaaggatgccttcataccaacctcgtcatgactgtgctaagtggcaggtctgatttggttatagaactggatacatcagacagttttaactttatgctattaaatatttgaacata

SEQ ID NO: 733 - DNA, 207 bp, Homo sapiens
gagacactggtctggatcgggtcggtggagtgggggacttacatccgtgatggccttcttggccttctcctcagcattcctgcactcctgcactgcctcctccacttcagtctggagctgggacaggaatgagcaggggagctgctcacctgggaatgcagcagctgcacccgctcactagtctcaatcagctcctgctccgccagc

SEQ ID NO: 734 - DNA, 460 bp, Homo sapiens
tgcttggacagagaggtctccccaacatcacgaggcagcaaactgaaagcaagaacgtggcgaagtgcaaacaaatccagtccacaaaaggcagaaaacaacatttgccaagcccaggaaacagataaaaaaccccaccagcccgaggggcttttcctacctcggaatcggaggagctgttttgattcgtttctgattcattgactagagacgatttgacatcagctaaatccctctctgccgaggagttttcggagctcttctcctcctgttcgccctcgtctttgaaggaaatcagttcgtcgttggcgcctaggtcatcccctccaccgccgttcagctgcggcatttttttttcacccaccagcagcaattttggaagaaaaatgaaggaggaagaaaagccaaaaaaaatcacccccaaaaagttttgcccccccaaaaaatattgcaagaaaaa

SEQ ID NO: 735 - DNA, 1807 bp, Homo sapiens
atttttattttacagacgggaaagactgagtaaatgtgagaaaattagctgaatagccactactttttttctggcataacctacccctgcttaagaacttccacgggcctttgattggggtttttaaccactttaacaaaccatgtaaccctgagagctatgcttgttggacaacatggtgtaatgtaccacaggctgtagagccagatactggggtttgaatccttattcaacatgggaacataggagctatatgacattaaacaactgtcttgtcttcactaaatttctatcaactcatttgtattgtggggataatagagcctgcttttacagggtaagtgagataaaatgaataaagtgtctagacaatatcatagcatagtaggtattcaatcctggtgagatcctgtttataaggcccactactttgtcttatcaggcagaataacaaaggaacaatatttaaaaagcaactagctcaaatctgtccccagaaggaaaaacatatcttgtccttggtccttaaaaaatttcctctgtcactgtctagaatcagcacctaagaacacaggcgtttagtgttgactggaataaaatggaatcgggtgctggtgcagggagattgagcagggatgaagagagaaaatcacagagtggaaaggatcaggtttggagagttcaatggggggctgccaggacataagcctaatatgtgtgggacaaggaaacccctctgaaactcataaaatggtattgtaatacccatctatgaggtggttaggagaattaataagtaagtagaactgtgctttgtgaattgtaaagtgaatttatatataaggtgtcaagatgaaagggaaaaactaagaaataagttgcccaaagatatcattaggaccaggagaccattataaagtatatccaggccgggcacggtggctcatgcctgtaatcccagcactttgggtggccgaagcagacggatcacaaggtcaggagttcgagaccagcctggccaacatggagaaaccctgtctctactaaaaatacaaaaaattagccaggcatggtggtgcatgcctctaatcccagctactcgggaggctgaggcaggagaattgcttgaacccgggaggctggagtgcagtggcatcatcttggttcactgtaacttctgcctctcaggtccaaacaatcctcccacctcagcctcccgaataactggaactacagggatgcaccaccacacccagctgattttttaattttttttgtagagatgggattttgccatgttgcccaggctggttttgaactcctgggctcaagccatctgcccacctcagcttcccaaaaagctgggattacaggcttgagccactgcacccagcctgttgatcatgttcattaatctgtttgaactccatatattaaggaaattagtcctttgtcaaatatgttgcaaatattccctccaatttgtcacttactttcattttgttggtggtttttctgttttgttgttgtttttctgtgggtttttttttttttttttgccatggacatgtttttagtacttatgtagtagtcagatgtattactcattttttctgtgctctggatcttatgctttgaatggctttttgtgaattccaatattttaaaaataatttacccctagcttcagttcttacatttaaatatttgttccttctggaattttagtgaatgtggacaaggttatgcttcagttgccttaactagttgccttggcatcattaataagttttcttttcctctactg

SEQ ID NO: 736 - DNA, 343 bp, Homo sapiens
agttggcttgggtccattggattaattttggtcaacaggctctgaagaaaaatgacatttcagggaattaagagcacgtgttcctccctctaccttctctttcttcccccagtgaccttggaggctacttgttgataagttggttgaatctgaagagcccttggatacggaaggctgactgtgtatggctactctgaagaatgcaagaaacagtgtgtgatacgcttagggcttagcacattttgccatctatggagcatgtggtatgagtcagaaatggtgtttttgcccaattcagagactagtgcagaagacagacaaagaaaaagacaactcaggtcta

SEQ ID NO: 737 - DNA, 2968 bp, Homo sapiens
agtctgccagattggcaatttgaaacgcactgtctgtgacggctgctgaggctgctgcgggggagtgaagggctgtcatgacgatgacccctggaggattctgagctctgacttccctccttgtcatgttgcctgaggagaattgcagacagaccctcagacctcaaatagtctagattttgaagaccctgctttggctgagatgaggccagcattggagtagaaatgctgcttgcttcactgaagctacaggtagaagctgactaccaaaggagaaggctgaggagaaattgctccatgagataagacatgcaacctatgtattaagtaagacattgttgatgatgaagtctcattctgtcgcccaggccggagtgcagtggcacgatctcagctcactgccacctccgcctcccaggttcaagcgattttcctgcctcagcctcccgagtagctgggactacagaggcaatcagtacaactgtgcagaacttctggaagattggcacaaagcattttaaaaatcactttctagtctatattaaattcttcaagaatacttatgaagaaacaggaagtaactaactttctttaccttttcaagaattggctcgtgagaaaaggatttccagtattatgttgaatagaagcggtgaaagtggacatcctttccagtgttccagttctcagagggaatgctttcaacttttccccatctagtatgatcttgacgagaaccttggcaatatcctgaatttagtactaaaagcaaaggataaggaaggtgttatgtggcctctgtataacagagaatgttctatactgaaaacttatgatatactttctaccttagacaaagccagacagatttttctagtttcaacttaccattatacttcctgaaagtattttcaaaagagtcatttgcttgatgaaatttctgagttcttgtttgcctgagaatatccttccagtggccactaaagaagaaaccttcatctagtctacatcaccaagagagaacagtgacagctaacactgctccagcctctaccaccttcttgacgtggcacagccatagaacacaggaagtcctcttagcttctaatgaaattggaaacatgggaacatgccctataatgaatggtctatatccaagagaatacactatattaaagtgtagtagaaattcaatatttataaactataaacttccattatttaaaacaagtgtttgaaatagtaccagttccaagcttcgttttcttcttcaagtattatatttatgatacaaaaatggattttctattagtctaaccatttttaaaattctcaaattgagtatttttctccagctctaatacttttcagatgcttctttgatgtcatttacagggagttgaggttttttaagtgtattatgaccttccaggctttctggtttcataagaacctggtgtctgggatactatcaaaaataatctgtcctcatttgaattaccctaacattttagctacaaatcaacaggcttcttgagggtagagataatgcatccctagcacttagcctgaagtctctgaaacagtacactttaatagatctgtacctctttaaagtattatacttatttatatttataccatttctgtgactaggtatgttttccaactacatttatcattttgtgttattacaaacgtgacatagttaaaacagaaatgatgaaaatacagaaaaccacaaagaaataatcacttgtaattactgcctatattatagatatatattgtatatttcccacattagcaagccaatttaccaattattatttattggttaattagcatttcatcatatggctgtccatacttatttatacatactatatataacaatgtggtggcaaggaaggtgtatattattgcctatgatcttataggcaagataaacaatgcttcttagtaggtgttcatttagtgtaagtcctttataaaaatcattacattactgattttaaattaaaaagggaataagccagtggatttatttattggtataacaaaactttgtaaattttataccgatattttctttcaccaaaagttcaattcaaatccaggcatggtgtctcacgcctgtaatcccagcactttggaaggccaaggcaggcggatcacctgagatcaagagttcaagaacagcctggccaaaatagcaaaaccctgtctgtactaaaaatacaaaaaaattagccaggtgtggtggcatgtgcctgtagtcccagctactggggaggctgaggcaggggaatcgcttgaactcaggcagcagaggttggcagtgagccgagatcttgccactgcactccagcctgagcaacagagtgagactccatctcaaaaaaaaaaaagttcgattcaaaattattccattataaactatctgattatattatccagaatttttcaactcatatcgaaatgcaaatttttaaatatttttcccaaatagagtcttaatagggttaaaggttgatagtctcacaataatacactattccacaatgtagagcacttagcagtatccataacaaccattattattttaaaaatattttaatagtaatattctttgaaatagttgatgatttattgtgacagaatgaggagaacctaagaaagactatttatcgataaatgaatttctaaccatgctgacggaaaagcagctttatattttacttttgaaagaaggtgatggttgtatctgaagaaaaaagagatacaagctactatttctaggctatccagttaaaggaaagcactatgtcaagcatttgaagtaaaagaatgttgtcttcagaacccaaacagttgtgtctcagaatacaaaggaatgtaatacatatattggtctatcagtcagaaaacaaaacactgtaaaaaattaaaatcatttcaaattagt

SEQ ID NO: 738 - DNA, 602 bp, Homo sapiens
ggcctagaccactaagggccgtgacgtggtgccgctgagcttggaccccgaccagaagatagagattgaaacgatgaggaaaacgaagtgcctaatccccgctggacgctaactgcagggcaagctccccagtgttgtagttgtgtttcggaggccgagaaccgctatcgggcttcctcggactctggccctggaggggggaaacggcgagggagaaggcgaaacgagtctccagtgtgttcttggggcctggtgcgaggcccagagaattctctgcaggcctttgcccgggcactgattaaggctgcgaagagacgcaccgggctgcgggcttagtagcttcaggcttctgaagtcagagggagggctgagagcttacacttctggagctccccgggagacggcaactacccaaccgtgtgggtgtgtttgtgaacatggaggagacatatttccacctatttctctccataagtataaaagaccataaaagaccatctagggacttcagaacccaaataatgacacaatgttaatttgcaggttctccctctgcctgccaccccacccagcaaggaggagaggaagtgttgagaagggaa

SEQ ID NO: 739 - DNA, 158 bp, Homo sapiens
ttaagtttgcattttgatgttttctgtaaggatgtagtatgtttaaactttattaactaatgttcaaaactgcgatgtgtgcatagaatattacgtatgcatgttcatgtctaaagaatggctgttgatgataaaataaaaatcagctttcatttttc

SEQ ID NO: 740 - DNA, 919 bp, Homo sapiens
accggactagagtggatccccataaaatgagtgaagccataatatgagttagagactactgaaaaagcccctcctgatgatgaaggacctgtcattggagaatcgaccaaaactgacagtgataacttggaaggcacctgacattacctggggacagctaaagaaactggaccaacagggaactatctggcttgcatctatgggagcccctgaaactgcagagaaccagtttcttatgtatctgatggtaattgggggagcttctgagaaggcatctgcaaatggctctgtgctgccactcaaccaactatgaccagggaagaatgatagaagcttactttgcattggataatccgcatgttctaagaattaaagaagggggaaatgtgaggggtgtatgacaatacattcaagcttatgtacaaggcatttgaggttgaggcatggaaaaatactgaggcactgtgtgtatgttgtttgtgcatgaaactgtaattccttgaccctgaaaataggacaaggaatagaatttgtaataaggagtgctgaacacagcctcctaagaatgtggtttgagtgcttttagatgttataaacaaggccatatgtgcctcatgacccgaccccaaatagccaccttgtagatgtttcttgtttgtctaaattgtagttcaactagccttctcaataaatacttggcagatgaatcttaaagcagcactgtcttggaggagctgctcccctccctttcagctgtaattgtctgaatacttatttcttggtgttcactgcagagcaagctgcagcacagctgccggcatttattcatgcaagattccagcttgcttatctatgtctgcagctcaattttacaggctgctctttgttaaaacaaaaaaaacaaaacaaaacaaacaaa

SEQ ID NO: 741 - DNA, 447 bp, Homo sapiens
cgctggtggaagacggaggaatgcttgagggaacgtttattgcatgctgaatccagagctggaaaccaggtttgagccaatctaggcacgggctccctgagcagggcaccctctgtctctccacctgatgggttgattagactcacagagaaaggaccgtcttacacctggaaaatcaaaagccaggggcagcctgaagacacgctggtcatgccagtactctaggggctaggattgctgtctcatgacggtgcttggcccgagaaagcacatggagagtttttcgtcaagaagtgttacctcttttatggagatgctcacagactgggcatttcactgtcccctgtccctgagacacagattctttttctgaaatctggtcaaaataaactggcgatgttgctgcagccaagctggcttactctgggcagtgccttttttctcacg

SEQ ID NO: 742 - DNA, 297 bp, Homo sapiens
ccaggactgacgccacagcctgcagctcctccccaagcccagccccagcccttgcccttcaatcctgagaccctgagatgcatgggtggggctttcatccgctggggaggctgagacccggggggccacagctggttcctggactccaaagcccaggacccttccaaatcctgcctggacggcaccgtggccaggaccccagccagcacttcccttttctgcgagggttttctgtttctttgattataaaataacccctgttggtggggggaaaaaattagcaaaataaagaaaagc

SEQ ID NO: 743 - DNA, 791 bp, Homo sapiens
agaaagtgctaggcacgtaggcgttcaggagacagtcacggtactcgtttccagacagaagtcatgaggaacaagagggaaggtgctttcccgtgtgcagcgcttggggagactcacacagacagaggatctggcatgacagggaaaggaggaaatggcttctgttaatctctccttcagcttctcccgcccttcccatgcactcttcctgtttccctttccagttctcacggtgactcaaggaacaacgtgtgaaatgaaagacctcaggtgctgtattggctcttgacagctcttcagaagaaaatacctcctgcctgttctgttcagtcctggtgcaggtggtcctggacaacactttgaaaaatgctggggcagaaacaagccagcaagcatatgggattcatctgctgtgagtgataatttatctagtttctaaaaatagtgttataggctggactgtgtccccttcctgtgccccgccgccatgcatatatggacgcctagtacctcagaatgtgactgtatttggaaacagggcctttgaagaagtaattaagttaaaatgaggtcattagggtgggcagtaatacagtataactggtgtccttataagaagagattaggacacagatgcacacagagggaagaccatatgaacacagagggagaagacagccacctgcaagccacagagagagcccttcaaagaaaccaaccctgcagacaatttgatctcaggtttctggcctccagaattgtgagaaaataaatttctgttgtttaagtca

SEQ ID NO: 744 - DNA, 2360 bp, Homo sapiens
attttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagtcacgctctgtcgccaggctgaagtcagtggcaccatctcggctcactacaacctctgcctcccaggttcaagcaattcttctgcctcagcctcccgagtagctgggactacaggcgcgtgccaccacaccagctaattttttgtatttttaatagagccaaggggcttcaccatgttagccatggtggtctcgatctcctgacctcatgatctgcctgcctcggcctcgtaaagtggtgggattacgggcatgagccacgtgcccagccttcatgtgtattttagacaatgaaaatgatgttagacaaaaaagcaaattcgagcagttttcgtttttgagttaaaaatgggttgtaaaacaacagagacaccatatcagcaatgcatatggttcaggaactgttaacttacagtgcagtggtgattcaagaagtttttttgttgttgttgtttgagatggaatcttgctctttcaggctagagtgcagtggcatgatcttggctcactgcaacctctgcctcctgggttcaagccattctgcctcagcctccccagtagctgggattacaggcacgcaccaccatgctcagctaatttttgtatttttagtagagatggagtttcaccatcttggcccaggctggtctcgaactcctgacctcgtgatccgcccgccttggcctcccaaagtgctgggattacaggcttgagccgctgtgcctggcagtttcaagaaattttgcaaagggaaggaaagtcttgaaaatcaggagcgtagtggctggtcgccagaagttgataactaccggttaagagcaatcagcaaagctgatcctcttaaggctacttgagatgttgccgaagaactcaatgtggaccattctacagtccttcagcatttgaagcaaattaaaaagtgaaaaagctcgataagtgggtgcctcatgaactgaccgaaaaaaaaagtcattgttttgaagtgtccttatccgttattttttgcaacaacaaaccatttcttggtcagattgtgatgtgcgagaaaaagtggattttatacaacaactggtgatggccagctcagtagatggactgagaagattctccaaagcacttaccaaagccaaacttgcaccaaaaaaaggtcatggtcactgttttgtggtctgctgctggtctgatccactatagcattctgaatcctggcgaaaccattacatctgagaagtatggtcagcaaatcgatgagatgcaccaaaaactgcaacgcttgcagtcagcattggtcaacagaaagaggcccaattcttcacaatgcccttccacatgttgcacaaccaatgcttcaaaagttgaacaaattgggctgtgacattttgcctcatccgccatattcacctgacctctctccattgactacgacttcttcaagcattgcgacacctttttgcagggaaaacacttccacaactagcaggatgcagaaaatgctttccaagagttcgtcgaatcctaaagcatggatttctacactacaggaataaacaacttaaaaatgtgttgattgtaatggtttctattttgattaataaagatgtgtttgagcctagttataatgatataaaattcatggtctgaaaccgcagttatttttgcatgaacgtaaatgatgaattttagatgctgaaatttctgggcatctaaatcttctttcacatccctgattatttttggaataaactcccagaagtggaaatataaggctgaaggcctggtgtggtggctgaagcctgtaatcccagcactttgggagaccgaggtgagcagatggcttgagcccaggagtttgggacaacatggtgaaacctcatctctacaaacagtgcaagaaatcagccagcgtggtggcgtgcacctgtgttccccgctaatcaagaggctgaggtgggatgatcacctgagtccaggagatcaaggctccagtgaaccatgattgtgccactgaactccagcctgggtgacagacttcatctcaaatatatagaataagactgattttatgggaaaattaagcagatgctccagtttgagaaacctggatctgcgatctgtttgtggtaccagcatcaagatgatttatggtaataaggtactcagtctttgcttaaaataaattttacgtttatcaaagt

SEQ ID NO: 745 - DNA, 786 bp, Homo sapiens
gtggctttgtgaggatggctttgtgtggctgcacattgcccttggccaagccccgctgccaggagaggcagctcggctgccaaacctcctgaacccaagttacctgagcaagcagccctatcccctcgcctgcttctcactgcctcgcctgccttgggcctgcccgacccagggggtcacatgccttgttccccatcagtggagaccagggacaagaagacagttctgtgggaagagccaggaggaccatttgggaaaatacaggttccaggtgtgtctccagaccttgagagttggtgtctcctgggaagaggccctgatgagatctggggagattcggatctgatgagattcaggaagccctggcctctccgtacttgaggagacgggacacacaggacaagctgcaggctggtgagcaggttcaccttctattttgaagacccgcttcttcctcaggtacctgatcttgaaaacgacctcccctttcagttctggaggccagaagcccaaaatcagtctcgctgggctaacgtgaaggtgtcagtcgggctggttccttctggaggctccagaaaagaatctgttttcttgccttttctggctcagtttctcggcttgtggctccttcctccatcttcaaagagcaccactccaatctgctcctccatcaggtcaccttctgcctgactcctacatccctttcagaaggacccttgtgattccatgaggtccacccagatcacgcaggataatgtccccgtctcaagaggcttaatctaatca

SEQ ID NO: 746 - DNA, 468 bp, Homo sapiens
cgacatttcttataggaaatggaactcttcataagtctggccatggaggcatggtatccgtaacatcccccaaaggagctaaagaagaaatccacaatttaccatgagcatttctcgtctgaagattgccaagcgattcctccaggacattcctcaagatcaatttctgttcatccaccttgtcctgggagggacatcaatgggtttccatgtcctttggcttctggttgagttcactcagtggagaaccctggcaagaggcaggaaaaggggaggaaggtgaaaaccatccatttcttggagaagtgccacggtggggttgcaagtcccaggatcaagttttcgatgtgtctctttttcccgtaaagtggctgaaatctgaagctgaatctgcaagtgtcatggagtcattgaatctcacagtctcaactgataaaagttattaaaggtcgtctggttcagccttct

SEQ ID NO: 747 - DNA, 1791 bp, Homo sapiens
ctgcaatttcaggtagcttttctgactcttaaagagatctcaagtataccttcagagaaatgccagcaaaaactgtagtcatttgggaaggaataagcctggaagaaaaagatacaacgaactagcacaacgaggagtttgaaaagttcatgacagctcacagctgatgatggtggcaatcttaaggatacagaaagctcattcctcatgcagggaagaagaaaatattctaaagaagagataagcatattccatgaaatcaaaaaagcgtaaaacgctggaggagaagtcagtagcaagcagctaagacaacatggtacatgtggctagaagcccaccaactgctaacaaccagctggagggtaagtcaaaagctatgagagcccagaaggagaacaattatttagacctggaggggccagttgggaaagtctttgaagggtcttcagaaaatggaccaaaagaaaagaggaaaagtcattctactgagaggtgtttgtgtaatcaaagcaaccgaggcctaagaactcacaaaagattagaaaagggtaaaggatgcctggaaagccggactaggaaaaggctgtgaagggccctgaaggtcacatgtcacatgttgcctgcagcatgcagaatcaaaacatgataaatcatgtcttgaatcatgacatatgaagcatgacacacgaatcatgacatgtgacatgttgaatgtcacatgtcacatgccgtaggcagccatcaagagtatttgaaaggaaagtgtataatcaggcctgtgctttagtaagacaatttgtatagtgttcagtgtggattaaaatggagaacacaggtatcagtttgacatcgacagtacaggaaaccatttgggtttcttgtacaccaaaatattaaaacatacacgcaaacacaccaacacattaaaatcttgagagagagggccaaaagttctttgtcgctggactaaaagtggaaataaatgtttacaacctctaaggtggattaagctaagaatttggagttgttggcaaaactgccacataaaatttcagacatgcaaagaaatgcaatcgtagacttatgcacatacttccaccagagaagggaatctgggcagagtgttcaaagcttaagaaattcctttgctcttcaccaagaagagccaacagagttttcgttgaatcaactcttatattcccttaaaaagaagttgatagtgttgtggaaaactcacccattgaagtgacaacaaaaacagcaacccagtatgagttaactggtattatgttaaagggacaagtaactgcacttttgacacacatcctctaaaaggtagggtgggagtgtttcaaagaaccaagtctgagtaatagaaaagcatataccacttccccatatacacgttcgagcatgggggagcaggaagctgggtaattgaatgcagttgtgcacactggcaattttcccgccacataccatttcttcggtgtctctcccaaaattctcctcctaagtggcacatccctttattgatcatctttccccatactgatcatcctcagcaatcatgtgagttattagtctaagtatttgtttttctcaaatatggtcttttaactactccctaaatattttatatatacatagtttgttttcccaatttaactacaagcatttaaaaaatgggaatatttgtctatatttctgtaatttttcatcatgccttatatggtatataaagatcaacagcaataaaacaacaacagtaataatagctaagaccttttg

SEQ ID NO: 748 - DNA, 3267 bp, Homo sapiens
cacaggcaggccgtacctcgaaatcccagcggggacacctgtcagggagacgcaccctcacaccgcccatgcatgcccgacgcatctttgggatccttagggatcacgtggtgcttccttgaatctccgcttgaggtttcttcaggcaggttcggccttgcccgactcctaggatcgcaggaccatggcgacgatcccgcggagaggggacgcactgccacagacgcctgggggccaagccgctggggccagtcccccggcaacggtggcggttactgtgacgcgagtcccccctcagcgctagcgcctggtgatcgcgcctgggctcttcctgcgtctccaagctcaggggctcctgcttctcagcactgctgtctggaaaaggcgggaacgaggactaaggcaagcccagtgtggggcagagatggcaacacctggaactagcttttcatgggggcagataatgtggagagtgtcccaattacatctccctttattctatcccatactactaaaccccaccagctatttgcctacaaactgtgtatcagtcaggacatcaggacaccaagataaaggactagagtttggtaatcaactactggctcctccagcagctcagaatgtggcctgtatgcatcacttcacttaattcattcaagaaatgctgactgagttcctgctgtgtgttggacactttcttagaagtgggacacactgcagtgtgtgggacaaaggctgggccgctcattgcttatgttctagttgaagagagagtcaatcaacaacattctactttcagacattgataaatgctgtcatgaaaagacaaggaacatgaaaaggtaagaaaagggatggagagagatgggatgaggggtgcctgggcagacaatgcaatgatctggcaaaagagtaggacaatcatgagactgcatgtgttccagtttctgctgctgtaaaacagcatccacaggttacatctttactattctgttacatacatactattatttaaataaaaaatagtactagttaactgtgaaaattgcaattaatagggcagattaaacaaatcctttaaatttaaacaaatgttttatggttttttatcctctgatacattgtttcaactttaaaaaaccctctttatttgatatttaaactctatattaatgtatattcttaagatacataaatttaagatttttttcgagacagggtctcattctgtcacacagtctggagtgctgtggtgcaattatggttcactgcagactccacctctccaggctcagataatcctcctgcctcagactcctgagtatctgggaccacaggtgtgcatcaccacacccagctaatttcttgtatttttttgttgggatggggttttgcgatgttgcccaggctggtctcaaactcctgggctcaagtgatctgcctgccttggtgtctcaaagtgttgggatcacaggcgtgagccaccacatccagcctaatttaagatttttaaaaagcagaatgtaaatatggtcatgcattgtgtaattctgtggatactttctgagtaatgcatggttaggtgacttcatcattatgtgaacattatagagtgtacatacacaaacctagatgatgtagcctgatggtacagcctatcacttcgaggctacaaatccaaattgcctggatactgtaaacaattatactcaatggtatttgtgtatctaaacatgtctaaacatagaaagggtacagtaaaaatatggtataaaagataagaaatcgtataccggtatacagcacttaccgtggatggagcttgcaagactggaagttactccgggtgagtcagtgactgagcggtgagtgaatgtgaaggctagggcagtactgtatactactgtagactttatatgtactgtatgcttaggctacactaaatttatttgaatttttttgtcggtaataaattaaccttagcttactataatttctttataaaccttttaatttttaaaaatgttttgactctcttgtaataaattagcttcaaacacattgtatagctgtacacaaatattttctttatatccttattctataatcttctacttaaaaatttttttaatttttttattttaatttaattttattttattttgagacagagtctcactctctcgcccaggctggagtgcagtggcgtgatcttaactcactgcaacctccgcttcccaggtaatattatttaaataaaaatagtactagttaactgtgaaaattgcaattaatagggcagatcaagcaattctcttgcctcagcctccagacttttttgttaaaaactaagacacaaacacattagcctaggtacacacagtgccaggatcatcaaaatgtcattaggcagtataaacttttcagctccataaaagttggaaaaaaaataataataataaatacaattttataaaaagaaaattttcagctctgctataatcttatgggaccactactgtatatgtggtccctcattgaccaaaacatcattatgtggcacatgattataacaaatgatggatggcgaggttgtgaagaaactggaacccttgtgcattactggttgtaatataaaaaggtacagccactgtaaaaaaaaaacacagtttggttatttcttcataagttaatcatagaattaccatataatccagcaatttcacttctaggtatatgcccaaaataattgaataaggtgtttaaacataaacttgtacaagaatgttcatagcagtacatttcacaatactcagataatcctctcattggaagcaactcaaatgtccaccaactgatggtattacccatgcaatggaatattattcagtcataaaaaggaatgaagtactgaggcatgttacaacatgaaggaactttgaggacagtttgttaatacgctatatactgtgtaattctatttatatgaaatatccagaataggtaaatcattagagactagagacagcagattagtggatgccaggagtttggggaaggaaggggtgggaagaatgggaagtgactgcttaatggatacagggtttctttttggggtgatgaaaaatttctggaactagattgtagtgatggttgcacaacaccgtaagtgtaataatgtcactgaattatacactttaaagtgatttaaatggtaaattgtattatttatgtattttaccacaataaagaagtcacctatca

SEQ ID NO: 749 - DNA, 535 bp, Homo sapiens
cgccctcgaagtagaagagcacattctggtagagggcgaaccacttctcgtgccagcggctcgcctcggccgtcttcttactcaggaagccgcgcttggtgccctccttgcgcgccagaaaggccaggctcagctttctcatcactgaactggagatacaggagttggagacttggaatcccctttggtgcagaaactattccttcatgagaagaagtccttaaataggctctttagacaggaggccacatgttgaaggcagcagggtcacaagatggaagaaccagggtcccagtatcatcgctccctgcttcaagctgccaggggcagcctaacccacatggcattatgacataagaaacaaagtaactattgttttattaaatcaatgagatattgggcttcttgttatagcaactagtataaattgccctgactgatacattatggatttagagtgcactgtactacaactgtttgttgtattttcaaaattgtggtataactgacttacaataaacttcatatatttaaa

SEQ ID NO: 750 - DNA, 1853 bp, Homo sapiens
tgcgcaccgcagcgcagcgcagcggccggggggtgcgggcgccctcgccgcccggctacctaccgccgcctgggcgccgccgctgcctcccttccccgcttctaccctccagcagacgcccgccggagcgacccctcccagggtgaccgggggaaggtgttccacgtggccatagcgtttgcgtcacaatgacctggcggacaggtgggagccacagcgtacaccccagggttccctctgtgctgtgcgtagtgcctactgcttgcttccaggttaaatttctgtagctttagaggacaggagacttcatgacttcactgccaagaaaagttacagaggcctgctgtacctggaaatcaagtttgagcttcgagaataaaggtcatgttttaaaaacagctgtaacaccagtaaggtgctagtgagaacccgaaacagtttctaaggagaatggctattgaatgatgggatcagaaattaggagagaaataaggaccctgggccagggaaagaaatgaatgaagatgccaccttatgcccagaacacatctctcattcaatgataaaggatttgtggttgggtcaacttttgtgatgctcaactctttccttcgtaaggacgggctctttctcaggaggcttttgtactcccaattaacgcactgctaatctgatgaagctctattttgtagctatgccatctggatcacatagcctccaaggccagcagagcagaggaagacaaagagcagagcaagatagaggtggaagttacacgtcctttgtgcttactttctactggcctcatcgggtcgcaagatcccactctgataggtgcatgggggcttggaaaattagaaaaacatgtgaatatttgcaatgctttcagtaacctggagaggtacacatggctggtataacaattatcttcatttaatgatgtggaaacacctaccacaagtcctggcacattgagggtcttgaataaattctgtcagatgaacggacaagcgcacaaaaggttgaaagagtgaatgaggcaggcacaattgtgatattcaacgagagtagtgcgaagtgccactttacagccaaacattcaattcctcctaattcacaagggagagagggatcaagttgtgcagctgggaggtgatgtttcttcccagcagctgtcattgaggagacacgtgcaaaccatagaagtcatttgtcacaagaaccccatccagaatttgctatgtgcgtctcacttgctaacgtgacatgaaatactgaagctttcaaaaatcaagtacagagactttgttgtgttgacatgggcaaaatgaaatgaagagctgaggcaattatgtggataaatcaggccaaaaatatccaaccattgagaggaaaaagttcctttggctcaaattattcagagtgactgtccatgttcatcaatttatcaggataatgaattttatcctatactttactttgtcactatagatatatctttagtctatgaatttgaatgactttgtgatattttacttcactgaaaattataataggggttgaatgagcaagcaccgtgttaaaagattgctactgcagctatgataatagtccaggagattttaaaccccgttattcaatagctagcagacatagttattggaatgggggtagagagggagacacgaaatctgttgagaatcaaatgcttgtaactaatctgtctttcccatttagcatcctattatccaaaaatatcttggtctgtagctcccacctggtttcctggtcatttgactactggttaaatgagcctgaaaatttcatcaggtttcatataaagaataatatat

SEQ ID NO: 751 - DNA, 1649 bp, Homo sapiens
gaggagaagatatgaggtaattaagggtacaagaagttgagattcaaacatcctccaccttcccaccccccactgccagtgggtgataaggaaatgatcacagacgactgaagtgagctaacatgattgtggatatacccatattaattcataccggaaacacagatgagaaggttgagaaggaatagtaaagaccatgagttcggtttagattcacagagtgtggaagtccaagaggaaggtaaaaaggactgaaggcccagagtcaactgtacagtagtacaagctacggaggtggatataatcactcaagaaagatatggcaaaatggtaagtggtggggtgatggtaaaaagagacaagggtctagtgtggtggttgaaagaagcagctgaagtcagattagtcacttaaattacttgattttctgagccttcgtttcaactgcaagataaagcttacaatggcatcaacttgagatggctggtgcattaaagatataattcatataaagccattagaccaaaccctgcatgagagctcaatgaatgtcagcaattcttaccatagtgtaccattataatgttggcataaaattagattttcagaaaaaataagcttattaacatgtattagttatagaggcttattactaaaaatgcatgatgaaaaacctatgggcaagcaaaaatattttagaattctccacctcttctctcaatacccatactcttaagagttatattaaaggcagacttgtttaaatgtcaggacatttaccttagcttctttcctttagttagcctagtggctcttaaattttagtttgcttaagaataacaatagcaacacagtgtttagtacgaagtcatgcatgtatttcaactaagtagatattttaaggaattttctgcagtaattttgaaaaaacttttatcaccataactggtgattttggaattgaattacccatgtgcccatccacctcccactgcatctcccagttgcagcgggaggtgaacgggcacatgggtaaaattatatattgggtacacatatatatatgatgaaatttaacagactaaaacaaggtttaagaagagttatcttgtccaacatcatatagtcgataagaaacaggatttgaactcgggtctgccttactcaaaggcaaggtctcttttcagttttctctatgctacatctgtaggatagggagatcccaagcaggtttagtacggtgcttcactgaaggaatatcaacatttaagaagatggtggagagataatcgtagactatggtgtgcagaagccaacaaaggctgaagtaacatacaatcttcaatttctactgaaatgggaaattttgaagacactaataacccttacaaaggagggtgaaaataaaatatgaggcaaacagtaaatctcaggaatgaggtagacgaaaaaataagcgcagcatattgactaaagcacatttcttcctctatagtttgggaactgtgtcacagtcggaccaatatatggctctaaccaacatgtagcttttcttttcttttctttttttttttttttggtcttcttaatttgaggatttagcattccagttgtcatgtttgatgccattctgaaataaatctcttagg

SEQ ID NO: 752 - DNA, 3684 bp, Homo sapiens
attcaacaatatacctgagagcttactgccacaagacactcatgagagctagcatttatggtggatactctatatgccaggcacagggcgccacgtattttccctcgacagtaacttggcaagcttttcatgtcactctggcatcgctcagattatcagctacccttcagaaaaagagccctgcgtttcgatggctaaggaactctgacaggaagaggagaggtcccgactagaggagggggcagcattcatcttttggcaccggtgagtcagtttgcgaagttggcggcagcgagaccccgaggcatctgggagaccccggagttctgactgccctactccgctttcgtttccttccccccacccctggcttcccgggtattggaagccagctgggtccccggggtcgcaggccgcccagaggttcgagccgcgcgccggggtggggcagcgcggggcaccgcctccctccataccttctctccccgtggagcacataggagctgcggaagaagcccaggagctcattctcgatgagcgcgttgtagataatcttcagattgtaattcctctgcgcgtccagtgtcctattcagcaccaccactaagacctgggtttgcgggtagaggaaaaaaccggctacagggacagccccgaacgcccggtcctcggccagctgcactttctccaccgccactcgggaagcgtgcagcactacgtagcgggtggcgttccggcacgcgatctccacgttgacctccccggagaaggtgaagttctccatgaaggcggtgagcatcagattgtagtgcagcggcttcaggtggcccgacaggcgcagctgcgtccacggctcccacggctcccgctcctcctccgacggcggctgggccgacgtggtccccggactggccaccccacccgcctcgggctgccaggagtccccgcctgcgtggtggttgcgccgggccgatccagggaggctcccgttgccgccgcgctccggaaagcctgaggggccaccgtcggcgcctggcgtggcactcgccccgcactcgtcgaagcgcaggctgagcagcacagcgagcattgtgaccgcgagcaatgccacgagggacacagcgaaggccagcacaagccgcttgtgtacggcgatgtggcgctccgtggtgcggggtcgcactcccactgagtctgcccacgggtcggagagccccctgctgccagcccgaagcgcggcgtcgtcttcccccatcgcggctgcgaaggcggcggcgttcggtcctctgggtggaatgtgctcgcagcagcagtgacggcggccacagcacgggaggcacccgagccatacaccctgcagctggagagaaaaggatggccgaggtgggagagactagagtgaaccagcaggaggaagtcccagggccgcgaagctacgacggagatccgtcctggaaaagccttctccaccctgggcactttaagcggcggtggcggcaaacggcaggaggttgcagacccgacagcgagactccctcattccagtcttgctctgccctccggagatgacaagtgagaaagaagtgtccggccgggccatccccttcagagaagcaaccacttcacaagaagattctgaagttggccatttttgatcccagaacagtttctcatagattagaaatattggagtctacacaaaaatcgatattcatttacaagatcatcactaaacttatcttgcataacgtaagtggcaagctctgacttgtgattttttcataagaaaaatgttttttaacttagtatcatttctacaacaatgtcccatgataattgattctaggtgatttgaaacactgcttagtcctgttttagaaaaagctcccatatctgatttagtctcatatgcagcttacttctaacatcagattgaatttgcattgagttaccttactcggtttattttttaattatgttgcagttacaagggaataaggaaaagtcagtatagtgcattgaaatgtcttttttaattgagacacacaagaaatgtgttataggttcccaaacattcttcatgtattagagatgttataataatcttttgaatagccaagtgaaaaggaatggtttcacctgaacatgttagaatttattgctacattttttgtgtgttgtggtggagaaataaatttttaaatcgcatttatggagtcatttcagaacaagtagaaaacatgtaatctggtcactttgaatgtgtaagtgtttgtatctgaactcctcctgccctattaagagtggaaggttgtactatatgttactcaaaaagtaattttccccggatatgcaataagacctcagatttgacctataagctgaatgtcataagctatccattagctatgctggaagcacaccaccaacaacaaaaaagttttaagtatttttataggcttgctaaaatctgattatagaaccaaggcagtcaaataccatgagtaagactgcagaaaccctagaatttaactccctagttattcttaatgagtgaatcctgtgctttgtgtctaaaagcaatgtattgtgctttccaattcaggaaatgcattttaattgctatactcattgatacatcaatctgtccatgacattctgacatatatccagtttcctatggattcggtataggagcaaattaaaagatgcactagaatggtaacatttaatctataatcctccatttaacctttatgtggctgtcacagaacaagtcctgtttttagagttgaaccaaaaaacaaacaaaacaaaacaaaacaaaacaaaacatgcacacacactagagaaacggcttttttttttttaacctggggaccatgaaaaagttttgaccattccccgacccccatgcttcaactttagctttgatagttaaagtatgtcttccttcagtttaagttgaacaaacttctgcataagaccctccagaaaacctctgaacacatacagttttgggggcaatggggactgaactatgtacaaataggtgatacttcagcacacaattcctgggataaattttatcctcttctcatttttatttttatgaactatatggggttttttaaacaagttacaagaagcaaaacacattttacctttactctgttacatatttcaaattaagcagatcctaattaattgggttacattatgtaacaatagcctttttaatatcaaatggtttttatgatctgtcttcaatttttcttaaaatgagactgcactaaagattttcttgacatttctgagaatttcattttcagtttcaaaaaattatttattcctttaatctttcaatgtggaaaagtaatgaatattgattcatttttagaagcgctaacatccaactaggtaaacttcatgagtgatggctattaatgttctctttcatcttatagacagaaaatcaaagctatttaaagtaaaggatttgtttcaaatcaatgtatgtccacaaattaacattaatgtttacaatactttctgtgataattgtgtcttacttgggtgtatatatgtctttatatctatctgtaaagatatagttgcaagtagatgagagacgaatgttcatgtttctatatggtctgaataaaagtgttatcactatgctaa

SEQ ID NO: 753 - DNA, 786 bp, Homo sapiens
gatttgcagtcggaggcaggcaagaagtgaaatcagaagacgggaagtggctgaggggaacgtcttttctctctcctgctcagcccgaagtgaacaggtagcatcagagatgagatcctggattgaatgactactatggaaagtgattgaccaagattgtctccattcctccctggcttctccacagggccgctcaccatggcagccggctccatcaccaccagccagcgagagggcaagacaagagggctgacgagggacgctaccatcacagaggctggtctcgaactcctgacctgaggtaatccgcccaccacagcctcccaaagtgctgggattacaggcgtggctattagcctcgccaagttaagattcttgatgccaaccaatcacccactccatgtttttcaggattataaacactagtcataaagcatgaactgcctgggggtggtggctcacacctgtaatcccagcactttgggaggcagttggatcacctgaggtcaggagtttgagactagcctgaccaatatggtgaaaccccacctctagctgggtgtggtggtgtgcacctgtaatcccagctacttggagacaggagaatcgcttgaacctgggaggtggaagttgcagtgagtggagatcatgccattgtactccagcctgggcgacagagcaagacttcatctcaaaaataagcattgacaactgcgggtcaaaactgcccctggttgagactcactggctggagccaaaaggctgagctgcctgcccaacagcagc

SEQ ID NO: 754 - DNA, 371 bp, Homo sapiens
agcaccgggaagcaggggccgagccttccccgctctgtgcctgggggctctgggcactgtctacacctgggaggtggtcagcatatgtgcgtgggaacttgctggaaggaaggaatgacccttctagccatggaacggtggtcatccgtgagccacggcctcaggaggtgccttcctaatgtgcaggtgacgattgcctctgagctcaggcatgcagcttctgggatgcactctcctttcacggcaaagcattctgcataggaaaaaccgtctctgcgtctccaagctgtggcctagcccttcattcatcaaatgggatacaactttcatttcttattaaaatctggaagtcactctccatttgtaagata

SEQ ID NO: 755 - DNA, 1421 bp, Homo sapiens
cttctgtcccttccaagacccggcgacaggaggcatgaggggcccccggccgaaatgacagtgctggcgccagcctggagcccaacacacccgctcccctgcagacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctgccaggcatggtggcgcgcccctgtagtccaagttactcgagaggctgaggcaggaggatcccttgagcccaggaagtggaggctgcggtgagccatgatcgccccacagcactctggtgtggacaacacagcgagaccctgtctcacaaaataaagtaagcccggactgagtgcggaaaggcgggcctggcgggtctggtctccccatgcgggccaccagaggccctgcagccttcagtcgcttgaaggggtaatggcgcttccactcacaaacatggcggacagagcgtgtgaacgagatgaacagcccctcaaaaatatggccgccgaggctggacggccgtgccccagcagcaccgcctccgcgccccacgtgatctctcgccgggcacagcgctgaccgcggaggtccaaccggaagaatgtccggattggacattcggaagagggcccgccttccctggggaatctctgcgcacgcgcagaacgcttcgaccaatgaaaacacaggaagccgtccgcgcaaccgcgttgcgtcacttctgccgcccctgtttcaagggataagaaaccctgcgacaaaacctcctccttttccaagcggctgccgaagatggcgga

SEQ ID NO: 756 - DNA, 5007 bp, Homo sapiens
gagctagttaattttaaattccccgaggtccttttactgagatggaaaagcacaaacagtcaaggaaaaccaaagagggaggggtgagggaaggggaaagtgcataaagcacttaaagattttttaaaagtaggtatgatagataagccacaagaagtttttaagactactaataaccataattctattttaatcagctatttagctggtacctactgctatatcacctagtgtgacatttcggaattaatggaacaatgaaggaagctgtacactggaggttccaggtggtcatggaaggtttccagtttatgcaaacttctgtgaaaatgagctttgttattggtgaagacattggaaattttaccagccaaaacagagtttctctcttattcagggtaagatgtaattgcagtgtgctagcgctggaagggacctgttttatatgttatgtatgttacacgtcagccctccatgtcctccagttctgcatccttggattcaaccaactgtgggttgaaaatactggaggtaaaaagacaaaaaataacaatgaagaacaacaacaaaaatacacagtataataattacatttacatagcatttattttgtattagacattataagtaatctagagatgatttaaagtatatgggagaatgtatgtagattatatggaaatatgagggtattttatttaaagggacttgggcctgtggataccaaggaataactaaggtaaaactgagcataagtggcctgtccatattttgttaaatatcagattattgattagtgatcatcaacattttcccgcattcatgcagtgcggcctctgaaaacatggttgaacatcctatggaatttttttttttttttgagatggagtctcactctgtcacctaggctagagtgcaatggcgcgatcttggcttactgcaacctccgcctgccccacctcgggttcaagtgattctcctgcctcagcctcctgagtacctgggactacaggcatgcaccaccacgcccggctaatttttgtatttttagacgagacagggtttcaccctgttggccaggctggtctcaaactcctaacctcaggtgatccaactgcctcggcctcccaaagtgctgggattacaggtatgagccaccgtgcccagcagaattttttaactatttggttacgactaatttggataatgtagtgcatgcagctttgatttgtgccactaagagtgggcaaactgtcttcctttttgtgaatcagtaaaaattttccctcaacatgtgtttgacagttgtcattcactgctaagttaaggcatttggtaaaccacacagcctctgcatccttcctagcgacagccacaagaaaaggtgggcatgggagggaaaatgctcttgtgaattgaactggaggcaagctccacttttctttagaaaaagatgtagatcaaaataactaatattttcttccttgctcgatttctgtgccttccatggtacatcaaaataataggaccagtaatggccacaatcctgttgactgctgttaccttcgccccaatatttctttaagcatttcttaagcatctagcttgtgttttgttatatttaacagattttcttaaagtattgtatgaattaaaaccagaaataacttcattttcctagaaagggataatttctcccggagaataaatcctgaggatttagttagatgctgtgggtattgtattttaaataatattttaatgggagcagctgattgactttcaaatggattgtttacattaatagtaattctgcagttgttttactattgcatcagtctgccagacaagttccatgtgcatattttaattcagaactaattatacttaaaaatttaaaccctgcatacttccccaaaaatgtttagggcagttaaaaacaactcttttggaagatgactcgcattttaagaaatgagagaacactgtcaaatgatgaatgcatttaaaaaataatttgcaaagtgataaaagcccttagttttaaatcttacaatgacattagctcttacaagaactcagtaagtatttgctgttttttaatgggatagtaataaggttgaggtttttgttaagggacgtttacttatcatcaaactctatacttactactacaaggaaactccaagtacattaaacactatgttttataattctttgccacactgccaataaattctgttcacattttaaggatgacaagtccactatatgtaacacgtaagaatgctatcctggcagtagacacagggccagaataaactggcaagttttcattccacacaagtgtgggaaaaaaatgactacaacttaaactttatttacttgattgagagcttattgcacatgaaatgttttatgtggttgatcttaacttcgtttacattgacttctatgctcaagattgttcaattgctgctgctgccgttgtgttttctttcaggatcgaggtgggtaccttcatataatatcttctttttaatttcttctctggcaattctttcctggattctttgctttgcataattatacctacaatgaaaccttagaagaaaagaatatgaataaattgttaatataaagtcctacagaaattaatttatgaaatttctctaaatcacacaaaacttaaatacagatgactactaccctgagactgaaaaatatgttctaatttatagtgctatttttgggcagttttggtgtcagaatacctatcaacacattctttttttattaggaaaaaaaggatgtctacataacaatttgtaaagtgataaaatccattagtttttaagtcttctgatagcattggctattataagaaacaagtatttgctctcgtttttaacgggataataatgctatgtctacataaaatgatttctaccaccttaaatagctcactgtagaaattcatgtataaatggaaccatatagtacatacatatcatactcttaggtctggcaaatatttgaggttcatccatattttatattcactcatcagtagttgtaaacacattcttaaagtagcattttcagatatgaataagcagggatgaaataagtattagggtaagggaaatggttgaggctttcctaagtgaagtgtaaaaaccacagctttctttttaatgggatgtctaatatgcatttatctgttcaagcattttaagatttccatgaaaatgtcctgaaaaatcaagattcttcattgagggtgaggatctcccaatgggagactgctctgaaaagagcatgtgctttttgaattagataacctactataatcatggatgttcttgaatacttagcaaacataccagcatcccaaagtcaccaagataaaccctcctactccaacatcacatgatcttctaattctacctgtaaaaataagcataacaattaattagaatataattacgttatatacattactccacctagaaaaaaaaatagttcattatgtagagaaatgctttttttagtacatagagaaataaaaaatacagatactcactagtgaacaaaaaatgtccaaagccagccacaacagatcctaatgaaccatacaatattgaatgccgggcgcagggagtattttcaacatctaaaaatcctaggagcttaagggactagaatgaaaaaaaagaacctagattgagtaagaaagtatttcattttggggtgctttggcaaaaatgacaatacaccatttcttttcttgtagttgagggtttaaactagagtatgtgccacgtgacaacctaaatcagcttgcgttgtctttgtccacctttggtatgcagtctgaatctttaaatccgaaaaccttacaaattggaccggaaaacccttaagcagtagggtaacttggagctgtatcttaatttgctaatcaactgacttggaaataggataattcattttatgagctctttaaatgagtttatttgggaatatgcctatcattggaattgaaagcagcatagcttgcttcagtaactccaataatttgggaagcagaaatggaaaaagtaatttgagtcatgtttgcttatgtagtgccgtttaaaattcccctagtaattacctttcatattttattaactaggttaacatcaactgtggttgtaagagtaaatgtttcaccttaagataaacatgggcaatatattaaactctagtctgttttcttgcctgtgaagtgaggctgcacttgattatatttgattctttgttcgtaatacatgggaacgacagctaagtgtggtgaaaaacgcggggatccaaagagctggatttttatctcagatctgccgctaacttttgtatcctataggctacttttatttctatggtctcaatctataacatgaatgggttgggttaaatgactgaagttccttcaagtgctaaaattctttttctacagtcttcattggatttatgtatttcttattcctaatatgtttaactgggatgtctgtcactctagggcggcaagacagacatttaaaagtaacagtcacactgctgaactggcatttctgttaacacaaaagtttagaaaactcacggtaactgttacttgatttaagtgtatataaaattttcagtaaggctgcttttaaaaggaaccactgtccatttaaaggtttcatagttatcttcaatgggttagtattgtttggggcaggacattaaactagaagggattctataggatgaggtgatacctagaaggtaatatattgtaaggcaaaagagattagaagaaatggggaaaggatagtaaaaggcaagtcagattaaaggttgaaacatgaagatattctcaattgtatttctgcctatgtttgcttttttggctcaagcatctgttggaagagacaaaatgtgacttggttcataataaagcaagaattatttactctcgga

SEQ ID NO: 757 - DNA, 959 bp, Homo sapiens
gtctcgggtggggtgcggcttcctgcgtctgagagacgcttcctctcctgctgtcctctccctgccaggccccttctgcagcggctggcttccagacaccctgcgtccctcccttgctcgcagcagttgctgtggcggtcctcccgtgcacccccccttctgccctcactgcccctgggggtcctcatcacggaccccctaactcggcatcctggacaccaccaccccgcacctttccacagtgcagctctgctcgtgcctgtgaagcctcccacagcctgggaaggaaaatccagacttgccagaccttgcctcagccaggccttggaagcctgccagcttacctaaccaggctagtctgcccccctcactctgggtgctctccatgggccactcaccatttcctgagcaggaccagagctctcctgccccaaggctgggcttcagctgctctttcagctttgaacgtcctttcccattctccatcatccacattcacctatcctgcctgccccagttaaaatcctgtttcttctaggaagtccctcatcccacccgcttaccccagggagactgagcttgttccttctcctagtaagaccctcagcccatggagtcctgtgtgatgttgtgagcgtgggaggacagactgaactgctcggcccgtggagtcctgtgtgatgttgtgagcggggaggacagactgaactgcgtggtgcttcgcacatagacctcaacagggattggcattttgaagctgttggcgggggctgtggactgcttttcttcctttctagctcaacggcagctaaagccactgcatacaatgcaaggactggctcctgtttggccacgactgattgcagcccctggtgaaatgagaaccctgtgggtcggaacaaagtttggattatttatgttgcaagtaactaaaatctcaagtgaaactggtttaaaca

SEQ ID NO: 758 - DNA, 936 bp, Homo sapiens
ggccacatctgccagagcctggagtctgcgaaggccgggacccggttccccggcccacagtgggggtgtgcaaacccgagagaactggtcgctgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaaagttctttaagctggaaattgtaaattcctcctgaaatgttttttcatgcagttaccatgaactaatactacaataaaggatggtcttgggtgtcaattctt

SEQ ID NO: 759 - DNA, 344 bp, Homo sapiens
aggcagagagggagaaataacaagaatggaagagtcgttcttccaaaaagggccatctgtgaccctgagagataaacctggcagaccagggctcacatcttagtaaatcacctgtaaataaagcttgcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctctt

SEQ ID NO: 760 - DNA, 545 bp, Homo sapiens
cacagtccacatacagggttcttaacctgcgtttttacctacattttagactgaccctgcttgtgcctgtgaaccaaccaacaatctctggctgcagctcagaaaggacaaaagagaatggatgagggaaacttcccagggcttgtctgggtatgcccacagtggactggagcccaaaatgcacactggaggaagtggatggagccacgtggatgtcatgccttatgcaggggaggagcctgctctcttcagctcctgtggtaatgtgggaatcgatctgtgaggaaacactttctgaaaatgtcagaactcttgaaaacatggatgaggaaaagcataagtactgctttatgcttttcttatgaattttaaaagatgtaatttaaaggtactttaaagtgatatttgtgcccttgtaactgattcaaagtagactgctaaggacaataagtaataagagtctacaaatatcagtaaattatgagaaaaaacggtctaatggtacttaaaattgcattgtgatttattaaataacattgaacagc

SEQ ID NO: 761 - DNA, 452 bp, Homo sapiens
cacatttattgtaatcaacagtaactggatgtttctgaggtgttttgattggactcaaaagtattacaatcagtttggagacaaaaacacaatctgcattttagtttaagtatgacactgatgacttaaaaaaaaactatatacaaacgttctatataaagtttgcctccaaagtatttctctttctctttcttttttgcaggggagatggggtctcattctgttgcccaggctggagtgcagaggcacaatcatattatactacaacctcaaactcctaggctcaggataaaacaagatttattttattctgacctggaaatgagaaaaaatatgccacctactattaatccatatgatataaatgaagaaacaaatggtgaaagggagaaagctcttctttacaggagtatgtgatctaataaataagaataaagtttttttaaaaatca

SEQ ID NO: 762 - DNA, 3528 bp, Homo sapiens
attacatttcaaaatgaattttagaagaaacacattcaaaccacagcacatttctagacaaactttcagacacagatgtagagaaattttaatgaaattgaattttaaccaagtgaagacaacccacagatttgcaaatacccttctaagattcttcaaagatatctcaatggttaatcacgttgtttaggaaaatgagaacagtgacagcaagaccttctcagtggtacaatggcctcagcagcagtaaaagagggtagtaaacattatgcagactttgtgtgggctctggatcacccacagagaagaaagttattttgtatgtatgtgtgtaactgtatgtttaagagaaatgaactgtttatttacagggattattgaggagcagaacctcacttgggtagatgcaggtgtaacttttaagatcaatatccatggctttgaatagataggctagagatacagcagatttacttagttccccaaagatgcatgttgggtgatacccacctatattagttttccaattactgcaaattcagtaggttaaagtaacaattgtcttatctcacagttctgtatgtctgaagtccaggaaagtatggctggatttttctcagggtcttataaggtggaaatcaaggggtcagctgtctgcattttcatcaggagattggctactcctcctagattattcctagtactggtagaatttggttccttgtgacagcaggtctagggtctccattttttattggctgtcagctccttgcagtttctttctggtccccttgatcttcaaatgcacatcaaatctgtctcatgtttaaaatcctgtgatacccacttctgcttcaagacagaaaactctgcatttaaagggctctggtgattaggttaggccaacctgaatagtatttattttgtcaaataatgtaacataatcgctggagtgacatatcatatttttaggttccactcatgctgaaagtgaaggacattatacatgggcatgagtcactggaggtcattcttggaattctgcctaccataccaatggagatcaaatgccaggaaagtcaggaatagaaattcagagagcatacaatcaaatatattaaattagaattcaaaactattcaagagatggttcagagttttggccaagcagtggatcaaattttcttactactgcttaatcaaggatacagtacagaagtaaaatgaattgatctttattaaaatggagcaaagaccaggtctaggaaggaaaggcaagaaggtggaatagatttgctcttactggaagaacactggagattcaagacaagaaacagaattgttttagtccctgagttaacaaataaaagaaagatgagaccagaacagttgtcaatgaaggagcagtgaagtagaaaggaaggatggagtgaatgtggagagcacttttctgaagagaataaacttagttgtcagatgaaaggagatttataattagctttgtccttacaaattttgaggtaacttaccatggaaatactttttcttatcagttgattaatctggggggaggtagcataatcctttgaaattccagtgcgtagaaaactaggctcgacctcaagatgaagcctcaaaaaagaaatgtctgttagaatccagttaacaggagaacacctactgcgactttattatcagcaagttggtgaaaacttcctgaagaagaaatgtgggatgatacagaaactgattaaagtctcagaacagcaaatagtttctcctcttgtgaattaattcaccttccacaattaaacagagataactcagggtacctcaaatactgatgagcttgacagaaatgaattgccacctaattccattgatggagaaagataagacaatgagcaaagaaaagggactttcagagagaagaattgttgagaaggtagcagtcctttctctttccatgaggtagttgctattcattactctgtgatggggactgggaacacaagaatcaccacttagggattaatgaattcaagatctgtaccttccattttgatccaaatttgaacttaaatttattcaggacaccaactgaatacttctacctaaaggtaaaactcatatcatatttccctcccaagctgcatttcctctgagttcctgacttgacggagtcatttatttgtacaatatatgaacgctgagagttgtgccacatttctctctcttttgccctggacatccaatttttatgcaacactttcatttctaactcctaaatatcttagtttactatctcaatcactgcaaccactgacatgtttatgccctttttactagcttgccaaataaatataaaagagctcattaatctctctagttccttattaatcctcatttcatctaatctagtattagtattatacccaagtataatcttccaaattgcaaaaatctgtttctatcactctttctgcagcatccttcactggctcccccatggtctacaatatatacaatctaagttttaaaaagaaaaaaacttatgactatcccttattttgaaaaaaggaaaattagtcctttactagaaaaatagcactgtattataatgtcaagttcacactagagtctacgatggtgtcaaagagctctatatttttcttcttgagtcactttgatatcctcccacagtaagaccattacagttggtgtattggtctgttctcacactgctatgaagaaatacctgaggctgtgtaatttataaagcaaagagggttaattggttcacagttccacattgctggggaggcctcagaaaacttacaatcatggtggaaggcaaaagagaggcaggcaccttcttcacagggtggcaggatggagtgagtgccagcaggggaaatgccagatgcttgtaaaaccatcagatctcgtgagactcactcattatcatgagaacagcatgggggaaactgctcccatgatttaattacctacacctggtgccacccttgacacgtgtggattatagagattataattcaaggtaagatttagatggggacacagagccaaaccatatcagttgggtactgagaaggacatactgtattaatcatgccttcttattgtctgtattttctaatgttttgacatccatattttctgatgttttgacatctggggacttgctgatcttggagggactgaccctctcagggttaactcattcctaggggtagcaaactgctttccctagagcatgcctttcatatcaaatcaaccaatccaaacctctactccaacccaccttctttattgggctctcatactctgagcccctattctcctaccctaattaccacagggccaggtactaaacaacttgagataatccctacactttgtagcctgctcaaaaatttaaaccagccaatgctaaacctatttagcctgtgtaccctgcctcactcatttgttcagtgaaaaccacaataaagtttcttgccaatg

SEQ ID NO: 763 - DNA, 2122 bp, Homo sapiens
ttcaagaccagcctggccaatgtggtgaaaccctgtctctactaaaaatcaaaaaaaaaaaaaaaaaaatggctgatttcagagtcatattcaggtttaaattctgtcattcagcccaaactcattactttatgttacttatgggaacctcatctaaaaagcaaggatcctgatacctgcctcatattgtggcaaggatcaaatgagtcaaataagatgcttgtgaaagtgaggacaggatctatcctcaacacctagtgcaattctttttacacattaggtacttagtaatttgggttgaattgtgttgaactaacctggcggtataggcaaaatttggaagtttggttttcagaaagtcttgacttcctcttatctctaagtaattggcatgtcctctaattcatattttcccccctcatctgttgggtgaaatactgtttatcctttagtactaaaattaaaagttacctcattcttctagctagctgatttttttttttaatctaggctaaatcatgaatacatttacatttaaataaaatattacagttgaaagtaaagggtcctttcattatctccacttccaattccagtaccctgtgtaaaggaaaacatatacatcttgcagacattttttaatgtgtttgtaatataggtacataaaaatatatgtgcttgttttaagcaaatttcatactctgcaacttgccttttttcttaatacgttctggagatcttatctagtcagcctctaaattagagttcttcagaaaaccaatgggatggatgaatggactcaagagattgtggaaaccaagaagtcccacaaaataccatctgcaagctggagaaccaggaaagctgattgggataattcaaactgggtccagaggcctgagaactggaagggccagtggtgtaagtcctggtctgagaccaaaggcttgatcaagaatcaagagcatcaacaaccgagggcaggagaggatgggtttcccagattaaaaaagcaaattcacgcttcctcccccattttgttctatttgaaccttccgtggataggatgatgcccacctgcattggtgaaggtcatctttactcagtctacccattcaaatgccaatctcttccagaggtaatctcacagatttagaaatgtttcgccagctagctgaacaatccttagcccagtcaagtgcacacataaccataacaattcttactaatctacctcattcttttttatcttctgcataataatccacaacatgaatgttcacgtttgacctctattgatagacatttcggatgatgccaatttctttttctggtttttgttttttgtgtgtgtgtgttttttttttttttgagacgaggtcttgctctcgcccaggctggagtgcagtgggtggggtgatctcggctcactgcaacctctgcctcccgggttcaagcagttctcctgcctcaacctcctgagtagctgggattacaggagtgtgccaccacacctggctaatgtttgtattgttagtagatacagggtttcaccctgttagccaggatggtggatgggcatttgaatgggtagactgagtgatcctgacctcgtgatccactccccagtctcccaaagtactgggattacaggcgtgagccacggcaccaggccctctttttctatttaaacagtgcttccgtgaatgtccttgtgtacacctccttctgtacacaatgatgtttatctgatgcacattgccaatcagtgcacttgctggattgaagaatgtgagtgtttgtatcactctttcagtaggctgtaccaatttagacttgctctaccaatttagatttccatcagcagtaaacaaagacattcctgcctggcagtcttgaactcctgctattatctcttaaatttttgccagtgtgtgaaaagtagtatcttactttaacttgtattttcctggtccaatagtgcactaaatgcccgagttctgtatttattctatttggatagccattagatagccattaagtccactcatagagttattttaaatgttttcctttagtttccaaccacattttcaaataaaatttagaattagcttgtcaa

SEQ ID NO: 764 - DNA, 291 bp, Homo sapiens
tatgcagccccagggcaacctgagccatggtcttcatctttcctgtctctttgagaattagtgagaaaattggctcatctgggattctacccatagaaattccccacagagggagagacaattagcaaaaggaaaacatctaaaaatagtcctttgtgctgcagcggaacacggttttccgatacctccaggatttggggctgcagttggacgttttccatctcttctaatagcactgtaacaagttgtcttgaataaacacgagctcgttagccataagaaaactttaaa

SEQ ID NO: 765 - DNA, 622 bp, Homo sapiens
ggtgctgggtgagctccaccgctgcccgggctgcgagcctgacggctgtgtgtcgggaatgacgagacccaggcttgcaaagacttgcacggcaactggaatttatgacaaatagctcactgcagctaaactttgatacagtgtacagtagaaccgcctgttacacacaggagggagacgcgtccttcgtcaccatgcaaagccagccttaacacaacataggaaaatgtggcaggtctctaattacggactgagaacaagcagaagaggagtgacactgcagattccgaggcactgcagtgggatgttggctcagcaagtggctgtgatgtacgggataggcatggaacaggattccagctgttccatgcaaataggataaaagaatggtaaagaggattcctttttttttccctcctcaaaacgttaccagcaaagtacattcacagagcctttttaaggtgccttttgccagcttttgaactgaacttgtaccagtatctcaagccctgaattgtaagaagagctgagagttctggaactcatttttaaaaagtagatctacgaagattctaggacgtccgtttctgttactggctccttcttgtgcttggatgcagct

SEQ ID NO: 766 - DNA, 723 bp, Homo sapiens
ttttattttgggaccggacacactattatataaagaggatctgtgagtgttacttggtcttgtaagctatttttctttttttcagcaaaatgttgtgagcacctaccatatgccaggcactgttcagtgaactggttgtacaggagtgaatgagatcatcttgattttgagaagtttataatctactcaagggaaacacgtgtaatcaactatgtttcagacataacccctcaaaaccaaagcagaacctcttcaaggagctgagagatgcaagcctggaggagaaaagcggggcagcatcaaacccctcccactggggcaacctgctgagcatctccctggccttggcccctggccataccacacaagtgtccaatgagtcactgatcctgaagaacaagagaagactgaccacagaccccaaaaggaagcaggagtacaaccttcgaagttggtgggcaacaagaggtcagaggttgacaagcatccacacagctctaagactagcatcatgtggctacccaggacctgggagagtgctgcagagcaggagcaggaaagggaccggctgttcccatagaacttcatgtcacaggtctgggagccagggggccttggttctagtcccaactctccctctaagttgtcttatggccacaggtgagtgaaatagcttctctggcctcagcttcctcacgattaaaatgacacagttgtgcaaaa

SEQ ID NO: 767 - DNA, 466 bp, Homo sapiens
cagttatccttgtaactcctaatgtctatataaaagatttttatattttttaattcttaaaattttattatttatttcacaccaggccatcactgtgatacattttttaaaacacattaaattatcaccagaaaagtgctgtgatggaaaatataaattgaaataccttttctggttaggagagtaattctgtttttctgatagagaatagaagagtccttcaggcccctccaaactgtcatattccgggcatcgggtgtccccatcctcacttcagtccacaggcagggtcctcagtcttcagcgctccttctctttcccctttgtcttgtgtctccttgggtctcttttctccaagacctaaactccctgaggacaggactattttttacatcttgatgtcactcctgagcacttgctttaatgtgttggacactgggtccattaaagattgtatgtgaaatta

SEQ ID NO: 768 - DNA, 3070 bp, Homo sapiens
aaaataaagcaggcagaggaacgtggaaggactagactgcctgagtcttctgaccttcatctttcccctgtgttggatgcctcctgccctcaaacatcagactccaggttcttcagcttttggactcttggacctaccccccgagtggtttgccaggggctctcaggccttcggctacagactgagggctgcattatcagctttcctacttttgaggttttgggactttactggctttcttgctcctcaacttgcagatggcctgttgtgggacctcaccttgtgatcatgtacatgagggaaatacacacccctcccagggatgatggaaggttaaggtcctaacacctcctgcacatctgagcagctgcacattgaaccagatagtcctggaatgtgggaaaacagaggcagactcaagagtctggaacattattttaggatcacacaaaaaagatacataattttcatagaatgatactgaaagcatctcaaaaataaaatcacgagtatctgcagatcactatgagactggactggaacattaccttcagacacattgatatgactacatgctggacattttcttgcggaaatccaaaagaaatccccattttcttgcagaaatctaaaataatctcccctatgtgcaagtcagactgagcaccactcccaagaccatgacctcccctgcagccctgctccttcccactcacctctcctcttgagaaagccacctcccaccacccagtctgcagtgccagaaaactggaaaccagcccctaagctgctttcaccttcggcccatttctcactagccagcctctcccacggcctccccagtttcttcaaatacaccccctccactattcaccatactgccaccgtgatttatttacaactttttgtccggattacctcagtagccttctaattgtcccctttgcatctaaagtagcccctctcatcccccaaatcttacgtcactcttctacataattctggctttccatgacccataaaccacatttctcaagtgtgctctatgctggcttgaatatgttaataatcttaattctacttttagtgcaattttcttagagctggcatcactttcatcatgacgtgagaacttactagagataggcaatgatgactcacagtcaagccacatgtcatatgctgcagacatctggactgctgcttatttgcaaatccttttcttcatatttttctcatttgtagcactggatcaattccaattaagagtttaataatgaattaactaatgatttaaacaggtggataagactaacactgaaccaatgattttaagtaaatctaaatacataaatccccccaaattattaatctatgttgtttactaagaagtgtattaaaatgatattgaaaaagtttgctttgggaaagagctagaagttagaaggtctaggttcaaatcccgcctctactccatccttgactaagatgttggacccatcacctcaactttccttgggtctttttgcccagacatgacccgatgacacagagcttacctggacctccacaatagtaaatagaacagggccagcaaaccaaaatttgttgagtcctttagaattaagtagcttagataaattttcatcaaaatctttatatagtagggaatagaaaaaagtcaattctgttttatttgaggatgtatgaatatgttaccatttttcagactctgatttaccttccaattattgtttattggggtcattgtaaattagttatcattttttgaatacacattcactgctgacaaagtggtgaagccagaagttatgtttgaccagggaagattatgaccctcaaaggagaaaaattcacagggggtagttgattattggtggaatggagtgagagtgaattccttaaaagtttaaacgaaagcagaactatattcatatcatggagggaacttagtttctaatatgatgaactattgccccaagtcatgacaataccttgctctctggaagagaatgagtgagtttttcatccgccaagatacacactctatatttccaaccatcacatctgccttgcaggctgactgaacccagagcaaatcaatcacaaaagttaatccaaaagacttcccttcagctgctggaaatcagtcatcacatctgtgaaaagagtgctagttataacaaatgagatcacaaatttgaccattttattagacaccctctattagtgttaacagacaaagatgaaggttaagttgaaatcaaattgaaatcttcttccctctgtacagattgcaatatctgataataccctcaactttcttggtgcaaattaattgcctggtactcacagtccagtgttaacaggcaataatggtgtgattccagaggagagtactaggtggcaggaaaataaatgagattagcagtatttgacttggagccataggcatcaattctgctccagctgtcgaccaggttctaaaaacaagactcggagcagcttttgctcttgctagtgatgcagggccaggagagcccccacactctgcatttgcaggtgtccatgaggggaagccactcctgcatttatcctgtgagtggagaagctcagaggaatgaggacattccaacagggtatcagaattctcttttgtttatgctaattgacagcaggaacatcaccatcttggacaaacaccaccattttaagttctcttttatttaaaaactgcctaaatccagccccaaaacatcagcctaatggctattgtcagcataatcagaaacattccaaccctaagataaacacccctctggccagaaatatgccgaccccgagacagcctcccctccgaccagagacattccaaacccgcagtaaactttccttcacatggaaacattccaaacctacaaaaagcttccctcttcctaaacccttaaatatccttagtctgcaagagagaatgctcctgactgaaatcagccagaagcccctctcaggtttattctccaaaataaacctgtctttgactgttgagcca

SEQ ID NO: 769 - DNA, 3252 bp, Homo sapiens
attaggcacccaggggcccatggtcacattagaagttaaaggcagcaggattctgctgtatctggattccaatttctcactgatggctaagccactagatggagttacaaaaggggaagaaaaagaacccctcctctgggaaacagcaggagaaggagccctgcctggtgaaaacttgcttatagacttcacagaacctccccgtgccggaggttattggttcatgctagtgcttgtttgcaccttttcagggtgttatgtcttggatccaccacagtcggctaacactggcagctcaggacaagtgaaccagccagcaggacccagatcatccaacctggctgatccttagatgagaccgagttgctgctgaggacaacagccctgctctagtcactctggaggctgactagtctacgcacggctgaaacttgaggacttgtcaagcaagtaatgtagctaaaatcttaagactagtggttttcgtgtacactaactgttttactattgttctgtcgctgtgctcaacctttttcccaggtaaggaccttttttgtccttgctggatatgaatatgctgtacattgttttgttgttaccccccttaaccatgtagaagaaacacctacagaaggtgtccccactgtacacatactacttggtcagggaacagtataactagaaccctattgcactatacttattatgagtgtacagggactcgcttaggaacttgtacttataatcaaaccacctattcaacctgtgacccaggaaatggccagccttatatatgctatgaccctaagtgtttacctgggacttggtttgagattcataccgagtcaaagggaggaagttttgtaagttgaacccaagcctctcttcccgggggcggggggtggggtggctatatccatatactttgatatttgtcagttaacatccatgaaccagagattgtgaactatctcacaatctctggtcctacagggtactatacaaactgccagtacaaaattgcatgtgcaccccgtttgcccctccgaggccctagcgatagcttgctggaaccgcacaacgcagttcactgaccgatcatcaccgaggctaaagccaatcttgctcatcaaagtgccagcaaaaccggattgtaagacaagcacttgcaatcctgtaaatcttactatcttaaagccagatctacctatatagactgcaggttactccatggcattacaaagctacagtcaaaaaactaaaataactttgtatattctaaagaggactcaaaccaagcggtcagctcagcagcaattccgagtctttaagtcattctttgagcatataaaccaaaagttaccagagcctcctcctttagccaaaaacctatttgctcagctggctaaaaacattgcatgcagcctaggcatttcctcatgttatgtttgtagaaggactaacatgggagactaatagcctcaggaagcaaaagagttaatgcctcaagataactttactctgactctctctttccccaaacagacacgcacaagttcaagcgtctagctcttaaaaacttctattattagcagatactgtgttgctccctagggaaaagtttttacagacccagtaggagaactaacctgcttaagacagcaatattataatgaaacattaaggaaaactttgtggcagggcagagatgactacaaagcacctcatccaaatctgttctcctgtttctcttctctaaaccacacttggtatcaacttgaagctccaaatacttggcaagcaccccccgtctttattggatctgtaggctacaggcatattgacagttgccagttaaatggacagaggtgtgcttagaacgattagaccatctttcttcctactcccactgcaacagggaaaaacttcaaggtaccctgtctatgatgaagttagaagaagaaacaaaagagatgcagacacaaagaggtataaaaataagagattgaaaaggcacaaattagccccctgaaaaaataattccatactataggccagctacctgggcacaagataggtcatagggagaccgcactcctatctacatgcttaaccgtatcataagattgcaggcagaacttgaaatcatcaccaatgaaacaacaaatgcattagatgtactggcccagcaaaccacaacattgagaaacgctacctatcagaacagattagctttagactacctcctagcccaggaaggaggagtatgtggaaagttcagtctaactaattgttgcctggacatcgatgacagcggaaaagcaattatagaaataactgcaagaatgagaaaattagccagtgttccagttcaaacttagaaaaggtgatccccagattctctctttggagactggttttcattttttggagagttcaagactttaataggagtagtgctggccacactgggaagctgcataatactccattgtctcttacctttccttgttagaagtattcaatcaactatagaggcaatagtagccaggcaaactacaactcagctaatagctctgtgtaaatatcaacctttgtctaaagaagaaaacttgtctcttcaggcagaactaagtaatagtgatgccttttattaaacttatttcataaaaggcatcaaaggggagaaactgaggcagaaatttaaataataataataataaatactgcatttcttcactccaagaaaagtaaaagctaaggcccagaatatggcaaggcaaaggctaaaaagaaaagaacaagttttcctcttgcctagcagctcactttaaggaaagttagaagataacgctgtccaaatagccaaggccaaaggaatgggctccagacacccccctcccttccagagcaagcttgaaagaaaaaaaagaaagacaggttcttttactgttactcttttcccaggcttcttaagcatgattagcatgattatgttttacaaatgtctgtatttagccagttcttatttttcttttaatgcagctacaaggccactggctaggtcacaaattatgttatgctatagattacgtgacctgttactgtatgattaactgcttttattttgctactgtttttattttgcttctgtaagaccgcttataaaaaccctgctctttgttcagggctcagctttcggatgtgaatcctctgagccggtgcgtacctaaaataaacaaatcctcctgt

SEQ ID NO: 770 - DNA, 331 bp, Homo sapiens
gaagctccttagtgaggagctgccatgctgggccatccaccatctggattcctacgactcagggaatagaacactgcaccttccagaagcacttgtttcttcgtgggtacaccaccagctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattattttgtcata

SEQ ID NO: 771 - DNA, 243 bp, Homo sapiens
ctgaatgagaccctttgctagagctggcacagggaggaaggtcgtcctggagggagggtagacactgtggagggaagggagacctgtgtcaggagagctgagaccacctctctgcccctcactactcttgtaatctttaggagtgtaaataatccccctaaggtggggacaggaccccagtccctgctgtgcgcaatagattatgatgatcaaaataaataatcagtgaatgtggatgggaaa

SEQ ID NO: 772 - DNA, 1432 bp, Homo sapiens
cagcacccctgcctcattaaccagatggctgggataagactcttgattttgaaaattcaacaaccagagttcagctatttgcagtgatttgcagtcatttgtcactatcaaaaaggaaaataactaaaatgtggtgtgttggcattagttacttactaatgagcaagatcagcacctgcatttcagcttggctctgtcattttctatttattggaagaatggtgttgtggttaagtgtgtggtgtgtagaggaagactatttgtttttttgtcttgttttgtttttattgaaatatagcatgcatactgaaaaatgcacaaatcatatgtgcagagctcactgaatttcacagaatgaatacacccatgcaatagcactcagatcaagagacagaacattagcagcacccccagaaggaccacccccaggatcccttccagtaaccacaccccctccagtagaaactattatccttacttctaacatcacagattacttttgcttggttttgtaacttatataaatgaaatcacaccatatctactcttcgtgattattttcactcaacattatgtttgtgatatccattcgtattgttacaatagttgttgttggttaactctcattgctgtatagtattacattgtgtaaatataccaaaatttatttattcaattcattgtactattcatggttattagtttgcaattattggcaattatgaataatgctgctataaccatttctttatattctttgtagtgaacatgcatgtatttctgttgttatatatttaggaatgaaactgctgtgtcattttgtgtgcatatattcaaatataatagttgttgccaaacactttttcaaagtggttgtaccactttgcatttccaccagcagtgtatgagtgttctagttgctctaaattctcaccaacacttggcattttggtattttttattttagccaatgtggtgatcatgtggtgacctctcattatggtttccttttgcatttctctgatgactaatgaaattgagaatcttttcaatatatgttgactggccattgtacatcttgttttgtttgtcttttagatgtcttttgtcattgatttgtaagggctctttatgtattctggatatgaatcttttgtcaaatatatgcattgcaaatatatacttttttacttattgatatctttaatttgttttaagaaaatttttaatttttatggaaattttatagaaatgctgaaaatcaaacgttatctgcagtggtaacagtctgacttctaaactgctatatgtaatagaagaacaatacataattgttgtatatatttatgaggtacatgtaatattttgatacaagcataaaatatgtaatgattgttgatctcttttaatgaacagaattccttaatcataa

SEQ ID NO: 773 - DNA, 557 bp, Homo sapiens
tcaacttgcttctgccatgccagcgtcacccctggtctcaggtgatttcttaggctaattctcagagatggggttattgggccaaaaaagcaaactatggctttccgaagctctcattgttcccattatgtcatgcatccctgagatgcagtcagcagaggattctatttgagggactaaacactcccggggaaagcaggaagaaggagacgggaactaacatttgctattgagcgccaggcatcgtcctacaggcttcgaagtgaaccttggatgtgctgctgatctgacctgcccagatttgtcatcattgttattgtcttggcctcttatgaagacgttcacccagcaggacttcagaagctttgttcactcgatctcatttaatcctcacaatagtgccctaaggaagatattagtatccccattttacaaaggaggaaacgggaacctggggagattaagcgaaggcctcacagatcatgaatagaagaggctggaaacctagtctggttcaagggtgtgctctttctgctctgccatgctgtgcttcagcc

SEQ ID NO: 774 - DNA, 457 bp, Homo sapiens
ctcagcttcggcattccagcctggaacaatcctcccagacctggaggtccgccccctccaaaacttccaccgcctccgccaccacctcctccgccaaatccgccgcctccaccaaagccaccaccaccgcctccagcaccagctcctttaggttctgtagaagaagagacacccgacagactatgccccctggtctggcccagaaatggactggagaagctaaaaaagacactgctggacttgtcacagccgccgggaaacaagaattaagacagttcggaagagtcccattcaaagtgggcggtctagaaaatgaaaattttaaattccacagcagcaacagcagctctcatgtatggagaatctgctggatccagggctctatccttgcgtggtctctgactcctaagacagcggaagccagcatcgctgtgctcatttgatagactcagagaaa

SEQ ID NO: 775 - DNA, 360 bp, Homo sapiens
cacagcactcaccgaccccaggcgtgactacgtttgaggcaaccatgaaggcttcagacattcaaacttcttaatagaccaggcgtggtggctcacgcctggaatcccagcactttgggaggctgagctttcctcattggccgtcatgccttggatcattaaggacactttggaacggagctttgctattctctgaagatacacaaaatcctccactgctcacgtcataatctatttaccaactgtggaaaattccgcggtgcctgtggtttttaaagtgatgctgaagcgagcacctttgtgcatatgtcttgatccacgcctgattttaaaatttcagataaaatcctagaagtgaaa

SEQ ID NO: 776 - DNA, 2319 bp, Homo sapiens
gcggccgcgtgcgcaggcgtacttcctggcttgggaaccacatcgcccgaccgtgctctttatttttcggtggagcagctctgctttctcaggtctctacttacttatataagatggcatcaagaagaaggacctgaccactggcccctgactacatggtctttggaacccgtggcattggaagatgtcagagacatggcacatggatgtgatcttcaaaaactgttacagcctcatctcattggattggtctacacatcaaggtgctggaagtgtcgcatgcccagagatgatgtggaagctctatacccctttcccttctgcccaccttgccctgtgcatctcttcctgaatggcttctcctgaattgtatcctttataataaactggtaaataggaaagagataatatcttctacttaatcctggatactatatctgaagtcagagcatccactccaaagcagagaatttctgaaaaacaaaataatgtcatcatatgatgttagaattttttttcaaatgatggttcctaatacttcacattagaagaactcgaatttgatgaccagtttgagaaacaccagtatatccagattacaagaaaaagcgagtcaaaaggatgatcatgaatataacaacttcgaggaaacatttaaccaaagaccaaagctttttaaacaactgagagtttttataagaaaaagacctcatacagtagtccccacttattcatgggggatacatttcaagacccacagagaaggcctgaaatcactgatgtaccaaaccctaaccaggttcttaggatgagctactaaatgacaaatgggtgggtagtacatagagtgtagatacaccagacaaagaaatgattcacagcccaggcaggacagagcagatcacacaagatttcatcacagtactcagaaaaccacaccatttaaaagttatgaattgtttatttctggaattttccatataatatttttgaccacagtttcccatggataactgaaaccatgggaagtggaactgtggataaggcaggactactgtaactatgacatcaatggtaggaacctgaagcataattctgctgtagtggattttttcaaaagaaactcatgaatgaaaaataatttattagatataagaaaggatgcatttgtatctcaaactttacttattctggaaataaatgaaaagccaacacctattacataccgacaaaaatgaaaaaataaataaatgtaaagccatagttcagtactgatggaatctgagaaaatttatatgaccgcgaacccatatctctgtactgaatgtgggaaaggctacacttgtcttgcatccctgacccagcatcagaaaacacatattggagaaaaaccttatgaatgtaaaatatgtggtaagtcctttacccggaacagtaatcttgttcaacatcaaagaatacatactggagagaaaccttatgaatgtaatgaatgtgggaaagcttttagtcagagcactaatcttattcagcatcaaagagtccatactggggagaaaccttatgagtgtaatgaatgtgaaaaaacctttagtcataggtcatcccttagaaatcatgagagaatccatactggagaaaaaccctatccttgtaatgaatgtgggaaagctttcagccatatctctgcccttactcaacatcatagaattcatactggaaagaaaccatatgaatgtactgaatgtggaaaaaccttcagccgcagcacacacctaattgaacatcagggaattcattctgaggaaaaatcctaccagtgtaagcaatgtcggaaagttttttgccacagtacatcactaatccgacatcagagaacccacacaggagagaaaccatatgaatgtaatgaatgtgggaaagctttcagccataccccagccttcattcaacatcaaagaattcatactggagaaaaaccctatgagtgtaatgcatgtggaaaggccttcaatcggagtgcacatcttactgaacaccagagaactcatactggagagaagccctatgtttgtaaagaatgtggaaaaaccttcagtcgaagtacacaccttactgaacatctaaaaattcattcttgtgtgaaaccctatcaatgtaatgaatgtcagaaactgttttgctatagaacatcactaattcgacatcagaggacgcatacaggagagaaaccctaccagtgtaatgaatgtgggaaatccttcagcttaagctcagctctaactaaacataagcgaatacatacaagggagagaccct

SEQ ID NO: 777 - DNA, 1623 bp, Homo sapiens
agcaatgcaccctcaacagacccatgggggctcacgagctcccagcaacgcaccctcagcagacccacgggggctcacgagctcccagcaatgcaccctcaacagactcactggggggtcacgagctcccagcaatgcaccctcaacagactcactggggggtcacgagctcccagcaatgaaccctcaacagacccacgggggctcacgagctcccagcaatgcaccctcaacagactcactggggggtcacgagctcccagcaatgaaccctcagcagacccacgggggctcacgagctcccagcaatgcaccctcaacagactcactggggggtcacgagctcccagcaatgcaccctcaacagactcatcgggaggtcacgagctcccagcaatgcaccctcaacagacccacgggggctcacgagctcccagcaatgaaccctcaacagacccacgggggctcacgagctcccagctatgcaccctcaacagacccacgggggctcacgagctcccagcaatgcaccctcaacagactcattgggggctcacgagctcccggtccgaggcctcctttggcagcagggactcaggagggagaagagtgagcccttggccacatggttggtcaaatcaactcctagaggttgtgacccttctctgctgtggccttcaccaaaccacgcatgttgggtggaggggaagtggcctctgtggctgccccagctggcagagtgtggtctgtcctgctctaaactgggtccccagaaggcactgctctccagatgggctggtgagactccttggtgtccagctgcttatgaccagcacagttaggggctgtcgtcagcaccgccactggtacctgcagagccgagtccactcctggggccggctggatcagggtgcagccagggtgtggggcaccagggagctctccgggacccccaaagccagatgcggccctgtccactcgtgctctgtggacggagaaggcagagtcccaggacactgtgctcaggaaagcgagctccagaggaggctgaggagatttgggagtgcccaggacagcctggccctgtgcaggtccatgggaaaaccttccactctcccctttcagggaggtctgggggcttggctgcctctcagcgggccagggcgacttctcatcatttccgcaatggatgcagctctggcctgggggggtggggaggagcctccagccctggcccctccgccccagccctcgctagcggcatgactgtgggtgaacggcggcacctgaaagcctcagtttccctgtctgtgaagggatgcacagtgtcagtttgacccccggaggctgcagtgaggacggggcccaggaggtcaggagagcagcccgtttctggccagggcaccgtggtgtttgtggaacacagccccactgacttcagctgctggggcagaaagagccgtgagaagagtcgatctcccaggggcttcatgtgtctttttgctgcattttactcacacacgaccctcctagtccatgtaagagaagataagtttatggaacaaacccagtatttacttaacttttaaaatataagcttcacagaccagcgttacataaaaa

SEQ ID NO: 778 - DNA, 4732 bp, Homo sapiens
agataccggaggcctctgctgtggctgcccactggctgggcccaggccttgaagcggtggcgaacgtctcttccctaccctacctcggtgactgatggcggcggcggcctctcccagtccggaccctgccggccgtcgggtctcccggcccaagcctgccgggcctggacgaaacccccgccgagcagcctggacgcagcgcctttgggtggcggcgggagtagcgtgccgggaagcatggcggccgctcgaacgccgcgcggcggagggcgttagggcatggagggcccgggaaggcggcctagggacgcaggcaggctcggccgcctcttcaggccacggagccgccagatctgggtcccgggtgaccactctgtcgccattgggcgagacctacctagtcctaacgacaacggacaaaggccttaacgggcctgggaggtgagcgaagtcccgaacgacgacgggtggaacggttagcggcgatcgggcggttggtctccgtactaccagaccttgctgtcggaagagacaaatggtagaatgacaggccacgtttggcccgttggaaatgccctccatcctctgggaagattcacaggccgtttacggaaggcctgtgtatataatatgaaaaagctgctctcaactccaccccaaccttttaatagaaaacatttgtcacatctagcccttctagatggaaagaggttgccgacgtatgatagagttagaaagtcacacatcttgtaaattctcatttgtttaaaagaaatcatagaaaatacatgtcttccggagttgacttttggaaactgagttgttagacggcctctagaagcgatacgttcacgtttgttcagtgggttagatgacatggagctcgaagacctgagaaggaaaaaaagaaggttctatgctagactggtcatatttagaagacattttcatattctatccattgttttgtgtgcattcgcttcctcactactatgtatgtagttgacaatgctaagcttttttgaaatgtctattctttttagatattctgaagtgtctgatatatgttaaaattagaggtagtaaaaccacattttgtaaatatctttttgttacaattcatagaaatgttgttttttggggggaatggccaaatcacctgttgagtaatactcattgtgtttgtgcagtagttcaggggaggagagaggagggggaggtgcagagagctctatgccatcctgcttacagcgaggcaagatgaatcactatgtctgtgcattttgttttatctatgtatataatgtacataaaggacaaacgagtcctaatttacaacatctagtctttctggatgttaaagaggttgccagtgtataacaaaactagagttagtaaactaatatattttgtacattttgttttacaagtcctaggaaagactgtcttctgaaaatttgagcattcttgcccactgggttgatggagatgggaagggttctaggccagaatgttcacatttggaagactctttcaaattataactgttgttacatgtttgcagtttattcgagactgctgtgtacatacatagtggacaaattaactccttacttgaaacatttagactatctagatgtttagaagtgcccgatgtatattaaatgtagaggtagtaaaataccaatttgtaaatatctttttgctaaaattcataggaaatacttttggaagttgaattgtgaagccacctttgtgagcagtatattactgtctatacttgctcaatggtttagaggaggtgggagggaagaaattgcaaaagataatatgctagtgtgttcatacttggacattttcagacaccatttttctgtatgttttgtgcattttgttttgctctgtatatagtgtatataatggacaaatagtcttaattttttaacatctagaggttgccagtgtatgacaaagtagtaaaattagcatattttgtatgctttgtgttgaaattcataggaaaacttgtcttctgtaattgacttttgcataggaatttgttcagccatctctaagcattacacatgcgtgtacttgtccactgaattgaaggcagagaaggaagagaagagggaatgattcaaggccaaaatggtcacatttagaagataccttagatgataaccattgttatgtgtgtgcagttttatttaacagtgccgtgtacatggtggacaggctatgaaatatctagtctttagatatttggaagtgcttgatgtattttaaagtagtagtagtagaataacactttttgtaaatagcttttaaaaactgatgggaaatgctgtttggaagtggatttgttgaaccacctgggaggtgggagggaaaaaattgcaaaaggtgttttgccattgtttattagaaaatttcagcttaatccattgcctatatgttacaagcatttcatttaactttgctatactgtatatattgtgtatatactggacaaatgagtcctgattttataatatctagtctgtagctattaaagaggttgccagtgtatgacaaaagtagttagtaaactaacgcattttgtacactttgttaaaattcatagagaggctgtcttctgaaaaggactttttggaagtgaaatgataacatcagctcgaagtgacacatgtgcttatatccaccaggttggtggtggagaggagttggaaggaatgaagggttctagaccagaatgttcctatttagaagacactttcagatataaccattgttacatgtgtgtagtttattcaacagtgctatgtatatagtggacacacttaagtccttatttgaaatatctagtctttctagatgtttagaagtgcacaaagcatgttaaaagtagaggtagtaagtaacacattttgtagttattttgatatgaaatattgtcttggaaattgatcaattctctgagaagtacacgttatgatatttgtgctggttcagggggaagaaggagcacaaagttcaaagggctttctaccagtgtccagtgtgtttatgatgaggcacattgaccattgtcccttatgtctgcattttcgtttactgtgctgtgtatataagcagacataggagtcctaatttatatctagtcgatgttaaagaggttgccagtgtatggcaaaagtagagttagtaaactaatacattgagtacactttgtgttaaaattcataaggaacacttcttaaaaacagaagtaaaattgttaaacgccccccgcccccaagcattacagatggcttatagctgtcaacggggttggtagaggtcagaaagggaagtgttctaggccagaatgttcctatttagaagacactcaaattatagtctatgttatgtatatatgccatttattcaatactactgtgtatataatggaaaacttaagtgcagtttgaaacatctagtctttctaggtgtttaaaagtgcacaatggtcaggtgcggtggctcactcctgtaatcctggcactttgggaggctgaggtgggcagatcacgaagtcaagggatcgagactatcttggccaacatggtgaaaccccatctctacaaaaaatacaaaaattagctggtcgtggtggcacatgcctgtagtcccagctactcgggaggctgaggcaggagaatcgcttgagcccgggagacagaggttgcagtaagccgagaccacaccactgcactccagcatggcgacagagcaagactccatctcaaaaaaaaaaaaaaaaaaaaattccacaacataggttaaaagtagagggctaaagtaacacccctctaagcatttgttttcagtacttcctaggagtggttgcatttgggaatggaattgttaaaacttgatgcttaggagcgtatgctgactattcactgcgtggtggggtggggaggaggaggaggtatgcagggagaagggttctgtgcccctgagttagattagttcagatggtctaaccattgttctatgtatgcattttattgtgttaatattgtgtattaaaggataaacaagtcttaatgctcaaagtatgttaaaaatagatgtagtgaatcagtccctttgtgaatgtcctattgttagtttttaggaaggcctgtcttctgggagtgacctttattagtccacttcttggagctagacgtcctatacttagtcactggggatggtgaaagagggagaagaggaagggcgaagggaagggctctttgctagtatctccatttctagaagatggttttagatgataaccacaggtctatatgagcatttttagtaaagtgcctgtgtttattgtggacagagtttattattttgcaacatctaacctttatgaatatctgaggtgacaatgtgtgataaaaactagagctagtgggccaggcgcggtggctcatgcctgtaatcccaacattttgggaggctgaggcaggcagatcacaaggtcaagagatcgagaccatcctggtcaacatggtgaaaccccatctctactaaaaatacaaaaattagctgggcgtggtggcgcgtgcctgtagtcccagcttctcaggaggctgaggcaggagaatcacttgaacctgggaggcggaggttgcagtgagccaatattgcgccactgcactccagcctgggcaacacagcaagactccatctc

SEQ ID NO: 779 - DNA, 3897 bp, Homo sapiens
gcggggtctggtgccggggcctgagtctctgctggctaagccgacgcctcagccgcctcagtcgcctcaatctcgccttccgccctcgctctccctccgcgccaccggaccccgtagccccgcgcgcccccagacctttaagccagatgatgaacttcctgcggcgccggctgtcggacagcagcttcatcgccaatctgcccaacggctacatgaccgacctgcagcggcccgagccccagcaagcgccgacgccgccgccccccggcccgggcgccgcctcggcctaggcggcgcccccgaccgcctcgccgggaccggagcggacgccgccggccgcctaggcgcccgcgccgtaagacgcgccgaagaccgcgcccccccccccgcgcgaacaccgtcggtgggcagcagcttattcagctcgctgtcccaagcggtaaagcagacggccgcctcggctggcctggtggacgcgcccggtgccgcgccggcagccgccaggaaggccaaggtgctgctggtggtcgacgagccgcacgccgactgggccaagtgctttcggggcaaaaaagtccttggagattatgatatcaaggtggaacaggcagaattttcagagctcaacctggtggcccatgcagatggcacctatgctgtggatatgcaggttctccggaatggcacaaaggttgtccggtccttccggccagacttcgtgctcatccggcagcatgcatttggcatggcggagaatgaggacttccgccacctgatcattggtatgcagtatgcaggcctccccagcatcaactcactggaatccatatacaacttctgtgacaagccatgggtgtttgcccagctggtcgctatctataagacactgggaggagaaaagttccctctcattgaacagacatactaccccaaccacaaagagatgctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaaggttgtttacagtatattctcgactgtaatggcattgcagtagggccaaaacaagtccaagcttcttaaaatgattggtggttaatttttcaaagcagaaattttaagccaaaaacaaacgaaaggaaagcggggaggggaaaacagaccctcccactggtgccgttgctgcgttctttcaatgctgactggactgtgtttttcctatgcagtgtcagctcctctgtctggttgtttacctgttcctgttcgtgcttgtaatgctcacttatgttttctctgtataacttgtgattccagggctgtttgtcaacagtatacaaaagaattgtgcctctcccaagtccagtgtgactttatcttctgggtggtttgatagtgtttttaaaagtaatatataatgtggggtgaaatgggagtaggggggtggacaggggagaaacgaaaaccacaaaaagaaaacccaactcctctcctccccccaagctcagttaaatcccccacctccaactttccctccaccagtgtgcttgggatcttcaatgaactgtgcttttcgctttctttctgcatgactattgtaactagatagaacattaagagattttcaagatcaaacttccatagcttcatccactgaatttgaaggcatccacctttttctccatttgctaaaatttggtgcagtttgagtttatgtgaataggctggctgtgcctgtagagctcttgtgtttttagtgatgacatgaaatacaaagaacaagctatttccaggaatgtgttctgtattttacatcccagtgtaccctttattttattattaactaattaactatgagatttttaaaaaatggggccgctgatgtgcaatatcaaagtgaacttgtgagtattttgtgtgtgttgatctcagttgtttcttcattgttgctgtttctggatccagccatgtgtgcgcttgtgtggacctgaggctgctttctgttcccaaagcttgacctgtgtacagagataattccttggcaatgttggacatagaatgcagggagctactgaaggtctgtcagggatttgtccattctgctcttggcctctcctgaggcctcataatgggagaccaaatcaaaaatgtcccatgtcacttgagtgggtacactgcctacagaaccttgaggttgactcctgcttcagttctcagctgtttaccacagccctccagggtccaaagattgaggagctttctctttcctgggaggaactgtctcagatttagcttgtgtgtgttttggacagaggctccacagcggtggctcttgaggaatcctcaccagtttgttctcttccctctgacaagcagcacctgagcagatgctgaggcagttcattaaaccaggcctcagcttcagtgcctcatcttgccatctcccggccaggctgggaacgggcaccaagcagccgcctctaacaaacaccatggtccgtggaagttcatgccagcagcttgcctttgagaagaaatgctgctggctctatttttacattcccttccacctctatactgtcatgtcaccgttctgaactcccagatctgagaaggaactagtgttggtggtatgtaacaagagttacgtatccaggggcttgtgccttggtttctcctttgattgctggtaaattctgaggccacagagaaatgcattgagtgtgaatgttgtcatctgtaatccctccctcagctgataatggtagttgatctgttgtaaatatatacatatatgcatatttgcacttccagatgggttgcataagaatcaggtccttaaatacctcccaatctgatgaaacgatagaataaagtaacatttcccagaatggaggaatacattattttatcgtatatttttgtccaagcgatgagctgacggtggtattgcttctctgcatgttatcagtgtgtacatctggtgcttttcatgtgtcatttgtgagccacaaatgcaaagttgccatttgaattcagtcaggctacagggtggtgtcagtcaaggtctttcaggtgggggagaaattggttagggctcccactgccaaatgcaagcagatagcataacctgactgttatgtgccctcaggcagcatgcttagggacaactctgtggcctgggggacatctgtgtcacagtataggattgccattcaggtgttttgtacctatttctttcctgacgttgtcccctttttttgtactgatccaactgggagaacctcagccaatgctggaagtatgattgaagtacctctcttttgtgactcttgtacagcttaatgtgcaataaaggaaaagttatatctgtc

SEQ ID NO: 780 - DNA, 697 bp, Homo sapiens
atgatcgcgttgctcgagctgccgttggaagcttagaagcaggtgctaccgtgctagatacaaagcgatctatttaaaagccctctgtcacgcacgcacacttactgacgaatcctctggctctctcctaccaccgcccggtggcggattccggaattggttcaaaaggccttgatcccgaacacccaggacagagacagagtacttttcctacctctttcgcctgcatccttagaaaactcccgtggatgagaagatccccaggcctttacaagctgttgttttacaaaaggagaaactgaggcaggaagaggcggtggatgtgcaccagagcacgtggtgcgtcggtgcaatagctgagggcacatggaacattcaccaagataaaccatatgctggaacataaaatttatggatgtcacccatgaagcagagtccttcagaccctcaatcaaaaacaagtctcattttacattaaattggaggactatctggagtctctgaccaccgtgtgacagaaaagagagcagaattgttgcatgatgggtaacactcatcagtaatcgctgtttgccaagccatctgggaggagaccaaagagctataaaataagttcaggcacggtggctcatgcctgtaatcccagcactttgggaggccgaggtgggtgaatcacctgaggtcaggagttcgagac

SEQ ID NO: 781 - DNA, 1273 bp, Homo sapiens
gccgagacaggacaaatatttgagctctggagtttgagaccagcctgggcaacagagtgagactctgtctctacagaaagttttaaaattagccaggtgtagtgacacatgcttgtagtccccattacttggaaggccaaggcgggaggatggcttgagcctgggaggtcaaggcatcagtgagcgatggttgtgccactgcctggagatagagtgagaccctgtctcaaaaaagaaagaaagaaagaaagaaaaatccctaagacctgacctgcctactccctagaaagcaccaaataaggaaaagcactccggaagaatgaagctaagaaggctgtgctctctgaggcatccgggcagccttcactggagggacaaggtccagtgggaccttcttactcaagatggcttcaattccaatcaccagagagttttgagaaccagtgggaggggttcctgggcagcggggctctgctcctaccgggatttgtttattcagctgatgttaataaatgaagctgaaggtaacaagctgtcacttagcatctccaggctggaccagaactgccattggttaagtttcagacttcagccccaaagtacagtgtcaccaccttggatgaaggatattaattagtgtcatgagggagatcacagtctcattcccctccgtcactagcacgagactgaaaaaaaaaaagaaaatcaaattcagttagaacagagacgtgctgagaagctgggccagagaccccgcggggaacctgccgttgtttgtcaaaaaacgaggccagcgaggaagaagccaaccatgcctcccgctccactcgctttggaacccacagaatgttcaacagggcagcacctttcagttattaagacactcagattccaccctggtgcagtgaagcaaactggattaaccacgcggcacgtggcagagccacagcgcaaaccacggctcctgctgctgaggaaaatacaggcacctcggccactctgggctgtgggttcgacgtgagcagcctcagggcagagacggattctgttcatgtctgtcccctctgccatcccaggtctcaggggttctgttcacctgaccatggcagagttgttttgcccacctgtgaaaaccactccaaccatcatggttaccattgcattgcatgttggcaaatttggggaacatcaccttccaggccacttacagcactcgaataagggctttgacaaaacacaagcgttattatgaatataataataatcagcgtta

SEQ ID NO: 782 - DNA, 979 bp, Homo sapiens
tttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 783 - DNA, 560 bp, Homo sapiens
gttgtttatgtaagaatttcaaggccacaactccatatttgaagtaaagtgctcataaaattaattgcaaggaaatccatcactatgattcagtaagtaaacaaattcaaggtgtcacatcatattgctttttatgcttttgattttagtaatatcctttcacattcataatccagatagagagataagcaagattgtatccaccaagcctcctctttattgatcttccaaactgaaaaacatagctgccattttagtcagcagttaaactttattatagaatatttttataccttttctgctaacattacctgcaactcccatggtgatgctcaaatcccatttgggaattcagtgaactagcagaatgaaattctaagagactggggcttgttgatgtgtccacgctttccatgggaactgatgttaaatatttcacaaataccataacttccaggaattcacatattctttattgaatgtagaattgtgaaatctttaagaaataactgaatcattatttcttcactgtctcctgcctgtgaaagcagaactatgaa

SEQ ID NO: 784 - DNA, 1587 bp, Homo sapiens
agaactataaactgactacacagctccctggcccgggaaggctatgaaacaggcaacatggacaatttaaaggtgtacaacatccgaggttccatttcaccctcaggcagcacggagtggacaagagatggggtctcactttgtcacccaggctgggctcaaactcttggcttcaagcgatcttctcgccttggtctcccaaagtgctgggattacaggcttgaactactgtactcgactgacttttcctatttctaatgtcagcatgaagaacacaagaagtcagcttcaaaggcatccagcaatatcatctattctccactttgctaaatcttacctttggcagagccttcatgaacaagattggtacccatataaaagaagcccgagagagctatcttgaccctcctaccatgtgaagacacaacaaggtaccgtctatgaaccaggaaatgggccctcaccagacacctaatctgctggtgccttgatcttggacttcccagcttctagaactgtgggaattaaatttctattgtttataagctacccagtttacactactttgttctatcagcccaaaaagcacaccctgtttcaagattctgcattcatttactcattcatacattcaaccatattttgttgggcaccaatgatgccaggcactactctaggtgctcaggatacaataattaataaggcagacaatgccctggcttcatggagataaatgtgttgatgaacaggaagtagatagagtggtcagagaaggctggtggagagcacagttgaccagagatctgatggaagtgagaaagcaaactatgggaatatctggaaaaagagcattccaggcagaggaatgagcaagtggcaaagatcctcaaatgcctatacttccatggaagaaggccagtgagtgaggaaaagagaggtagcaaaggggatcagagaggatacagggatccagatctcaaagggacttgtaggtaatggccaccactttggacttcatgttttcggagtgacggaaagtccctacagcctttcccagcccctagctaagcctctattgattacttctccttcttgtgctcttatcacctgtacttttatttaccagttagtctatattccatggatttctattcatctcttgtgtatcaattctatgtcctcaactatgtctcaacggcaagaatcagtcatattctcttctgtattcccagggcctggcacctaacagatgctcaataaatctttccagaaggtgataatgatgatgtaatctcttagaatcttttctagctgttaagatccatgatgcctttgaactctctcaacaaactagtttgcacaatgactcagaggactgacatctttctagatattttgagattatattcatgccacttttagagtctccatccatcaaatgactagaatgaattacatcagagttttgtctaaatgaaggctgtgccacttggaatgggattcccttacatggaactacctactaatatttgcactttaagccacctgaacctcaggagagtaataaattgctattaaataaatgct

SEQ ID NO: 785 - DNA, 1385 bp, Homo sapiens
ctaaggcatgcatgttgttttaggtgtgtttgagatgcctgaagaacatcagtgtatccccctaatttctgtcatgttactcaaaccagacacattgtggccatttctttttcctttatcattcccacgtccggccactgccccattcctttttgttccgtagtagaccctcaatatatatgtgtgtgttggtaaatggccatacacagcagggtattttttattattattttcagttccctcagcgcgtttaccacaaagctgtgcatataggtggcaccatatatggcgtaccttgacctcgaagagaatctacatggacttttatggacctacgtacacaattttagaaatcataataaatgaatgctggagtcctcaagaccccttccagatttgatttgctaggaagactcacaggactcagcattttgtcatactcaatggctatgatttaccacaccgaaagaatccagagcaaactcagcaaaaggctcaaacccaagtccagaggaaaccaggcacaatctttgagaatcttaatgaaatcacacaggatgtgcttcattgaagctccatctgggacttaaaacaacacacgtgagatgtgttccaggaagtcgtcttgagcacccattgctcagagtttatattggacttgctttctagcacataccacaattgtagacctccagaagaacaggaggtgttcagcgtaagacaatttaggcacacggagctacttctcattactgggaacaatgggaaacttcccaaaacctaaagtacagactccagccaaggatgaaccttgcaagatcaaagaatagcagtctctggcctgctctgttctctttttcacagtaacttaaatggaaaaatgctgagttagcttaagtttctgtaacaaacattaagcaaataaaattttctataacagaaataagccatagctttgagatgaaggcttatatacgtgtaaaccattgtaaccaagaaaaaaaaaaaaagtcagagtcacagtgaaaatacttaacaaactagccaggatttaattcagtgatgacagggaacagaggaagtcttgtgagaaaggatcttgcctctgcctagtatctttcacagataggcttcaagtggtttgatttgcagatacaccctttcttggcctttatttcggcaaagatgtgatgggtaggtaaatgccgtgttctttccctagcacgtatgtcagtttctcatccactctttgttcttgctattgaaagttgtagcttctggctacaacagagatagttgaagaatatggagttcgccataatttatcattaaatgtggataatttgagattaaagaatatgttgttgcaggcttagtcactttga

SEQ ID NO: 786 - DNA, 532 bp, Homo sapiens
gcagcgcagggccccgaggacggcctggcccggagaaaagataccgaagctccaactttccccaaccccgctcccctcctccttccaccctcccttcccgcccccaaagctcgggggtcctatccctcctccggtccgcggagtctcccgaaccctgcggggacccggcgctcggcggtgccctcctggggcgcacggggctggggcgggagcgaggagaccaggtggggaggggaccccagatctcagacgccaggggagacggcgtttcccgctgttcattcaggtttgtgccaaaaggagcctcacagatgcagtattgggtttggtagactcaaatcgtcttgttttaatgtaaatgaaatccttcgacccaggcacgagcgcccatcgcggaggccacgatgcccgttttattccctctccacggcaaggaaaagcagcgaaatctgaggtcttcagaggttaaccctatctaggagcagaatgtgacgcattgtaaacaaataaatattgaaaactcgatgttaaa

SEQ ID NO: 787 - DNA, 2178 bp, Homo sapiens
atattgttaaaatggccacagtgctcaaagtaatttatagattcaatgcaatccctattaaaattcaaattacattctttatagaaatagaaaagacaatcctaaaattcacatggactcacaaaaggcccgaagtagccaaagcaatcttgaacaagaagacaaaagctggaggcatcacacttcctaattttaaaaatatattacaaagctacagtaatcaaaacagtatgctactagcataaaaacagatatatagaccaatgggatggattagagagctcagaagtaaacccatgtatatatggtcaaccaactgggaaggtgccaaaagcacataataggaaaaagatagtttcttcaataaatggtgttgggaaaaactgaatatgcaaatgcagaaaaatgaaaaaataaaattacaccttcatctcacactatatgcaaaaatcaactcaaaatggaacacagacttgtatttaaaacctgcaaatataaagctactaaaagaaaacatgcatatgagcttcttgacattggtctgggcaataattttttgaatatgacatcaaaagcacaagtaaaaaaaagcaaaaataaagtggaattatatcaaactaaaaagcttctgcactagcaaaagaaacaatcatcagagtgaaacgcaacctatgaattgagataaagtatctacaaatcatatatctgataagaattaatatccaaaatgcataaggatgtcatacaactcaatacgaaaatgacaaataatctgattttttaatggtcaaaggatctgaatagacatatttccaaaaagacatacaaatgcaaaaaaaaccaggtttatgcaaagtgcctaatatcactaatcatcagggaaatgcaaatcaaaatcacagtgaaatattacctcgcacctgtcgagatggctgttatcaaaaagacaaaagataacaaatgttggcaagaatgtggagaaaagggaacccctgtaaactgtttgtgggaatgatagttggtacagtgactgtggaaaacagtgtggaagttcttcaaaaaattgaagatggaactaccttatgattcagtaatcccaactctgagaatacatttatctctccaaaggaaatgaaatcagattgtcaaagagatacctatatttctatgttcattgcagcgttatacacaatagccaatatatggacaaaatgtaaatgttgacaaatgaatggacaaagaaaacatgatgtgtgtgtgtatgtgtgtgtgttgtatgtgtgtgggtgcatgtgtatacaggcagagataggatattttttaaccttaaaaaaaatcctgtcatttgtacgaaaatggatgaacctagagcagattatgctcagtgaaataagccagatatagaaaggcaaatactgcattgttacatttatacattaaacctaaaatggtcgctgtcatagaagtagggagtagaatggtggttgccagaggctggcaaaaggggaaaattggtagatgttggttaaagggtacaaagtttcagaattgcagacaaataagttctgtagagctaatgtatagcatgctgacaacagataacaattctgtattgcatgcttgaaatctgccaagtgggtagatctggtgttctcattacacatgaaataaatagtaaaagaagaggaagaggaagaagaggaagaagaggaagaggaagaagaagaagaagaggaagaagaaggaagaggagaggaggaggaaggggggaggagggaggaggaggagaaggaaggagaaggaaacagaaaggaggaaatgacttggggcaggtgatggatgtgttaattagcatgattgtggtgattagctcacaatgtgtatgtatattaaaacatcaagttgaataccttaaatatatacaacatttatttgtcagttatacctcagtaaagtcaaaaagtcaataggctacaaaaattccagagtcattatttttaaaattaaatttacaatgttttatcaatcaatacatgaatacatcttaattttatgtcactgtaactagtactattctaggcagtaataaaaatagtattctagtactattctaggagtaacaaaaatataatagaaaacaaagaagatgaatgtaacacttgggaaatgagcagactt

SEQ ID NO: 788 - DNA, 594 bp, Homo sapiens
tttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcagccagcgtgggagaaccaaacatgagacacaagcatccccttgagctccacagatcttgcgccttgctctcatcaggcatttccttggaaaacagcagtcagcagctcatggaagtgagcccggtgcacagactttgcatggactttgcacaggttccatttccatcgtgtgcagacacctgtatctttgggctccacgtgagcacctgccctcttcactctgat

SEQ ID NO: 789 - DNA, 216 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgg

SEQ ID NO: 790 - DNA, 4302 bp, Homo sapiens
gaggccaggaccacgcctgactcaggcgatcggacgggcagggaggctgcaaggcatggcatgagcaggtggagctgtcaggactgccccagcccctggctcaaagatgcccgaccccaggaccctgcctcgctggatggtgaaggccaacttcccctctgttggagctggcctgggcgttgtgggaagggctgggaggaggcccaggacaatgcagaacagacaggacgtttcacagagcaggctgccatgtccctcggggccttgggggctgctgaggccctgagaaaggtcactggaggcctggccggaagtgcagggttatctcagtacttgatttaaggctcctgcagctgaaaagctgccccacacggcggaccgggtggaggaagtcagctgtgctgcttaaccgtggagtctccgtcccggtcctgctcaccagctctgcaaaggccttgtcctccctgcctgattctcggcaccatttttaacacgcctatggagaggccacgttgagtccagaggtccgtgcgcctcatggccacatcacggcacccgttcacccacacaagggccaggagcatcccctagggaggaggagatggcagatctgcacaggctctgcgctcctctctctccggagcgtcctctcctctgtgtggcaggctcggcgcgtgatggaggagccccttctgcagggctctgtttagagggtgcccgccccacagcctgtggctgctcctactcatgccagaacagaaatgggtgcccagctggtcaacatacatttgttaccttgctttaaaatgccttgagagtggaaccaccggtgcaggcttggctggtcaagaatcatgttctagaaattatttccagtgctgagcacagtccctgagatttaaaaacgcttatgggatgaatggaaaatagcagggcctcttaccggcctgcaacgcctttagaggcacggatgccacgtgcacagacccagctccgggaagcacaagcctggtggtgtgcgggaagcggcgaggtgcgcgggaagcggcgaggtgtgcgggaagcggcgaggaccggctttaaagtcacagcagtttcctgaaagatgagggggaggaggacagtgacgctcacagcacagccacttgtcaacttggacatgacacacacaaagcccagagctcggacggcaccgcgaggaggctgggattcacgtcaggcggcacttggtgggcagttacaagaaaggacggcagccaagccagtgcctcctgtgctccggctctggggccctggacacacctggggattcagttttgcatggaccagcattctccaagcgctctgatcagtcttacaggagaagtaggctgtgtggtctgggagccttgagaaggttccgctgtaatctgtcagacttttggacaggatttttctgccttacgtggctgatgtacgtctgcaggagggtagcacacggcaccctctcggcctgctgtgccacaaaacctttgcttttacaggtctcacggagccagtgggctgcccaatgccccagtgcagagtggagacgaggtcttcccctccttcccagcttgcctgggcggcgacgcgtctcagagacctctgccagggtcaatcctggcccatgctactagctcggggtgtgaagtcacagttgatgctgaacacctggctgggccagacttgtgcccaagaaaccttataccaccaactggttttcaaaagaaaaaaattaaaagtaattcaaaactttgagatataaatataattctttaaaaactgcagcgtggttcactggccctgtgatgggctgaatgcgcccccaagttcatgtggcagccttgacccccaggacctcagcgtgtggcgtcttggagacaggggctttacagaggcgatgaaggtaaaacaagctcttatggcgaccctgacccagcaggaccggtatccttatcagaaagggatatctggacacagagacagacgtgcacgtgtggagacacctgaagatgaagatggcatctaccaggcgggggagtggcctcaggagaaacgggctctgcccacgcctcgacctcggacttccagcctccagagccgtgtgaaaagaaacttccatcatttaagctgccctgtctgtgggactttgcctcggcagcctgagcagacagtacaggctccaaaaacgctctctgcatgtgtgattctggccaggaccaccctgcccgaagccacggctatgtcgaagctaattgtgcgatttctgccggccacgtggttttgatccaaaagcatttgaaagctgctctgaagatgcagaaaagctgagtcccggcatcgctgctccttccaagcgactgttcacacacagggtgtgagtgcgtccccccatccagggtccagcctggcctaaggctcactgggcaccatccagatctgtgactgggtccccccatccagggtccagcccacccgaggttcactgggcaccatccagaggccccagatgccgacacctggggacgggctgtatcaggcagatgtttcctcccgggctccacctggggacgggccccggatgctgacacctggggatgggctgtattaggcagatgttcctcccgggctctagttttccaggccgacaggaggaagtcctgttggggccaggggaggcattggggatgagattgagaggatggtggggtcgcaaaggtttacattgcctgtgccactttctccaaggtctggggccgccaccctgtggtgcctctggaagctgccatgtggggctggcccacggtgactggccacggcggggctgtgtgtggtatgcacctgtgagctgctgaaacgcagcctggcggccaggaaccagctgccccatcctctctgcaggaggtcaggtttgagcacgtattccctcaaacgctcatagacgtcagtatctcaggacaaagtgcttgtctgagacccaggtttgggccccaaggtggtaccatcgagggaggcatgttctggcaggtgacagcccctcctctgtgcctgaacctgcagtttctgcccccgcataaaatgccgccatctcaggccctccctgacccccaacctgcacaagggctcacagctggcaggcacctgtgtggggtcgtggtaggacctgtgtctctgaggtccagcccaaggctgtgccacataggcccaaatccaagcactcccctcctgggcacgtggctgtgtgtgcatgtgtggctgggtgggcaggggggttgactctggccaccgaaatggagaggagcggtgcactccctgggtctggcccacgcaggctccttcccaagtgctgctgccgggaaatggaggtccctaggtgagacgggagccgggcactgtgggggtggcccctgaggggctgcaggttggcactgcccagctgacgcattccgcagtcctgcaccaggggatgaacgaggaatcggcttctgctctgctgaacatcccactggttcatgtccacttgtttgggtgatcctaactgatctgctacctgagtttgaatctcagcgctattattagtcaggggtcctggaggtgggtgaccccacctcacctaaaccacagagatgctcatcctcatgcatgcacacgtccatctcagcttcagctcgcaagcaggaccctcaccgtggggccacgacggaccctgcaaagctggtctgactgtgccgagcctgtcgggggttgggggaaggaaggcgggagctcggcatctggagggcagtggagaccctcagcgagtgccaggaggatctgctgtcttcccagtgttgtcttcacagtggagagatgagttcacacagccttatctgtgtttccagtggcctctgtgtgcaagacgggccacgggttttgtgcggtatttgcctgtgggtcacagccaggtgaatgggccctcctggggctgcagccccaggtcctgatgttacttgtgccagcctggccacagtgcccggcctccagaagctgctgtcagaggagcagacgggagggcagggtggacggttaacagggtcaaggccccagagccccacaccctccccagcagccagcacaccctctgttctgtgacctcgcccctgcattgcggcaactgacagatgctccccggcctccttccccgctgccgcgcaacctctgacagccacgtgtactctcctgctttagaacaaggacctttcccttttgtgcatgaatacgctctcagcagatgcgagaaaa

SEQ ID NO: 791 - DNA, 719 bp, Homo sapiens
ccccttgaggttatgagcgcccatagggaagatgttgccactgtacgcagttgggagaagaaggacctggcacatgaggaagccaagtagttggatcagccctctccatcatggcgtttcccacacctctgattggactggaaactccctgaaaggaggaagcaagtcagattcacctctaggtccctcccaggcctggagaggctggcatgctgttggcactcactgactgcctggtggccgactggctggatggaatggtgacctgtgaccagtctgtctctctcctcagctgatctgagagttcctggaggccagggactgtgtttgcctcacctcggcacctctgtgcctggggcagaggaactgctcaacaagttctggttgaacaaatggagggaacactaagagcgaataattattaagcgcttactgtgtgcgagcagctgctgtaagcaatggacactttatctcagtgaaccctgcagagggttccaatgagggaatggagcagacctgatctaaccaagctaggggtggggaggtgcccggtggtaggtgccagcagacatgacaggcactcccgcacatggcaccacagcaatgctgtcaaggttgcccgtggaatctgaaagctgaaacactcatctttatatacagagttggccaaagcaagacaccagcaaatcagtttacccaaaaatgtgcaaacaagattt

SEQ ID NO: 792 - DNA, 1536 bp, Homo sapiens
agttctctcgcgacctctagccacttccggttgctaacggttcccaaacagcccccgaaaacgctacgtgagctgggccctgggccagaggcagaaaacggacggaagaaaaggtctggccggagatgggtctcactctgtcacccagactggagtgcagtgagtggtgcgatcatagcttactgcagcctgaaactcctgggctcaagtgatcttctcgcctcagcctcctgagtagctggagctacaggtgtgagctacccagcatggctcatttgagatttctgagtagagaagtaacatgattaaacttgggtattgagattattattttggctgctatgttaacagtagacttgaatgtgaaggggttgggcaagggcagaagcagggagacaggttggaaagttggagtgggaagggcctttttaagaataacacaaacccctaaagacataaaactgaaaaggccatggaggaaaagataaatgaaactggccttgtaaaattgaaatatttgaatgaaaaaagtaaaaataaaatataaactaaaagtaaaatatgccacacatctaaaagacacagctgattttcctgatatacaaagaccttttatcttaccaaaaaataaaaatatgaacaagccaatagaaaaatagacaaagtacttaacctgcatgcatttattgtcaggcctctgacaatatgatactaagccatcatagcccctgtgaccgccacgtatacatccagatgacctggagcaactgaagaaccacaaaagatggcattccaccattgagatttgttcctgccccaccccaactaatcaatcgaccttgtgacattccccctgcccccgacagtgagtctcatgatctccccacccagcaccttggcaccttgtgacccccgcccctgcccacaagagataaccacctttaactgtaattttccactacctacccaaatcctataaaactgccccacccctatctccctttgctgactctctttttggactcagcccacttgcacccaagtgaaataaacagccttgttgctcacacaaagcctgttggtggactctcttcacacagactcacttgacatttatagaacacaaaattaagaatagtgaatatgaaaaggttcactaataagaatttaaacaaaacaagaaagatttttaagattgctaaagacaaacgatttataatattcagtgttaggaggtgtgtggatatacaggcatacttagttttacatttttagaaggtaagacttatttagaaggtaagaagttgtccataccccttgattcaacaacttagcttcttggaattatccatatagaaatgcttacataaatgtttgaacgtatgtacaaagaagcactatttatttaaattgggaaacttgaatgcctaacatttggaatttaaatttttatatgtctattcattaaaataccacccagtttttagaaactaagagatgctaaaggtatattgagtaaaataaaaagttacaaaa

SEQ ID NO: 793 - DNA, 475 bp, Homo sapiens
attgtctgaagcggcactggagacccaggaaaaatctcgctgaatccgcctgccccagcagcggcctgatctgggttccgctgattcctttcgtaaccgcaccacacccgaggagctctgatttgaggtgacaatgattttgaaccttaaattctttggaaagactcagaatgaagtccattgtggaggctcagaaaaacaatttcctgggaaatgaagcagtatttttatagagagaactgtatacatgtgaaagcttattcatcgttggtcaggcaagagaccctccaatgactaaataaacctgaatttaagtcagaggaaagaaattacacagatctctatttactgggtggccttcaaatatatcatgtcctcataaacaagatcaagggagggaacactatcccagaagaggttctgtctgtaatcttctcagtttgaaaaatactaaataaagaggtattccactgtt

SEQ ID NO: 794 - DNA, 727 bp, Homo sapiens
ttgtattgcaacttgctttcttttcagttaaagacacagtgtatcttggatagttgagtgatttgccatgcatgcaagaagagtcttttatttgtaacaaagtcttgcagaaatagacacaaacgacggagcttgcagagaaaaatgtaaaaaatcctttccttcccttatcagaggaaccctgagaaaccagtatttgaggctgacgatgacagcagcccccaccgattacgagctaactgtgaccagcactgccatgcatgtatcccatcactcagtcctcatatgccgctaggagactggatggccatttcacgagcaagtaaatggaggcgcagccacgtcacgtaactgcccacacagctagtaggtgcacagctgaaattcaagccttggcagtggtacccagagtcccagcttggaacatcactgtgatacaaatggggctttctgtggttatggctcagggtaggaatcagatgcggtttagcttagggaaagacaactcttagctctgtcactgcctgagccgatgacagcacccattctctagggactgggcatgtgcctggtacattgctgcattgtcagaggaagtgtgtatgtgtgcagggggtgggggtgaaggggcagggggtcatagggaagacacaggtgttagggtcacaaagacctcagtttgagtcttaaccctaatgtaccagctgtgtgactctgggcaactttt

SEQ ID NO: 795 - DNA, 227 bp, Homo sapiens
caccaccaatttggatctgagatcagacataaccttgccataagcagcaaagggcttggtgaaccctcaaaaaggctgtcaaacacccagaggccttggggatcaggaaggagctatcatgtggtctttcataaaaaactggttcacccataccaagcctacacatttcagcccatgaggatggagaaaaagaagaaattgatgacagattctatcatcacaaaagg

SEQ ID NO: 796 - DNA, 1641 bp, Homo sapiens
attgcccacagccggatccacggtgactaatctccgggaaggcgtccagcgtgagccgtgaggcctgcacctgcgccggacttcaccactcaccaggagtctctgcccgccgcccccagcgcggttctcttccctgctagacgtaaagtcctggggacaagcacagcccagggcactttctggagagaagatttcgatggggaaagataagagagcatttggatatctacgcactgtcaacagaaatgaggcttcaggccaaggcttctaaaatgcaggattcccaaagtggcagtcacataagacgggtccctccatcgccttctagaatattgagaagatcatcacgcctgggactggctcacagcactgatctttttcttgttagcagagactccaggaagcagatgagcagacctatgggcctgctatgtgcaccgcggcccacactgccgcctgcctgggatcctgcatcacccgagtcttcctgcggaccaccctgggtggtgcacatgcggtcatcattgtgcaaaggaagctttagttctataatgaaagcccctttagtaagtgatgctccttgaagactcggtcagcgtctcgttcacctctttatccccagacttagcacaattccagccccaaatcggcaacggacctttgaccaagtgacatgtcagtgcttcagggagcttcactgatcaggacagaagtgagtgactggaggaaggtgacccggatgtctgtaacccccagaaagggtgagatggctgttttatcagccagcattgccgagttggtggtgtgacgacatcctgtctgactgctgggccttaccggtgtgttctctgctggagccgtgacagtttgagttgaggacattttacatcaatcactgaactgcacgaaagatggaaatccagcaagggaccccgtcggacctgattgaccgcagagctaccttttgctctttctggatgccacacggcctcctcctcccacctgtccttggagcttgtgttggtccactttcatgctgctgataaagccatacctgagactgggtaatttataaagaaaaagaggttgaatggactcacagttccacgtggctggggaggcctcacaatcacggcggaagttgaaaggcacgtcttacatggcggcaggcaagagagaatgagagccaagcaaagggggtttccccttatagaaccatcagatcagctgggcgcagtggctcactcctgtaatcccagcactttgggatgctgaggtgggaggatcacaaggtcaggagtttgagaccagcctgaccaatatggtgaaaccccatctctactaaaaatacaaaaattatctgggcatggtggtgggcacctgtagtcccagctactcgggaggctgaggcaggagaatcgcttgaacctgggaggcggaggttgcagtgagctgagattgtgccactgcactctagcctgggcaacaaagcgagacgctgtctcaaaaaaacaaaaacaaaaacaaaaaaaaccatcagatctcatgagacttattcactaccatgagaacagtatgggggaaaccaccctcatgattcaattatctcttgctgggtccctccctcaacacatgggaatt

SEQ ID NO: 797 - DNA, 408 bp, Homo sapiens
gcaaatgtcagcgccagcccagtcaaaagagcttgaaacctaccaagccggaggactgtgctgtgcctctctcgcccacattttccccaagcactctcaggaacctggcaacagactgagagaaaggaatgaaaggatggaagaattacaagatcaggcactgctgtctgtctgttccacggatgtaaccacagcacacgcgtggctcacgatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagca

SEQ ID NO: 798 - DNA, 464 bp, Homo sapiens
ctccccaggcaccaccctcaccccgcagctcccccccatacacaccctcgctggaaagttcgccctgcccgggctgggctcccaggcagcctggcaccgtgccaggctcgccgccgagctcgggcagcagggtggggcaaacgcggagcacggaggacggggccgggcgacctgggcaccagcaggacccgaggccaggagccaggggcccagaagattgagcttctagagcctcagagatggaattcgccgttttgccgcgatttggcgttaacttattgacccatggggaggagggtcacttcccgtgaaaagaaggcagagatgttttgctgtgcccagtgtgaggaagcgaaggaaaagaaagatcttttgaaaatgtgtacatctacttgcagcttgaaaattccaagtgccagacatttttcttggaggaaataaatgtcttcaatttattcatctta

SEQ ID NO: 799 - DNA, 289 bp, Homo sapiens
ggatatgagggcgatctggctgcgacacctgtcatcccattgatcgccagggttgattcggctgatctggctggctaggcgggtgtccccttccttcctcactgcttcatgtgcgtccctcccgaagctgcagctcagtcgaagagaacgaccatacccaatagaagagctgggcttccctggtagaacctccaaacaagctctcaaggtccatttgtaggagaaggtagggtagtcaagattccagacacatccaaatgaggcgctgcatgtggcaatctgcctttct

SEQ ID NO: 800 - DNA, 514 bp, Homo sapiens
aatgcaagtgtttaacagatgcttcactattaaaatattttccccccaagtctcaaatattgaagaatctctaaccaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattccccgaatctgtagtgtggctggtatcggtgttcccctggtttaactagcctgtttgcgggcatctgtggaaagcaggtttagttatcggaggggaaccattaaacgccagtttaagaggcaggccgggaggacggctcgtggatgttgagactgctggccttggtgatcttgaacgcattataacggaaaatggatctccacttgtaagtcac

SEQ ID NO: 801 - DNA, 556 bp, Homo sapiens
gtcttcattcatccttcacatttactgagcacctactatgtgcaaggcactgttccagttgctgggcatgcagcagggaactaaagtggcaaaaattcccaccttcaaggagctagcctttttgatgggctagcaatccaaagcgaactttggattttgcttgtgtatttattagagacaaggtctcgctctatcccaggctggagtgcagtggcacaatcagctcaccgtggcctcaatctcccagctacttgggaggctgaggcaggagaatcacttgaacccaggaggcaaaagttgcagtgagctgagatcatgccattgcattgaagcctgggcaacacacagagactctgtctcaaaaaaacaaaaaaaagaatgcgttggagaagtagaaggctgccataatcatatataagggtgtatgtgtgtgtgtgtatgtgtgtatatatatgttgtatgtgtatataattatatgcacatataattacatgtaatatatgatataacattttcattgaggtataaaatatatacaataaaatgcataaattgc

SEQ ID NO: 802 - DNA, 662 bp, Homo sapiens
gcctcccggcggcctctgcaggcccaaatcgtcctgaagtcggcctctccaggtccagctccagcctcccggcagcctctgcaggcctaagttgtcctcaagtcggcctggaagtgggcctggaagagctgcaagttggcctccctgggcccagctccgtcctcttggcctctccaggtgcaaaacttcctcgagtcagcctctccaggcccagctcctcctgcctcccagtggcctcttttggcccagcccagctcatggctctcagcagccttcccaggccccgcttttgacttttggtggcctcttcaggcccagaacttgacctccagtcggcctttgcaggcccggcttcctgcctctcgaaggcctgcacgggcccagcctcagcctcacagcggactctccacgcccagctagctctcgcctcactgcggcctccccagtcgaaagctcctgcctttcggccgctttggcaggcccagctcctgcctgccagtggcctctttaggcccagctcattcctcacaacggcctttccaggccccgtttttcccttccggcagccttttggcctctaatttgtttatcttttgtgtataaatcccaaaatatggaattttggaatattgctaccattatataaatattttcgtatgtaa

SEQ ID NO: 803 - DNA, 560 bp, Homo sapiens
ctttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgaggtacctaaatttaattaatgttagttatgtgatgtattcttgacagataggtttaatagctggcacaatgatgacttaaattactttttgccgtttacccagctgaggttgtctttgaagaaataattttaagactgagatgccagtactgtacattgattaattactgacatgtatgtaaggcaataatttaattaagggtgaatattctttgtttttagcatataggttgctgtagatgaatgttcttagctgtcatgtttaaaaatacttctgcttcgttacctcaagtaagtgatttgtcaagcaactatgtctgctgacagttcagaaagtatctgat

SEQ ID NO: 804 - DNA, 571 bp, Homo sapiens
agacatctgggctgctagctgcatgaaggagctacccgctgtgggtctcctctttgctgacagctggacacttgacagaatgacctgcctgaactcgggacctgcagaatgatgggactgaagaagctgtaacacaaacagggctaaaacacgcactctcctccccctgctccccaccgccccacccacttgccacattggaggtgatgagaaggagagaagagctgtggcctttcagggagcatagtcccaggggctccctgagccagggctgtgaaaccctcttccgggcactgcagttcctggcatctccaaacttctgagtgccaccgcattccccgcgtccggatgcaggtcaatgcacagaaagaaatctctctcctgactttagtacaatggcacgattggtggccacagtccaaggatggttgctggtgagtagttacagataccccgagacacagcaggagtgagtaattgggtttatgatgggcagcgactctggtgttcactgcaagctagcactggtgttttctggatgacctttgttagctgtgcgaagaggtttcct

SEQ ID NO: 805 - DNA, 552 bp, Homo sapiens
gagacagcaagaccaacaaccccttctcttcctcttcagcctactcagtgtgaagatgattgctgccctcagctgtgcctggagcacagggcacctccagttcggcctctccagaagtaaacttgtcttctgcctatcttgtgtttgttgggaggaggtgacctgggactctactactattgatgaagaatccgaaaaagtcttctattagccctgtgccacaccctacctatgagaaatcagtgtttactgcagagaacacagaagccagcaagcagcagggaagggaggcgaaccaatgcagcagcccaccgggaccgaggaggacacacgcagagcaagtcacaggaagcgcagctgaaaacaaatggacgcttatcccaaatgcacaggacacttaccaagaactgatggtccgtcaaagtaaagctcaacagctttggctggcaggacagtcaaacttttggacgacagaaagtaacagtgggaaatgggacaacatctgccagcaacgcgagaggccaagaccatggctgctacaggaggggtcag

SEQ ID NO: 806 - DNA, 3352 bp, Homo sapiens
agatgtagatggaaccaaagtccagaagttacgcgtcacccttgctctacagccaaacatgcaggactctagtaacccgcgaaatgatgggatagcgttgcaaatccttaaaagagtcttaacgaaatcctggctgacattgacttctccactgcaaccatcgagttcattgtctcctaaaccttgccatggaggcctgtggcacctgagccagccattatcatcaccagcacttccatgagctacaagctggacccactgcagtcctcctgacacactgaaatcagagcctgcacacagagcagcagatgcttcaatgtaaaggtcatttccaggtccttgacaggcgtgcatctgggccagatccatggcaataaccttcaggttgaggctagagggcttcagatgggcagcttcgaatgacaggagcaaggcacaagaggccggaaagggagggtgacattttcagcatctataagatcaactttagaaacatttgggggttgacaaattcccatcaagctctgtggatcttgtacaactgctcaccaccggcttctcatcagcacatgattggtgcagggttctgaggatgattttgagatgttccctgatgtggtcttgtgaggagatttcatgacagatggcaggaagcttcgtggagagatttctgaagacactcctgagctcccaacaccgggcaactctcttccagaggatagtggggtggagggtagaagagaggcaaagtcaggagaagggaaaatgttacattgtcaaagtcccaaagcctttcagcctgaagccaggaacaattgttcaaagtttctttggaacatcaaggaaggaaatccagattttactttaagtgcaatggggagtcattaaggattttgtgtagatacagcaaaaagacaacaatcttcaagccacaatggccctcaccagaacccagccatgtggtcagcctgatctcggacttcacagccagcagaactgtttgtcaaagatcagatggtttccttaagctgataagcaacttcaacaaagtctcaggatacaaaatcaatgtgcaaaaatcataagcattcttatacaccaataacagacaaacagccaaatcatgagtgaacttccattcataattgcacaaagagaatcaaatacctaggaatccagcttacaagggatgtgaaggacctcttcaaggagaactacaaaccactgctcaatgaaataaaaggggacacaaacaaatggaagaacattccatgctcatggttaggaagaatcaatatcgtgaaaatggccatactgcccaagataatttatagattcaatgccatccccatcaagctaccaatgactttcttcacagaattggaagaaactacgttaaagttcatatggaaccagaaaagagcctgcactgccaagacaaccctaagcaaaaagaacaaagctggaggcatcatgccacctgacttcaaactatactacaaggctacagtaaccaaagcagcatggtactggtaccaaaacagagatatagaccaacggaacagaacagaggcctcagaaataacaccacgcatctacagtctatggtattttactatggaagcccaccctaagatttcaatttagcttccatgtagttccctggtgcttggcaatctcctgactcactaccttgtcacatggtctatcccaagtcagtccttctcctcttcccatatccccctactccaatattcacccatatgtggccaagtcttcctccacctgagctccttgcagaggaatgaacaattgtttgaacattaatgaatattaaagttatctgatcatttcaaattgggaccacttaggaactttttctgtgttgtttctttaactttcatgtccagtgattgagttcttctccagagctgttgagacctaaataaatccagcctatcatctttcttctcatgctgcttttgttatacacagacagcatgagtgtcacatgagaaagctgaaatagggtcactttgaaaacaaaagtttccttgtatactggatttggccgccctctgcggatggatatcttgcatttggacatctcttgatccgtggatttccgtagagttaacttaacatatgtattgggtggtctgtttgctgcccaattttttaagtggctgccttttatcacttctgctgatagtctcccatttgtggcattataaagcaggctaatgagaatttctggaactgacccgtcttcgagagactgacatgcggatgtactttcactacaagacatttctgacacgctcatttgggagtcacagacacattttatcttgtgaattgttccttgtactgtattctgaaccaagatctggaagccctccaacattttcaaaacagaactgcttattaatatagagaaaaagaagcagcatcaggataataaacacccaaacagctgacaaaaacccaactgcctctggagatacttttctaaaacaggaaagcttcctgctgactcaaaaggatttttcttcttctgaactcctattatgggaatggatgaaatcacttacagagccacagaaggaaacaaagcaaagccaggatcatgagttggattatctggaggcctaggccaatggggagttattgcttgcagtcactgatcaagcaaataaacttttccttctttcttatgaaatttatttaagaagctgaaattacttaaatgataatgagttgtgagaaaagaattgtagtagatatttgttctctatccaaattgcactgagtggggaggtgtacccataccccagcttcgagaattgactgataacagttcacacctgcacttctccagagaattgtccttgtctgacctgagcaccttgtttagtaatgtctggtaggctatgctccaccttccctgggcagatccactggtctaagacaaacaacccaaccctctaatttctgggaagaatcacctccgtgattaatctaagctccagatctcccagagaaatcatgctgaggctacatttgtgaaactacatttttatctagcttcttcctttgccctttcctgctgtcctcacttccttatgaatttttttctgaaagatcttgattaataaattatttaatcaagatcccccagtcataagttctgtgttttggaatataacctatacaaaaataaattaattggtactagataatgctccgctatgcatctatttcaatgtctattctttggaagttctgtcatcacacatccccaagttttagataaggtttttagctaacagccaggaaaagattcaataaa

SEQ ID NO: 807 - DNA, 925 bp, Homo sapiens
atttttaaggagggaaaacagaataacttattttgcaatataatttaacaatttagtatattcagagatagagtccatatatccttgatataaaatctaaacccagtttcttgtatcacactaacatggccataccataccttccatgcttatttctctgtcatttagtgtgcataacaacaacgattcaagcttttcgtgaagaaaaatcctcagtaggatgctggccagtagtgttcggtcttgtccacatacatgtgataaagcatagactacatgaagttccttttgcagtataagctaaaatgacattttaaaagattgtttaaagtacgtagcattataagcatgctccatgagactaacaagaaatatgttctttcacaagttcttatatttaaaatgatgtcccattgaataaatttatttaaaatagaatgaattcgtagtctacttatttctaccaaaattacagtataaaacaaggtttaaaatctctggcatcattgtgctactaagctatgaattactatgtttaccttaatggatcttttattaaatgttaaatgtttctgttaattccaacaaaaacaagactgataaataatttaatacctctttaaattcactgtactcttcttctggcatgattttttccatagagtatcgtgctcgaacacgcagggaccctggttcaataccttttaatggtatatgggagctgagcagaaaccattcatctgtggcatgccctttctgtaatcggctcaactggcagcgcataaatacttgggaagaaaaacaagcaattattgtttaaaaagagaacacgataattagtcatgcaagtaaattttcctggtgttcagtcttccctatggtgttaaatgcttttcattaaaggagttttcagtaacatcacaaa

SEQ ID NO: 808 - DNA, 600 bp, Homo sapiens
ggcagaaattgggcataagacaatatgagaggtggtctcctcccttactttgaccaacatctccccaacccatacccctaagcccctggtaactaccattctgtctctccttctatgaatccaactttttaaattatacatacaagggagatcatctggtatttgttttcccatacctggcttatttcacttaacatattgtcctccacatccatccatgatgttgcaaatgacaatgtttccttttaaaacatacaccacttttgaatgtgttttattcagtctacaaagtcacctatgagacattcagtggggtcacagaaggaaagtgctttgcaagccaggcgaggtgcctcatatttttaatcccagcactttgggaagccgaggtgggtggatcacctgaggttgggagttcaagagcagcctggccaacatggtgaaactccatctctactaaaaatacaaatattagctgggcatggtggtgcacacctgtaatcccagctacttgggaggctgagtagctgggattacaggcgcacgcccccacgcctgactaattttttttttttttgtatttttagtagagacagggtt

SEQ ID NO: 809 - DNA, 379 bp, Homo sapiens
ctcaggcttccggtctgtttggtgccctggtcgcgtgtcttccgaactctgctgcttcgccccggcaagagcacttccttccgcggctgctaaaactggtgcgcgggttcccaacttcgcagaagagcttcatcggccccccgctagagacctcagaccgcagccatcgacgcctcgcctcggggatctgtccccaccctcggggccagctcaccatgagtcaggccctgtgctaggtgctgggatgaagcagtgactgacacaggcctggacctgtccttgggaagagtgcgtctgtgacacagatactgtgccatgtggcaaagtaagcgcgtgggacagcagagccttgtttgccattaaagtaatatcacaagtc

SEQ ID NO: 810 - DNA, 2168 bp, Homo sapiens
acaagaactggcagcagcagcagcagcagcagcagcagcagcagcagcagcaactggatttgctttttcaccagaggatccagatttccctgtggcctcgcaaacaaaaaagaaggaagacggagcagcacagtcatccctttgtgaaaaaggcattcagagacggggtttcaccgtgttagccaggatggtctcgatctcctgacctcgcgatccgcccgcctcggcctcccaaagtgctgggattacaggcgtgagccaccgcgcccggcctcagcaggtttttcaaaagtcatggcgtgtaattgtccgaacagtgaacttcggagatccaccggaggggcgaggccacagctcgaccgcgagcacctgagcatcctgcaccgcctgcgacggccgtcagggggcgcgatgccgcctcacagaacctcaagcggcgcccgggttccggcacagacggcctgcggctccagggggcggagccgagccgtctcctcaggacctacgcaggaggcgccgtcatccctacagggacacctgagagggcccagcctcctcctcctcaggacccactcgggagacgccgctggctctctaggaacacctggggaccgtggccagggacgacccagcctccttctcctcagctcctcaggaacgactggggaagctgtggcttcatggtccccgaggctgcccgaggaaaggtatttcaggacagccaggagggggcgcacatccgccgagaaactgtgagcaagagcgtctgtgctgaaccatggcgccaccagagggcgcgcgatcccgccccaaccaacttcccgctgaggtgccagaagcagcgaggagcttcagcttcctcagggcagcacgagggtcgtgttaacttggtgttcttcattgatgatgattattccccaccttctaagagacaaagaccaacgagccaccacagccaccagtcccagaacccgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatccgtttcctggccgtagaggtggcctgcactcctcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaatttttttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccacaccaggctaatttttgtatttttagtggagatgcggtttcaccatgttggctgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagagccacctaagctgaagattcccttgagaacaagtactgtccctagtttcccagtgctggaatatagaaaatggatggacaactggacctaccatgaaagacttctgaatccaggaagagaaactgactgggcaacatgttattcaggtaca

SEQ ID NO: 811 - DNA, 516 bp, Homo sapiens
agaaaatgggccccggctcccgcaggaggcccgcctggcgcgcagatgtcgttattagaatccgggacgtcggtggaccctctgggtctggctccctcggggcttacgatgaaaaaaactggggggcgcgtgtgtgtgtcatgagacttccatttctgaaggggtcctgttccatatcctcaagaagggagtgctgcacagagaggccatgaggaatctaagcagacaggccttgctgggtttccccactcagtctgttaatattagatcatacctttttgtccagtcacatttttacatggttgtcaattatgcctgtccagtaaagtctccataaaaggcccaagaagacagagttggagttcctggatagctgaacatgtggaggttcctggagggtggggcacctgggcataaaagctctgagccccttccctcataccttgctctgtgcatccctccatctgtatcctttgtaacattccttataataaattggtaaatgtgtttcccaga

SEQ ID NO: 812 - DNA, 537 bp, Homo sapiens
gtgtgttctctgagcacctcgtgaccttgctgggagtgtgtctgatcagccgcttcccttgtgaccaaatatttggtcatggcagcaggagagaattccatcagtggacagctctatttttaaggctctggctttgttttctctttcctgagaggcagtccctgcagcaggcttgagcctctctcactgacagcctgcctcgcataatgttaagcaggcatcggacacttgctggaaggcagggaattgcaatgaaagagcacggaggtgagaagctgtgctccttggggtgaaggcagcttctgtgctcctgggatctactgttaagccagggtgacgccagcttgcatgctaccggaggggaagagaaaatttggacacacagggagaaaaccacagggaggagatggccatctacaattccagaaaagcagcctcagaagaaaccaatctgcaaacatctttatctgcaactccctgcctcccaaatggagtaaagagacagaaagggaatgaatttccaagaagaccagcgta

SEQ ID NO: 813 - DNA, 483 bp, Homo sapiens
tctgagccagttccagcccggcccagatgttggcccctgacaactagctgtggctggtgcggagggaggagcgagggaagaggggcagatcgaggctgccagaaacatatgaagctcatttctgccacccttcctagaaaactggttcctgacagagacatgtggaaaggtatctgcacaagaaaaagtgaaaacatatgtccaagcaaggattgtttacaaatgtgcatagcagttttgttaataatagccccaaactggaaacaatccaaatattcatcaacagacggatacagtgtagtatagtgaaacaatggactagcattcaactaaaaggagcaagctactaatacatgtagcaatgtgcataaatcgcaaaaactatgttgtgtacaaggcaaacacaaatgagtacatactatatgatcccatgtatataaaattctggaaaatgcaaactaatataaagtgacacaacctaaa

SEQ ID NO: 814 - DNA, 461 bp, Homo sapiens
aaaatacagagcggtgaagagcttacagtcggaccgcgctgcacgccggcggcagccatggcggatgtgtcagagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtccccctcatggccaccttgccatgtccgcgccggagccccggtccgccggcgcccagaaccaggcttgccacacagtccccgcctgccatggccggctcttcctggagtgttgcttgttgaagatgcatatagactaccggaaagaaatgacttcttcttgcactttatgaatcaattttatttttaaaataaaaaaattaaacat

SEQ ID NO: 815 - DNA, 821 bp, Homo sapiens
ggagtggagaacacaatttaatgcataacagctcttttcatctctcagcaaactaggtctcaggtctgaagtccactgcggtcagccttccctggtggtgagctgctgtcagaacctccccactactcctctgggtggccccagtcttgtgcctatttccctctcgtggtcatcaagtctcgcccagatggagtctcagttttataagggggagtttccctgcacaagctctctctctttgtctgctgccattcatgtaaaatgtgacttgctcctccttgccttccgtcatgattgtgatgcctcccagccatgtggaaatagaattccaaaattgtacgagcttcaggccccacaaaacctggatccaccctcagatttcatttatctcgcttcgtggtgacaaatgaacctgctgttcttgtcactccccgggtccgactgtactcccaaatctgtcaagcgaaaagtttcagaaatgttcgttatgactccttggatattcttaactaatagggcctctgtgagatctgtactactaagaagtttcacaagtaattctaatattcagcctgggttgaaaaccgccatccaccatccacggatgctgtgcttagggcccgtgcttctcagatggtgggccatcactcattctgagttgtgaaatcatcttaacaggtcccaattagcattgttttaatagaatggaatatgttaccttgcatcataaggttggtgtgttcgtcccacttttgtttcaatatctacaatatatataacttatacattgccttgggtagcgcaattctgaatcctgtggt

SEQ ID NO: 816 - DNA, 2485 bp, Homo sapiens
ctggagtggagccctaggactgaaattttccaaattgctcctggcaattcttatgtgcagccaagattgagaagattgaggggactaaaatagaactcaccatttctgtggcttccaggacacttcccagagacttcataagtatttctgttcctagcctcagactctttaaggttgagaataggagacctcacaatcatactgctgacttaggctttcttacctgtctgtaagagccttatgagcggacacacacagtctatatatagatacacactttttacattatactagaagatgatgcctgtgatgtttatggtcacttactatgtttaaaaaatgcatgactggcctatggtgactcattatttcttcccagatgcttgaaccatgatgccagtgagtggaaatgactctattgggtgggatgggcccagcaggtcagacttacttaggcactggcactgagaaaagcaatactgactgggtgtcgtgtacgtgtgactgcccatagcaataaccctctggtactgtgtctgtttatgtaaaaacttcttgtttggtagttttgactcgtatttgtagagctaggtactggttattattgtgcttcatcctatcccagatttcccagtacattcctttagaagacatgtccatctccaactgctgggggctggccttttctgtaggccaaggtgctgccccattagccccacctggttgtcatcactcacccatgtgttgtgtccatctctgacccatttcccctgccaccttgcctaaagcttctcctgtcagcctccccaccaccatgaagtgctaagagtactatgtcctgaggtaagggcacctgcaacggagattgtgaagagaagactgtgggtttctgtggttacaagcacaactctgggtcaaaaacccattccaagtcctcagaggggcaagtcccttccattcagtattaatatagctcatcagtgcctctgatgaaattgcccaggatgctggcagtgtggcctgggaggcttccagctcttggggtctggttacacatttattcacactgcggccatgtgttgaggacctactatgtgctgtgtttgaccacacgtcctgtagaatgccgtttggttctgagtatgcctggctggaatggaaaccaggaaattctagagtaacaggctctagtcctttccaaccaaaacaaacctcatgggaatgtttgagggaccagttaatgttgagacagagagagtatggtctagaatggtggttttcagattgtgttttgagaagccagaggtcatctttaggcctctgaagagtggtaaggggaggagaagctctcaactcccacacccacctcactccaagcagctcaagttccatctgatttatacattagcattctaagtaaaattttatttggaggcagtaaaaaggtctaggagaaataaaaacaatttgttatggagtgtattccagggcctgtttttagttgttgactctgggcataagacacttaattagatctaacctgatggttaatacagcattaacctgagcaccaatgctaaaacattggttttgtatgctgttgagtgaccaacatcctggtttgcctgggatgatcgtggtttagacctgttgtcccaggataattattcaagtgtcaccttaattctcaaaagtattccagtttgggtgagaaattacatggacactttatgcaagagcacagagttaagggaagggttggccagccttgcctaatgagctgatgaaccagaaggcaagccttgaaggagagtccatgtgggccatctcagagaactaagggatgaagccttccaagattaccagcattccaaaaccagaatatcatattgtgagactctgaaaataggtcactaccaaatgctttccagccttttgaccactgtcactttgaacaaatcaatggaccagcaaagtggcatatttttcttttattctttttattctttcctatgattactcctcatgttacctttcaattcctctttctgtctctctttttaaaaatttgactccccaccggccatgagactaaggctgacctttcataaacccacaagagtaactggtatatttgtatatgagtagttgcatgagaaagctcaatgtgcatactgtatttattaagccctgaacgcatttaataaaatattaacatggtgttttgaattatgatctttgtctgctttgctggaacaaaatataacagagctaacgtttgaaatccttcgcatatttggacaacattacaccaaatgttgattttgtacagaactctggcttgctatttaaaaactaaaactctaagtatatagcagcccaagttgtgaatattgctttctgcttcactgaaaaagcagtttacctgaaaagagcatgtaacctatattttgttaatttaagcaaataaagacatgttgaaaaa

SEQ ID NO: 817 - DNA, 1630 bp, Homo sapiens
gccaaagcggcctcgaagcgggtcccgtgtctgcggcgggcggcccccggcgcggagggcagggcgcggggagcccgggctcccggtgtcggcggatggcgggagcccgggggccgcgggctcgcggggcagcgggcgagagacgagacgccgagaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggaaggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaa

SEQ ID NO: 818 - DNA, 2900 bp, Homo sapiens
gttctgcccagtggcctggcgcaggaaaggtgacccagtagttcagcctgtcccagctgcctgccccagcaccatcccagacccctttccctggggcccaccttggccctgaggaaggccagagctcggctgctgttctccaggaagtgcacacgcaggcggccccggctcgggggtggcagggcctcccctgagatgagctccagcagccgcaggaggtggatgccgtcagccagctctgtgtacaggttccggatcttgatgcccgcctggggaggggacaggggtaagtatggggtcagcccagcctcacctgtcctcccatcctgggacctgagaggtacgacccagagcagctgctttggaagaaggagctctggcctcagcttggcctcaggcagatgaccccacagctcaccccggaggcccactggccagagctgggggcctggtatgggtgggctgtgggtcacagctggctatactcacctggccgcactggaagacgttattgatccacttggtgaaagtcttctcctgcatctgcatgtgccgggcctgtagcttgcgaatgtggcccgtctcgtactgagagtccatggtgagacttggactgggcgggacccggagttctgtgctgggcctcctgctgcggtgccctgcagccccgaggagctcccggggactgtggggctgaccagccatcagccctgcagactttggggatgaggagctgctggatggctccctaaacctggagggcatgcagattaggggatgatgtgaatggagatggcccctctaccaggggcctggggtcccgccttgccagactgtcctcacatttcatgggggttgcagcttggagcccagccaggtaagggccagtgcttctggtcccctgtgcttgaatggcccagggccccctttgccccaccccaccttccagattcttcttctcagagcccctgctgccaggtccctccaccacagtgactgggacaggtggaaggaagacaggaaactgcttaccttggtgatgcctgggtcccacagagacggctctgctggacggatggagatggtagatagcaggggctgcttaccttggtgatgcctgggttccacagaggcggcccagctggacggatggagatggcagatagcaggggctgtggagggagggagagggacatcaggagaggccaaggctggagcagggctgcaccacagccctccccttgagccagcgtgctggggtgacggcacacaggcggcattgtcctcccacctgccacagggcgtggcccagacagggagggggtggttcaggaatgctccagggccattgccagatgatgtcctccttcatcatcctcccttccccgccagcaacttctccaactccaggtgggggtcctggctcccaggacgcagaggcccatggagcggccctgccaccgcatggggtgctgcagtctgcgtaggaggtaccaaagggcagagcctctgtgggaagcctgtggacgcacttcccaatctgagactgccctctgtaccctcttggggcctctctgtgagcacccagggcgaggggatgagggagcgtcctgggccgtggtcttctcattcacccccagggaacagcccatagactgagggcctcacagaccctgggcttggctttccaggccctgccagagtgcagcctgcctagcccggggctgaagggtaggctccctggaggaaggggtgacctggaactgcgagggctgtggagtctcctccaaaattagagacacggtgttaactctgggctccacagagctggccgtggcccggggctcggaggcaggggtgcagagggagctggtgggcgcccatcccttcctccccgagcagccgtggactacatgccagagtgaaggcgagttctaattctgggggtctcacccgcctctggctaaactcagggtagcagtgtgggctggggtgtgtgtgtgtgggtgtcttccagcggccctggagcctctgaagcgacagcccgctcctcagggaggcgctcctggcagccacagcccacagcaggacagccgctcagcgcgcccttgagagctgggctagggatgagtcacacttgaaccgcctgggcccactgcaggcagtcaggggtgacgctgagaggtgccgtggtctcgggtggggtgcggcttcctgcgtctgagagacgcttcctctcctgctgtcctctccctgccaggccccttctgcagcggctggcttccagacaccctgcgtccctcccttgctcgcagcagttgctgtggcggtcctcccgtgcacccccccttctgccctcactgcccctgggggtcctcatcacggaccccctaactcggcatcctggacaccaccaccccgcacctttccacagtgcagctctgctcgtgcctgtgaagcctcccacagcctgggaaggaaaatccagacttgccagaccttgcctcagccaggccttggaagcctgccagcttacctaaccagtaagaccctcagcccatggagtcctgtgtgatgttgtgagcgtgggaggacagactgaactgctcggcccgtggagtcctgtgtgatgttgtgagcggggaggacagactgaactgcgtggtgcttcgcacatagacctcaacagggattggcattttgaagctgttggcgggggctgtggactgcttttcttcctttctagctcaacggcagctaaagccactgcatacaatgcaaggactggctcctgtttggccacgactgattgcagcccctggtgaaatgagaaccctgtgggtcggaacaaagtttggattatttatgttgcaagtaactaaaatctcaagtgaaactgg

SEQ ID NO: 819 - DNA, 1835 bp, Homo sapiens
agatctgaagatggggaggagagcagagcgtggtggcacggctggaattcagtggcaacatcgcagcttgccacagcctcaacctctcaggttcaagtgatcctcctacttcagcatcatgagtagctgggactacaggcatgcaccactgaaaatggaagtattaacaatgcctgccactgcctactcaagatgttgcaaagatccaacgagatctctaacctacttgaaagggcttcagaaactttggagcaccatacagtatcacacaagccctcaattactgccacgtccctgaatcccttggtgtcaattcaccattaaacaacttctcccttgctctgcagtttgaatacggtctgtcttttaggcactgattctcatactctggtgtgtaacagaaatgcctgtagcacttaaagatacaaatgcccagccctgggacttctgcctcagcaagttatcctttgcgggaaggatcgttggacagaaagaggcagaacacagaagagaaagaagcagcagcacctttttttttcttttctttttttctctttttgagacaaggcctcactctgttgcccaggctgaagtgcggtggcatgattatggctcactatagcctcgacatcctggactcaagcaatcctcccaccttagcctcctgagtacgtagaactacgggcatgcactaccaggcctggctaattttttaatttttgttttgtttgttttgtagagacagggtctcactatattgccaaggctggtcttgaactcctggctcaagtgatccttccactttggcctcccaaagtgctgggattacagatgcgagccatcatgcccagtggagaagcagcactcttggcacataaggacaacacaagtcaacaagactggggaccaaattaacaaagggaagcctttctgtgatacagtcccccaagccactgccagacctacctccttatggacatgagtgatggctgtggagagttctaagccatcaagcaaattattgccatcataatcatgcattttgaagtaatggagctgcaattcttgtggcgacatctccgcctctggtttgttgatgacaccttctagatgctccatgatatgcctaaaaatcaacagtcaggttcaggccaattgacagatactgggatcatgctgaaatcttaaggactctgaaaagttcaagatcttaaacttcctccagctcagaaaaacaaacaccagcagtggcagaccacactcaaggattacacagagatagacaaggccttgagaggagcaggaaaagtcaaatagaccatctgttatgctggcaggattagggtattctttcctctttattattagaattttgttataacattttcaggccatcaatttaaaaatatgtcctttaaaacttttttttttttttgagacagggtctcactctgccacccaggctggagtgcaggagcgtgatcttggctcattgtagcctcaacttcccaagctcagttgattctcccacttcagccccccaagtagctgggaccataggcatgtactgccacatccagctaattttttgcaattttttagtagagacaggttttccctatattgcctaggctggtctcgaattcctgggctcaagtaatccacctgcctcagcctcccaaagcactgggattacaggtgtgagccactgcacccagccttaaaaacaaaggataaccgagtataatgcgtgaggctaactggcccaagacaaaagctgcaacaaatgattcaatgtttgaatgtgttgatttaaaaaaggtcttgttatagtc

SEQ ID NO: 820 - DNA, 2170 bp, Homo sapiens
tagaaaataacctatatgtggtggtccattttcagttctaagtgccttcatataggtttaagcaggctatgtggaaatagagaaataaagaagcagaaatgtactgagtcaccaccctgccctccttcctgctttccctttcacccagcggccacgtgcctatcagtaggagccccctcaactaccctctcctcaccccaccaaagaatttagtttaggctagcttgcaacataaataattataccctttcttatcagctacgtgcagccaccagggccatagtcaaatgtttgaagagtcctgagacagttgcaatgcatggtgggctgcaataaaatgcagcagaaagatcctaaagaacagacttgaaatcttaatccaacgaccaataggtgatgtccaggaagatcgtaaccccatttactcagtcaatgaggaactgggggagggacctgcgcactaggggataaattgcttgttgaaactctgctgggggtggctgcatgccagccagacacccagtcttgcaagactgtcattgaaaatctccgttttgctgttctccgggtctctgcgtccagtctttgtgtttggacggacctgccgggccatctttctgcaagaagataaaggaagaccaggagtgcctgccgaactcctatggaggaagtctaggagaggaaggggtaggaccaagggcactgctgtgggctgaagggaggaagatggtgtctgcaaaccaggaagcagccttgccagacacaggattggccacaaccttgaccccagacttccagcctccagaactgaaggactgagttcattttcagcgtgtctggcttttccatttctgtggcctgggaaggaatttccctgcacaggctctcttgcctgccaccatgtaagacctgcctctgctcctccttcaccttccgccatgattgtgaggccaccccagccatgtggaactgtcaagaggctgggaggtgccctctgcctttcaagatcagagagtagctgatccccctcctgccgtcatttatggactgaataaccacagagagtgtgaggccggcggaaacttggcagtgcctgtttgtcattgtcagtttcaaatactttttaattttgaatagttgtagattttcagaagggttatgaagattgtgcaggcagtttctgcaagctgctgctaatttccctcagcttccacgtcttcgctgccatggtccacctgcagcagccaagaaagccgcgttgcatcgccacgagctaaactccagccttcggatttcagagcttccatccatgtcctctctctgctgtgaccccacctggggtgccacgtcgtgtctgatcctcctgtgtcctcggcttctctggtctgtgacatttctgtctctcctttgccatgaccctggcagtgtggaggagactgttgggcaccctgtggatgcccctcagtctgggttcatctgtccttttcctcatggttagcctgaggtggtgggcttccgcaaataataccaaggaggtgaaatgttcttcccctcacggcctctcaggggcatagaacatcctcttgacttcacaggtggcgttaacccgatcgcttgtgtgaaaataacgcatcgggaggcactaggctgagggcttcagtacctcagaagcaaacccagttcctgcacacagaaaccccattcagggtaaggggtcctgtcctaggaaagaaaattcaagtttaaacagaaactgccagctaacctcaaagcagaggccgtgtgactgctgtttcacttcaatccatcctttttctgttcttccttccaagaacactgatgaaggttttccttgtgctccttggtagagcccaaactgctgtagttcagtgctgcccagctcatggattcctgtctcctcaaataactctttacactttcacgtgcctacgtttatcttctaacacttggatcaggtggcgtccgccaggtgtcttcgctgtaaagtcactgtcttcccttccaccgctccactctttgggatgagtcacgaagcctgtgctaccttcaggggagggctggggaagagttaaactccatctcctggaggggctgctacatatgatcatatgatgttatttggagtaagaaagatttgcctcttctccac

SEQ ID NO: 821 - DNA, 353 bp, Homo sapiens
gctttctgagatctgcttttagtgaagtggatcaatgatgaaactagccaaatctgagcatcagaagtctttccagtctacctgatgcatgatctctacagttctgagaagcaaaactataaaacaatgtaaaacaataagggcatatgtctggtgtgtgtgtgtgtgtgtgtgtgtgtgtgtgtgtgtacgcacatgtgtttataaagataacagctgtaggaatgaatgagattgagggtgggggggtgcgtatgtatgtctatgaaagcctaatcatttctgggcaatgatgaaaaggttttactactgatctttgtaactatgatggtttctacacttgacctgagctc

SEQ ID NO: 822 - DNA, 876 bp, Homo sapiens
gcatgccagaggctagagtcatctaccgcgcatgctggaggctggagcctacagtggctcacctcgctgctgcggttggtggccgcgagggtgactacagcgcagccagaatggtgaaaaggtggcagaataggcttatctgactttgcctgcccagttgctccgtgccaggaggaggagccacttattccatgctggaggctggagctgggggcaccgcagctcaccttgctgtggttggtggtggcgatggagactacagagcaccagagcgagagtggtcacggctgaacaatttcaagaagcgagtcgatgtctcatctccctatcttatcttgaaaaacccgtgtacctaagtcgtggatgtgtctgctgcatccgctgcatcagttcacttctgaaggaaccccatgaggaaggtgtaatgtgctcctttcgctctgtggctactcagaagaatgacatcaggcccgatttccagctgggaaagatggattctaaaatcaaggaactggagccccagctgacaattctatatcagaacccaaagacgctgaagttccaaggagtgggctggcctgtcctgtagaagctacctcatcgatgtgcaggccctggatgagaagctgctcatcatcatcgccctgcagttcctgcacggctactacaagcccatcctgttcgagcccaaccagacctggcccgggcacgtggctgtgtggcaggacacgtgctccatcgtggccatcttgctaacatcacgcagaaggtgcaccccgtcatctgatctctcaccagctaccctttgactgcacccaggctctggccgtacccaagcccataggtggggtggtggtctttgtcgtcagctcgctg

SEQ ID NO: 823 - DNA, 423 bp, Homo sapiens
gcggggccccgcggaggggcccggctttgtggaggattagaggctcccgccctaccctacctgcgtgtgtgtcgcctgtctggaaccgggagcttccccagctgaggaccacagtgagagcagagaagacccaggatcgtatttgaaaccataaaagccacatgaagacactaagaataacttgcagaaagacattttctatgaattgaacacagagtcccaaaacccagaaagttccctggtctctatctcatgggcccgtgtctggggaagggggcccgatgtgaggctggggccagtgcccatcctatttgatctttatcttaaatccacttcaaaatgctgtggcttggtggattgaaggttcgccccttcctgtaattatttggtgtctggtaaagtttttatgagtgtttgtgcaaa

SEQ ID NO: 824 - DNA, 7054 bp, Homo sapiens
cgccagggaaggtcaggcggcccggggcgtcctgcgactgcccgaggtcggaggcccggaggacccgccgccgcctttgtgtcaccagcccccgccccgctggactggcccgggccggggcggttgggccggcgctgaagaggcttggccgcccgggtccacccgttcccggatccgcctcggcggcccccgcgcccgcccaacccctgcccaacccctcggctccgcgagtttgggtgagaagtgcggcggcttttcccagggatggagtttagaggacgctaatcctatgtgcgagcggcggaccccgcccggatttcccggaggcgcccggttagtgaggcgacggcgcccacccgcgttcgcgggctcccgaccgccactccccggagccgccggcccgccccagccccgcgcgtcgccccggagggcgggctgcactccctccacgcacctggctggcagagcgtctccagggacaaaaggtgccctggcatcaaagccgagcccccgcccccgccgggatgctgccctccggaaggaggggcgctgcccccaaggtactctccccgggcacccagggggaggttccatttcaacctccgatgaaaaacacggccctcccgggtatttaggagggtctgagggtaagtgccaagatggagaaaacacaccggcccctcacagagtatctcctgaggaatgacaactatctagtgggcaaggagggcttcctgcatagcagagggcaccccctctgatcccccaacgccaagggaaaaaaatcactcttcaccggctcccctgagccaggacaggctccagtgcagccacccaccttataattttccgcggatgctgccttgatcagatagatctgaagatgactttaaggactacaagcaaatctcaagggaaaaattcagaccttgaacaacagccttgaactttttcagggttagacaagtactcccctgtggagtttctgcccttatttcttcgttcttctgttaattcttccatattttaacagaacacagacctgccgaaacgacacaggatggcgctttgctttttgttagttctccaaccttccaaacccttggggcacatgcaagcactgtggaaaaactccattaaaccaagagtcatcttactccagatcccagactgcttgggaagttggacatgcatattcccaaagagaacagtgttggaaggagacaggagagcagctcgggggttgggggtagagggtaggaaaagagggcaagatggatgactaccactcgaggccagcctccactgcctgttagggcagtagaacctaagagccggtccaaggcaacacaaaagacagtgaggctaggtctttcattgcagccaacgatcaagaaagcaactccatcaaatgacactgtcttttaaaaaaaaattttttttttgagacagagtctcgctctgtcgcccaggctggagtgcagtggtgcgatcttggctcactgcaacctctgccacccgggttcaagcagttctccctgcctcagcctcctgagtagctgagattacaggcacgcgctaccaggcccggctaattttttttttttttggtggagtcgaggttttgccatgttggccacgttggtctcgaattcctgacctcaggtgatccgcccatctcagcctcccaaagtgctgggatttcaagcgttagccaccgcgcccgaccaaatgacactgtcttaaatgatttaatgtcttaaatcgggaaaggagagtaagagaaagcactcaacggagtcagaggtgtcttgcagcctagctctttccacagacaagctacatgggcctatcatctaaccttttcaagcttctccgactgcttctgtgttggagggatttgggctagaggatctttttatttttttttattttattttggtgacggagtctctcactgtcgcccgggctgaagtgcagtggcgcaatctcagctcactgcaacctctttctcctgggttcacgcgattctcctgcctcagcctcccaactagctgggattacaggcgcacaccaccacacctggcctattttttgtatttttagtagagacggggtttcactatgttggccagactggtctcgaactcctgacctcgtgatctgcccacctcggcctcccaaagtgctgtgattacaggcatgagccaccgcacctggcctgtgatcccatttttcaaagtaattaggctgggtgcagtagctcacgcctgtaatcccagcactctgggaggccaaagcgggtggatcacttgaggccagcagttcgagaccagcctggccaacatggtgaaaccctgtgtctactaaaaatacaaaaattagctcggcatagtggcacgtacctgtactttcagctacttgggaggttgaggcaggagaattcgcttgaacccgggaggcagaggttgcagtgagccaagatggcaccactgcactccattctgggtgacagagtgagaccctgtctcaaaaataatgataataaaataaaagtaattatttaaggctgggagcggtggctcatgcctgtaatcacagcactttgggaggccgaggtgggtggatcatgaggtcaggaggtcgagaccatcctgtctaacacagtgaaaccctgtctctactaaaaatacaaaaaaattagccaggcatggtggcgggcgcctgtagtcccagctactcgggaggctgaggcaggagaatcgcttgaacccagaaggcggaggttgcagtaagccgagatcacaccactgcactccagcctgggtgacagagcgagactccgtctcaaaaaaaattattattattatttaaaataatcattgggcctggtgcggtggctcacacctgtaatcctagcactttgggaggccaaggcgggcggatcacgaggtcaggagattgagatccaacctggccaacatggtgaaaccccatctctactaaaaatatttttttaattagctgggcgtggcggcgggcacctgtaatcccagctagtcgggagactgaggcaggagaatcgcttgaacctgggagtcgaaggtttcagtgagccgaggtcgtgccactgcaatccacctggccaacagagcaagactctgtctctaaaataataatttttattattgttattcttgacaggccagtgtagaacaggtggggcatctatggtgacagaactgggttccaattctgtcccttcacctgtcccaggttcctcatctgaaaactgtgacccagtaaacctaatttcatgagcagctttcattaaaattgaaataatggtggaaaatgccttgtaaccgtgcttgatgtagagtagttacttagccagttatttcctctcttcttcccattcctaacaaaatggaaaaacgtttggttgctaggaaagagccttaaggggattttgttgttgtttgactctatcgcccaggatggagtgcaatggcacaatctctgctcagtgcaacctccgccatagacaggagccaagcgtagtggtgtgcacctgtcggtagttccagcctcttaggaggctgaggcaggaggattgcttgaggccaggagtttgagtctagcttgggcaatatattgaaaccttgtctcttaaaaaaaaaaaaaaaaaagaggccaggtgtggtggctcacacctgtaatcccagcacattgggaggccgaggcagtggatcacttgacaccaggagttcgagaccagcctgggcaacatgcaaacttatgtcttttaggccgggcgcggtggctcacacctgtaataccagcactttggtaggccgaggcgggcagatcacgaggtcaggagatcgagaccatcctggctaagatgaaacccagtctctactaaaaataaaaaaaaattagccgggtgtggtggctggcgcctgtagtcccggctacttgggaggctgaggcaggagaatggcatgaacccaggaggtggagtttgcagtaagccaagacagcaccactgcactccagcccaggcaacagagctagacgccctctcaaaaaaaaaaaaaaattacatctttaaaaaaaaatgcagggccgggtgcggtggctcatgcctgtaatcccagcactttgggaggccgaggcgggcgaatcacgaggtcaggagatcgagagcatcctggctaacacagtgaaaccctgtctctagtaaaaatacaaaaaattagccaggcgtggcagcatgcgtctgtagtcccagctgctggggaggctgaggcaggagaatggcgtgaacccaggaggcagagcttgcagtgagccaaggtcccgccactgcactccagcctgggcgacagagcgagactcggtctcaaaaaataataattaacaaaaaaaaaaaaatacaaaagttagttgcacatgttgccatatgctcgtggtcccagctactcagcaggctgaggttgggagatcacttgagcccagaaggtggaggttgcagtgagctgagaacccaccattgtactccagcctgcgtgtcagtgagattctgtctcaaaaaaaaaaagaaaagaaaaaaaatctaggctatgctccctagtatgggaaatctagtctagtcatttgacagaatcaggctttgcaggccatattgtctctgtcgtaactaccaactctgctggttaaaagggaagtagccacaaacaatatctgaatgatggattatggctgtgttccaataaaactttatttgcaaaaacaggttgctggttgcaaggtagttttccaacctctacgtgattctcagactttaggttgcatcataatcacctggagggcttgttcaaacgcagattgctgggccccacccccagaatttttgattcagccagtctggggtggggctgatatttgtatttctaccaactttccaggtgaggctggctgatgatggtctggaaaccactttgaaaacctctgaagcttttctcaactcccttctttgtgtacctaaaacactttatccctactgtagatgtagcattagcgtgttatattagtttagtgattggtgtgtgggtctctgggagcctttctgaatcacctccctagcctagtgcctgacaatagcaatttgctccccattcattgactgaactgaaaccggagggtcatggtcatcatcattgttccaagccatagatagaagatgaagtcaccacccctgatctcagagctcatcagagtagagcttgggctggaccctgcccttctctgcagtgagcagttttctctgtggagctctgtgcaacctggagccagtcctgcctggggtaagaggaaaaaagactccttccccccagccccacagcctgtacgcaaacacaccgggagacatgacctgctcagaggagacctggaaccaagggaataaaatgagagtgggttgggggctgctgttagttattttttgcttgtaagtggacaatttgtggtgtggtgtgtgaatttggggtcttaaatccagatagctgtctgctgtggacagccactgtttctgaattacagggcatttcaagtgacctgtggtcaggatgttttctcagatcaggcaaaatcaattggtcctgataataaccaggggagttgtactttccctatcttgagtagaagaagccacagctcccgggtccacctgcctctcctgactgcccacctcctggctttttctttttcttttttttttttttttttttgagacggggtcttgctccattgcctaggctggagtgcagtggtgcgatctcagctcactgcaacctgggcctcctgggttcaagagattctcctgcttcagcctagcgaggagctgggattacagacgcgcgccacctcgcccagctaatttttttatatttttagtagagacggggtttcaccgtgttagccaggatgctctcgatctcccgacctcgtgatctgcccgcctcggcctcccaaagtgctgggattacaggtgtgagccaccgtgcccggccggcctcctggcttttatcctgggggcactgcaagtagagccaggcatgtggcccatgcatccttcccagcctctttcctgctgggcatggaggaggaggcactgccaggagctccccacagacaggcgctgcttactgatgggttggctgcaaactgtaggcataacagttaccttcctcttcacaacccccaggcctgacgaggcttacatgggaattgctttgatttgtgaagtcttaagactatactgctgggcgaggtggctcaagccggtaatcccagcactttgggaggctgaggcgggcggatcacgaggtcaggagatcaagaccatcctggctaacacagtgaaaccctgtctctactaaaaacacaaaaaattagccggacatggtgggggggtgcctgtagtcccagctacttgggaggctgaggcaggagaatggcacgaacccgggaggcagaacttgcagtgagccgaaatcacaccactgcactctgcactccagcctgggtgacagagcgagactctgtcttaaaaaaaaaaaaaaaaagactatactacctaatcttccatgcctcgctctttccacattaatagacaaaaccaggaaaaaggactgcttcccctccagctcttgattgggctccataagaactgccaaaaggccaggcagcatttgctactcttctggggttcacttctgaaaggtgcgaccctgcaacctagagcacagggaagttaggacagcaaaggagctgggctgagccgacgctggcttagaactctttctgatactccctgttcccgccagctcgttagcccagcctgccaatcagttttgcatcaataaactttatgttctgaggttggccagatgaatgagaggagagcagctaaagactgatctctgaccttggcacgtaaacagcctccagattggacttgacagttaataaaggaaaggccctgcaa

SEQ ID NO: 825 - DNA, 1890 bp, Homo sapiens
ggaagcagagctgaggaaggcagccactgcccacccatggctaagcagggagaaatgaatacctcaacctcactttccccctaccccaagtctcccagcaagtctcctaccagaaggcagagggcagggcagctctttgacacaatccacaaagatcagcccttctggagctcagagctattacagagaagcctggagagtgtgtcaagacagcttttctccaggtggtgtgacgctgctgctaataatggtgatgacatcaaaactgccaagggccttagaaatctgctggtccagcacgaagcagggagatcaccaaaaaggggaggcagagctggaagagaacacagctgtcctgccatccaggtgctccattatgcctgaaaggttaacttcaccaccaaagcccaagaagaggttttcttcgccaaagatggggaagtgctgacaacgtttgacattaaaaacatctatgttctcccagacctgtcaggacagacagccattgttggacactttgacttcagagcaccttctggaaaagagcttctgttggatgacagcgcaattgtctgggcagaaggacccttaaagattagagctgagagaaccctaagaaccaagaccacacagcacctctcacatcccaagctccaggagaatcgcttgaacccgggaggcggaggttgcagtgagccaagattgtgccactgaactccagcctgggtgacagagtgaggtcctgtctcaaaaaaacaaacaaacaaaaaatacatattattactacaacttgagtatcccttatccgaattgcttgggaccagaagtgttttggatttcagattttttcagattttgaaatatttgcatatgcataaggaaatatcttggggataggatccaagtctaaatatgaaattcatttatgtttcatataccacttatacacatagtctgaaggtaattttttacaatatttttaactatatcatgcatgaaacaaagtttgtttatgtcaagtcaggtgtggaattttccacttgaggcatcatgttggcactcaaaaagttttggattttggagcattccagatttcagattttcaaattagggatgccccatctatatctccattttattgaagaggaatctgaagcttagagatgttaagcccaaggcacgcaaaccataaagggcagaaccagaattccaaccatcaagatgtcttgttttcccaccacactcgaaatccggaagagcttattcttacctatcactgtttccctaacaccctgtacagtacctgatatacggaacacatttttaattatctgagcaagaaatggagaaagaggaaaatgaaagagagtagaaaaggaaaacgtgataaagaggggtttaataaaggaaggagtaagagaaagaaagagagagagggacctagtaagtgaaaacgatgaggcttattcctccacgacctgactgcacagatgtcgctcaattccccctgcagtctccccagcactctctcccctccactctcccacctcttgtgtgtaggtcccttcctctgtctgcaacgaaaaacgtcctgtggaaaccaggaagtcaaccctatttgagaagtcaaaatgctgctacaaaagccttccctgacccagaagagaaatcgcaatgtcaccaggtaaggagggaggctggttcttggtcagagggtggccagccatcagccagagtagacttcagatgaaagctgtgtccacatcaaggaaattccttcaatggaaaagtccagggaagtcgagaccaaaaagaagatgtcaatgtgaccttcctagatgctacattaaagccatttgaggctattaaattcattctttcttttatcaa

SEQ ID NO: 826 - DNA, 2387 bp, Homo sapiens
agaaattctttctccctatgtcccagcctacccccactttaccgaggccaacagccgcctcagaaaccagattcaggagctaacatgccccaggtctcacgaggatcagagactccagaggccagggaaggagatcaaggtagtcaagcgggggtcgtctcagatctggttgtgctcgagctatgcaaatgcctctcacggagatgcgaggacctatctattatgatgaccagggccacatccggagggggcaacagactttcatctatcagcccttttcaaccactgatctactaaactggaaacactctgaaccctgccatcttgctcctggtatcagagagccctgtcgtgcataactgtgtagaagtgttggactcggtttactccagcagacctgatctccgggaccagccttgggcatcagtagactggaagctatatgtggacaggagcagcttcatcaacccacaaggagagagatgtgcgggatatgtggtggaaccctggacactgtcgttgaagccagatcgttgctccaaggcacttcagcccagaaagatgagctcattgctttaatttgggccttagaactcagttaaggccttctacggtcccaggctttctgctgcatacactgaagggccacgaagtacagtcatctggacttggcacctggaatacaaggatggaaagcatcatttctgccagcttcttatggtcctgaggcgagacagtcatgagagaggaaaactgcaatgacttctgaccactgccagcctcgcttcctgcattttcttcttcggcttactcttgccaagttggagttgcctaacttccaagagggtatttgctcttttttttttctcactccacaaactcttcccaggtagttcagtccactcccatctaccagtcactatacgccgatgaatgccaatattattatttccagcttagacattgttcttggattgcagatgtgaggtttgacttgtttactagacattgctggctgaggatccctagcataacatggcccaaattcaatttatttccaaagctgtctcatctcctttgttctctgtaatgatgttgctatccattcgatcaacatactcagaaatatcaccccctccttccttcttccaagataagtgagttgctcacgacatgatcatgttttggcagtgtactctgtccattcccatcacttagtaagaatcatctaggttatgctgaagtatgaagttaatctccaaatttctctggctcagtacagaaaaagtccatttctcccttctgcaatgcacccaatgcaggtctgcagggtctctgctgtgcgttgtccctcagggactcaggctgaagaggcccccttgtcttatctggccacctcctctgcacatggctcaggattttccaggcaaggggttgagcagaggcttttcagtgctgggcctggatgtgacataagatgcttctgctcacagccttgtggtcagaacaagtcacatcatccctcctacttgcaggggtgctgggcagcgtagtcatccacagatcaggagagggagcagaggcaggtgttcccgggctgcagcgatctccactgcactgctgtgggctgaactgtgccctccaccccaccaagcttatatgctgccagcctcaccctccacaccttagaatgtggctgtatctcgacatagggtccttacagaggtagttaagttaaagcagggtcattagggtgggccctaaggtactctgactggtgtttttatgagaagaggagattaggacttacagggagagacactaggtatgtgagcacacagagaaaagaccatgtgaagacgagaagaaggcaactgtctccaatccagacggagatgccaggcacagcccttctgtcacaaccctcagaaggaaccaaccctgccgacaccttggccttgtacttctggcctccagaaccgcaggaaagtacatttctgttgcttaggccgctcagcctgtggcactttgttacagcttctcacccagttcaggcccttttaattgattgctgggcctttgcagttgtttttgcttctaatatattcatctctcaatttatttctggaggctgccacccgaggggcagaacttcaattgtgtccctaatgggaaaccttgctgggatcatgtggtctacagcacaaggttgctaaagcatcttctgccagaattctgtgagtatctggttaggtgggtctggaatatactgagtttaaaaaagttaaataggtttctttactgcaagatgtttcagagactttaatatgctactctgctgtatgaatctccaggcaggaaatcttataaaatgtgtttctgaaatg

SEQ ID NO: 827 - DNA, 152 bp, Homo sapiens
gtggacatcaaccgggaagagctgaaagatggcgttaccagataaggaaactgagtctcagggaggtcaagagacatgccaaagcacagcttggaagtggtccattggattcgaaggggtcctcacacgaagcaggaagtcaccctgtatct

SEQ ID NO: 828 - DNA, 1168 bp, Homo sapiens
tttgcagtcacctcactaaagaatattcatttatttataattattgctaagtaaacttctcttttaaacaggaacataaaaacacagtagggctttgcacaagtggaatctctaaacagttggtttgtatacatgtcaaaataagttagaatggaatttgtccaggagtttccaagtcacccgagaggctgtgcacctcttttgagaaggttagggaggggtacagacaggagccttgccaagaccaccccccagctcaaactgtgagttgtgctgtttcctcctcctagctttgcccaggtccaaggcacagggcagggggcgttcaagtatcgaacctcacagagggccagtgctgacggcggggctgggggagggaaaggagagccccaccctgggggccagaccttctcccttcagtttccaagaccaaggccactgcactggcaggagggaggaggaggaggagaggtacagggttctttttggtaccaggggagaaagacgtgggaagaggtagttgcaggggatgatgccttctgctcagcaggagaaaatgtcttatacagtgacggggtcactgccacctgagggtcatcatggcgggcacctgggaggtcgtggggcttcggggtctggaagccatacttgggccaccttgtccacccctcagtcctgatcacagtcaccctgaggcctggcttggtccttcacttaaggatccagccttgggggtggctgcgctgcagattggttcctcccaccgcaggcacttgtgaagagtgtgactgattgacacttttttgccttggttgctgggaagctcagatctcccctctgcatgtcccttgcttaggacctcccatggtgtacttggagttgggacctcacctggctctcccttatctttccggctgccattttttcccctttctaactttctttcccatacacttatttgaaatattatctcacggtaacgaaataaagtgtctgtcacctcctgctgtgttgtcatcttgcatgagctatctaagttctctgttcttcagtttctgcatctgtaaaacgatgacaatgacagagccaacctcgctttgaggatcacatgagttaataaaggcctggcacacagttagcactcaataaatgttagttatgattttta

SEQ ID NO: 829 - DNA, 724 bp, Homo sapiens
ataggcacattccaatgagcaaaccccaggaatccacctgttctcatcttgccaacaatgctccttccacggaaactgaccctgtcctatttcctcgctttgatcattgcccagaaggaacagggactgttgagaaacagaggcagcgtgcagcctgaaggcatgcaccgtgcagaagaggatccctgcggctgcgggctcttttccaggcccaaggacaaggcggtgtgtgccgggttgatctgcactgctttagccaggatggctcttcttagagagacaaaccgctccaacgccaaactgccctcgcaattccaatcgcaaaggcaggctagggccacagttcaaacccaactgccaatgtccacaaagaaaagaagaaagctggaaatgcagttggtcttgccatgctggccgctcagcttctcacccccaggcctaagaaggacaaggtgaggatgagttccatttacagagtcctcaccaggtgccagtcacgatctcaatgtctcacagctgccatcccgccaggctcccaggaggaaggtgctgctatttattatccacaggacagaccccacagctggcaagtggctgggccaggaaccagctagggcaggtttgtcccatactctctacccatgagcacgaggctgtgctgttcatgtctccattcaaacacaggctgatatttccactccaggggaaaaaaggtagaaaaaaa

SEQ ID NO: 830 - DNA, 1039 bp, Homo sapiens
acatccacatctatgataatccaacaggtaaaagatgttgaattccaggtatatgaggagtaaaacttttgggaaattctgatttataactagcatttaacttccatgtaatatgacctcaaagacagtggaacttacttcgccaagccgaggttgggtgaaactctgccagtccgtgtacgcatatctgccagtatctccctgccccactcccttgacggactccaaggtctgatgtccacctcctttgttggaatccaaagtgtagcctcctttgaccatctcaaaactttgctgtgttttgattccctggccaccaacagtaccaacagacatgcttgtgtcacaaatgttggatgtctgcatggggagtctaatatttgcttcctaaaagtaaagtgagagtgataaagtgaatttgaaaaatggaaactaacaattcattttcattttttttcaccataggcaaatcacttgcctgctgtgcctctctgttcctcatacataaaatcagaataatagtatcataggtgtgatgggttgaattgagtcccctaaaaattcatatgccctaaccctcagtaactcagaatgtgaacttatttggaaatagggtcattgtagatgtaattagctaagatgaggttatatgggattagagtgggtccctaagcgaatataatcagtatccttataaaaaggggaaatttggacacagacatgcacacatggagaatcgccatatgaagatttgatttccactgccataagccagggaattggcagaagctaggagagagtcctggaacagatccctccccagttccttcagagggagcacggacctgccaacaccttgatctctgatttctagtctccagatctgtgaaacaatacttgtctgttgtttaagtcactcagtttgttgtgacagccctagccctgtagaattgggaggtttaaatgatttaaaacactgagggcacttgaaactctgcttagcatagtaagtgctcaataaacattagtgatattatca

SEQ ID NO: 831 - DNA, 850 bp, Homo sapiens
tacttacaggtaagtaaacctgggcccaagatcacagagcacacagctggaattcacagcaagacctgattgacttcgaagtcagtggtctttcccctgcttcccacgagacagttttgatcatcgatgattttctggttctaatgagatcaaggacatgaagaggctgagtgcctccatgagcttcattattttccatgatctgacctctcattctcttaagctttggagttggatgaaggaagaactctgaaaaaaagtatctgcacccaaggacccacacccaaggagcagtaccagagggaacacatctgaagagccctatctggatttgccaacatgatttagatgataagatactggactttgagctggtgccataatgggatgaggctttgggagtccaaagggagataagtgtaagtgtatttcaccggtgaagaatgtaaaacataaaaggccagaacatgaactctgcagctaatctccaaagatggctctcagtgaaccacacctcatggaattcatgtccttgcatagtcccctcccgcactgaatctgggttaactttgtgactttctctaactatcagaatgtgacagaagtaacaatatgatacatccctccatttagtgagatcatctttaatttctcccaataatgttttgtagttttctgtgtagaggtcttacaaattttttagattgattctttgacatgtgacttttctatgctgttgataaatgatattttgttaaaatttttattttctaattgcttgttactagcatatagaaacttaattacatatagaaactaagtacaggactttgtttattgactatgtatt

SEQ ID NO: 832 - DNA, 339 bp, Homo sapiens
gtagaagatactggaagatcaactctaatttgtggctgccttcccagcagtctctacttcagcatatctgggagccagaagcactcaagtttgataactcaaaagacagaacaatcagtcaaggggtagaggctaccttccattctgctcatcttacacttcttggaaaggagacattcggtgaagatcactactattctccaaacttcattcgggaccctattccttccctgttgatgtcagtgtgtgaaattctaaattatgtcatgggtgtatacgttcaaaagcaatatattttcaaataaacaaaaaatataattggccatcacatataccaaa

SEQ ID NO: 833 - DNA, 1500 bp, Homo sapiens
ctcggagcccggcgcagtggaaagcgggccaagaagcagaggtccaggttccaactcttgattctatcacaaaacactgcacccgaggcagccaggcagcttccgaagacctcgttttcgttcttgttgcccaggctggagtgcaatggcacagtcttggctcactgcaacctccatctcccaggttcaagtgattcttccacctcagcctcccgagtagctggtgttacaggcacccgccaccacgcctggctaattttgtatttttagtagaaacggggtttcactatgtggccaggctggtctcaaactcctgacctcaggtgatcagactgcctcagcctcccaaagtgctgggattacaggcataagccaccgcacctggccaacaattttttaaggaaaagaagaaaggaaaattattgacctcagcttccaccttaactagaaaagaccaaatgaaacctaaaataaaaagaagaaaagaaataataaaaatcagagttgaaatcaatgaaacagagaacagaaaataatagagaacatcaatgaaacagaacgttcttgagaaaattgttaaatttataaattatagttagattgatcaggaacaaaagagaaaataaaaatgaccattatcacaaatgaaatggataactttactacacattctacagatatttttaaagtctgaggcacagacctttaatataaaaacgctttatagttctgtctagggacataagatctcaggaaaaagaaaagaaacatcagtaaaagcacttttgctctgttttacaaaattgaaaatcaatcccgtgccttgtccaggttgttttaggtacacgagtgtaaaactgtatggtacccactgtaatagacgaagcccagctttccatttgatcatgtgcttatgttttcatctatggggtccccaggacccctgcacacagtaggtgtgcagtaaacgttgagtaagtcaatagatggtggtggttggcatcgtcttcctaatgtacgctagactctgtagtggcacaaaagtcagcacctggaatccacgtgggtttccgtatcctccaccaaatgttcaccaagcactcctctgtgcaaggcctgaaacaacagaggagaacagagatttggaactttgagttaataatggtagttagatgatattttggactccaagttgaccctagaatacttaagccttcggagcatgttaggatgggatgaaggcgttttgcctgcgggaaggacatgaacttggaggaaccagagtgtggactgttatgggttgactaggaccctcaaaaacgacgttcaagtccaaaccctcactacctgtccttctgaccttatttgggaacggggctgtgcagatgtcattagttaagatgagatcacactggagattacggtgggccctaagccaatatgaggggtgtcttcatgagcagagggaaatccgaacacaatacagggaaaaggaaaatc

SEQ ID NO: 834 - DNA, 731 bp, Homo sapiens
tgggcagacacagaagagggagaagcattccacaggggaggaaaggcctcagtggggacctatggagctcccaggcccaccgcagggaggcaggtcctcggtcatctgcggagggagaacactttcagtcgaaggagcctgggacccttgacacagaagtgacatgtgcattcggaacctctctgtggaaaacacagacccttcatgacacgcaaactcgaagccggtgaggccgagtctcagggctgcgccaaccaggaagcctggctgtccaatgttccaaatctggatgtgaaatggaccatgcagacaggacccaaggggcatgggggagctggcagaggcacccgggacaagtggggaagcacctgtcggccaggaaggtagagaggcacctaccccagaacacggtgccagcgtcacactcttattaacagatgcaataaccaccttcggagaccagacccctcaaagagcactcagcccacaatgtgacgcagagaaaccagagacccaggcagggagtgcacccacggggacactccgagggtggcctcctgcctgccctgattacttaaaaaggagattcttggaaacctttgcgggcccacaggtgcaccctgactcccagggatgggggctgagccacccaggaaacaaatatgaaatcaaagatccagacagccctgaccctcctgattccagggtccataaataagtcattcttaaaa

SEQ ID NO: 835 - DNA, 92 bp, Homo sapiens
ggatcgatgatgacttccacatatacattccttggaaagctgaacaaaatgagtgaaaactctataccgtcatcctcgtcgaactgaggtcc

SEQ ID NO: 836 - DNA, 393 bp, Homo sapiens
caggaagacagctggcccagtgaccctcagaagtggattgcagaagtgggggtacctcccaggttctccagcggggataatgccagtgctgagagccgactgtgccaggctccttcacattccctcctcgcagccccacgtcgtgacaccccaccagctttgacaaccagccacggcaggagcatttacaccacggtcatccacaaatgctacaggccagcacacggctgctgacgggagaatctcaagagtcaacagatgaagaaaatgggtgctccatagaatgccaacagctttagtctaaatatacacatttttatacatggaagaatccattgtcaacttttaaacattggttaccttttgggagaataaagggaatgggggcgatga

SEQ ID NO: 837 - DNA, 627 bp, Homo sapiens
acggtgggatttctttccgtgctcgcgcgttcagccccaagtctcagggccactcgtctgggaagttgtagaatctgtatagccaacctacacaacctccaaggggaacagccagtgtctgccagatacacgccacgcttgcaccagcttggaggaaatgtaaggagggaagagaggagacgctgacatcattgaatctggagtcatctgagccagtgacttgtcttcccagatagacttcaacaaggtgtccaactcagtggcccacagtaaatgtcaaattaatgaagacaaaatggcaataaggaaaaggagttccaggcactgtgacagatttttttttaaggttgcctgttttaacactgaaaacaatcagcatggtctgaaagaagattgtctagaggaagaaaggaaaagataatgagattttttgccactgccttgaggatccctgattcctattgattttacctgcccttggacctgtccacctctatcttcacctccacctccctgatccggtctctaatcaactctcacctggacaacagaaatggcagcccaaattgtctcccacatcctgtcttaatccctctggtctctactaaactctgcagcctgagagaa

SEQ ID NO: 838 - DNA, 781 bp, Homo sapiens
gttgaagaacatgtcacaccagcacacgccgccgtcgccagcagcaggaagttgttgatttgcagcatattcacactttctgatgcagtcagagctcactgcttctcagaacagatccactcagaaggaactccagtttctgatgtttattttactttttcttccccccaaacaaggcacaaaaggggaaaatgaaagggacacaagaaaaaagaatcaagggtcttactgaccccatcacacacctcctctaatgtcatggctggaaggaaataagaagcccttcctcgggagaatgccagaggcccttgattgaagtcaaggacataagggatgacctcctcccagtccccagccctcaccttcgccttgcgtttgctgtcatccatgatcatcttccagtccgagccgttgttgctgtacccgatcttgaacttcctcatgaacaccttgttctctcggtgcttcccaccctgaatgatgatgcccctcacgatcttctcctcccccaggtctatttggagccactcattgatgtaggaatgaggtgcgggtggaagtgcccagccagagcgactggttaccaggcggatgttttcaggcatccagtttctgtccccttggttggatgatgtgatctgggagtcagaaataagtccagacaccatacccaacattccagagcaaggataatctgggaagtgaaatgaaacagataatgtaaaatgatttcctgggcgactccatgctaagaaataaaatacaacatatggaataaaga

SEQ ID NO: 839 - DNA, 2311 bp, Homo sapiens
atccgcagcaggggcaggaagcgctcggtggtgaagtagcgcagggtcggcttcggggcgcgcaaagcggtgaggaagacctgcggcggcgggaggagagctgtggccaccgctgcgcgccggaggacgcaccgcccccactcctggagtccagcccggcgctcacctccgccacctcctcagggttctgcgccgcctcgcgaaagacttgcttgctgtgggcgaggtattggtagaagcggtggaaggtgtggatgtccgtgcggtccagcacctcctctgggctgcccaacaccttctccatgaaggcggtgtgcactgggccgcactcgatcaggctcaagctgctggccggagagcaacgagtgggagggggcggacgccagccaggccccagtcccagccccaaccccagtcccagccccaaccacgtcccggcccccgaccgcgagcagcaccgctgcgctgggaagtgaggcggaaagggcgctggggataaccagaacatttgaaacgcgggttcctgccggagcagccctcccaaatccatctgaggctacaagggagccctggtgtcaggattcgaatctagcggggtccctggccgctgtgtgaccttgggccagtcacctaacctctctgggctggagcttccccataacaataccaacacttcagcagctaggtcagcaggtggcacaatgcgtgccatgcgcccagcccaagtgcctggcacacagctaatgtgagccgggcagagagggccagggagatcgccccagagcggctcccgcaggacagggtgctcggcgtctctaggtcagagttaagagggttcggggaacgggggtgttgactcactggaccccaaagggcagcagcagaaccgccagactctcgcataagccttcgagcgcgaacttgctggcgcaataaacgtcattgaaaggcagcccttaggtggggagacgaggttcctgaggcgcagcggccagggggtcatccccgggcagacggtgcccctccaagctgacggcaccccactccaccccccccgcggaacctgccttcaaggctcagctccgcacacaaagaatctggagctgccgaggccactccctaccactcacccatcaatcctcccacgctcccggtcaccaacacgcgtcccgaaccgcgcctcttcatgtctggcaggaaggcctgcagcatccgcacagtccctactacattcacgtccagcacagaggccacggcgtcctcccccagcgcctccagcggccccagcaggcccaggcctgcgttacacactgcggagacaagaggcccgaccagcccgcctcagcatcaccctcagcacggcctgtcccctcgtgctccctgggcctgggaacatgttggtttcaacgcagggcggagaaggctcctaggagcccatatgcttccaggaggctcacccagcacgtccacgcggccctcagtcacgcgttcccgggcagcggccacggattttgagtcccttacgtccagctgcaacgtctccagggatcccggagggcatgccagggcccgggccgcctcccacagccggccctgtgttttcaggtccctcaacgtggcatacactggaggttttgggagaggaggaagatctgacttcccttctggcctccaagggctcctcccttctctccctccctgtccctgcctatctatacctttgaagctctgggatggatctgaagccagacgtacggccaagtgcaggccgatgcccgaggaacagccggtgatgagcaccacggtgcgggccatggtgagactgtggggagaggctggggctctgggcttgatatcacctgcttcgccccgccccgcctgcgggcccccaccccttgttgtgtctcccacgcaatctcaaggataagccttcctgcgggtccctggcccgctctccccaccctgttctgagccaaaacagacatgagcccactgcttggaacaacaaactgtcctggttgctggtcagagggaggggaggctttacaagcaggtgtgggttcccacgtgggcacagagtggccccctgggcagattcccctgggtatgcctctgtgccacaggagcgattatagtgaccgcagtttgctgcagaggctgtgaaagtaaaggcgttgggaggtgggagatgattgtatatgtgctggtttcgtccagggttcctagctcataactcacatgaccatggttacagtcttacgttgtcatgttggggtgcctcaggcctcaaaaaacagcctttcgtctctct

SEQ ID NO: 840 - DNA, 415 bp, Homo sapiens
agtgacatcaggttggtccacatcctagcagttctcttggtgttcctgcgtgatcaaaggatgactgccacaccccagcctgctgacctcagccctggcgtgggcataggagggtctgcgtggctgagcatccagtgtccttcgtactgccactgacagcctcaggcctgatttccagcactgtctgtccaggagcaatgggagcaagagtcactccacgagactctggaggcctgatagacaaaatacatgaagaccagtttctacacagagaatcactaaaagatggccaggcgcggtggctcacgcctgtaatcccagcactttgggagaccgaggcgggcggatcacaaggtcagcagatcgagaccatcctggctaacatggtgaaaccccatctctactaaaaatacaa

SEQ ID NO: 841 - DNA, 833 bp, Homo sapiens
cgccgtcgaccccacgccacgcagaggtgaagatacgcaggacgtcctctaaagcaacttccgtgggtgccaggttgtgggctgggggcggtgctgaccttgagagagcggaggaggcgcaggcgcagcacagtttaaacttgattttgtgaggggacgaacagcgtgacaattaaaagaagatctgggaatcgtaagtactgacagaatacctggagggaaggtgggactggagaatagtttgtgaaacagatcctgctgaggatgaatccagaacttcctgaagggttccgcttctgctgtgtagggacaaggttgtaaatagacaagccacaggcacctgcaaatggtaagtgtggtagagaggggctggaattgcctgttggtgtatctgtgggaagcagctgctatccttgaggaagaaaagatggagaaggtaagtggctatcaacctgtcagagacaacacattctgtgaagttgtactctttcatttctgacactgtggttcttaatatctgtcctaaacctggcagtcattgaggttcgcaaagtatctccttctatgtgacagtaaaactggaattactatcagaatggaatccattcctgctagagtaaaaccatgaaaagaaatcgcagttttgattatctgcttatcatttttaatagatcacagagtgcagtgttccttatttgttgtatggcaagttgatgaataactcttgattaatatcttttaatgttctgtttcacacagttctctcaattacatgtgaaaaatctgttatataagtaatgctatttaatgattaaaatggatatatgttttaa

SEQ ID NO: 842 - DNA, 1662 bp, Homo sapiens
agggcctggcgcacataaggtgtgaccttttcattcccgttgttatggagggccacatctgccagagcctggagtctgcgaaggccgggacccggttccccggcccacagtgggggtgtgcaaacccgagagaactgggtaagttggggtcggcttgcagtttggggtaccccgagggcggtgtacgtcggtaagattgtaacagtattactggaagacttattcgactgtcctgatgatacttgtaataggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggtgagaggctctctggtgtagggtttaacatggaacgtagttttgtcacttgaatgcacggaaattggcgttttgacagttttctacgtttaggtgttttatacactttagggtaacgttatcatgtcattgcatagggtggaacttaaatagaaactggagatggctgcttcagccacagtcctaacctagaactgcatttaaagcaaactgataatgcagaaacaaactccttcgttaagaaatgtctccagtagcagggttagcttaagtttcaggtagggtctagatctgcggttggaacagtactggagggttgtgaggtgcttgactgctctgatgaaatcactaataggaagtgccgtcagaagcgataactgacgaagactactcctgtctgattgcagtcaagtcttcaccacttgctggttcccaggagtaaacttgtttgaacggtgacctaattgctatattcacctaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaaagttctttaagctggaaattgtaaattcctcctgaaatgttttttcatgcagttaccatgaactaatactacaa

SEQ ID NO: 843 - DNA, 982 bp, Homo sapiens
ggttaaaaacaagtagaggttagttatacaataattagtatataatgacatttaggcaacctgacgtcactctgttttgccaattgcaaacatgttactttccattgttagatagaggattgctgaaatgttatctaaaagtccaaacatgtacatgaattgcaaatgcagcttttgatttgtggtcttgtttttagcttgaccttataatgaaatctatttttatttttaagtttatttttttaagacaagatcttgctttgtcacccaggctggagtgcagtggcacaatctcggctcactgcaatctctgccccccagattcaagcgattcacttgcctcagcctccctagtagctgagatcacaggcatgtgccaccacgcccggctaatttttgtatttttttaatagagacagggtttctccatgttgaccatgctggttgcgaactccttacttcaggtgatctacccgcctcggcctcccaaagtgctgggattacaggcaggagccaccatgccctgccttaatgaaatctattcttattgaagagagtggagaatgtgttttataaggaaaattgtagcaaatattaaatgccacaaagttgtctcagtatcgctaagataattaaggtctttgagaaatacaagtaagaatttaaagagtagagtaaagaaacagactaaagtaagcacaaatgtttccttacagtcaagggatttgtacagccctgtaggagacacctccagagaaagtaacagctctcaattgattagctgagccagaattagcttctgttacttacaactgtgagtcctgactgaaaacatatttcttcctttgaagaactgttacctgtaacaggctaagaagaatattaagaataaacagatgcttttacagctcgccttggcgggaagatctggcacaaatgaagtatctataaggagcagcagagtcaaggtggtgatcctgtg

SEQ ID NO: 844 - DNA, 2614 bp, Homo sapiens
atttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacacagttttattctggatcctcatttgcctttaagaattttctcaatttttctttttatttgatcgcaccactgcaacctccgcctgctgggctcaagcaattctcctgccgcagcctcccgagtagctgggactacaggcgtgtaccaccgcgcctggcttatttttgtatttttagtagagacgggatttcaccatgttggccaggctggtctccaacgcctgaccttgtggtccgccacgccaggccgaagattttcataatttggaagcattgcgtttcgtaattatgctttctcgtatttttgtgatttgggtcatttttatttttatatttttaggattacaggcgtgagccatcgtgcctggccgatttgggggtaattaacaagtccacgtgtttcatttgaatttaggatagctgggcctaattgttgtctttgcttctgcggtaccttccacatagtactaaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtctttttttttttttttttttttggagatggagtcgctctgttgcccaggctggagtgcagtggcgcactccattgcctctgcctcccgggttcaagtgattatgctaagtgattctcctgccttggcctcctgagtagctgggattacaggcccccgccaccacgccaggctaatttttgtatttttagtaaagacagggtttcaccatgttggtcaggctggtctcaaactcctgaccttgtgatccgccagcctctggcctcccaaaatgttgggattacaggcgtgagccaccacacctggctggattgaagtcttaatacatgtttaagaaaaattggctaaaaagtagccaggcatgatgataggtagctggaggaaggagaatcgctggagcccaggagtgacctatactcaaacctatactccagtgccactgtactccaaccccaggcgatagcatgaggcccctcgttgaaaaagtttagggttttgctgtactaatagattaatatcttgttttgcaggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgc

SEQ ID NO: 845 - DNA, 3402 bp, Homo sapiens
tagatgtttcaccagcatcataccttagcacatgcctcgcgttcttcccagaaagtcagccctgggaccaggtgggctggtaaagtcctcagtgctgggccctgtgcctgttgcatgagcctgtgtcactgtgactgtggaagttggagctagtgagaggaggaggaggtgggcagaggaaggagggtcccttgggctcgagctccacatcagccctgagctgctggcaagcacccctggcctgcagccagggagagccagagcctttgccaggcagcgagcctccgtgccttccactcctaggtcaggttttgacagcaccactttattactttgtttaagctgttagaaaatttcagaacatcagacacaccctattcaaatgtgagaacaaaaacaccttccagcagtgcctgcttctggaacaggactcctcctgcggaacagggttttgctcaatgactacctccccggtcatgctgctgtccagtgagcagccgggccagagcttgtcggaccgcagtgtgttctctgctagatgcggcagctgtgactcagggggaatgggggctgtatgcctgctcctgacacacctctgcccgttgtgctttgcaggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaggaaggtgttgcctgctgcttcaactcgtcctcagtggcgcaggccaaatggtttcccttgaatgcacagccatttccggcgtcagcccgggaagactcatgtcagacccgctgtctccaggcctgttgtcagcgctaagtgcaacctgtctattcttggccagcaagttggggcaccacattggatggctctgatttttcccaaaacaaagcccatgccttgctcttaattttttggccttaagagctggaacccaaagacacgtggagcccagagctttcctagccctcggctgaaggaaggctcgcggagtagggcacagtcttgttggaccacagaggcctggggagcatttgacattctcatgctgctgtgaatcgggaatcccttggtgacttctctccagggttgtcatgttaagagagggcctggggcagacttaggatcaggataaagagagtggctgctattgacattgccaagcacccagtgtatcttatttctaatctctttgcccatgagccagagccgcttgcccaagggctcccagccaggggctgtggagttgtcaggtttgtgcctccgaagctgtgtcctgaccactgtggctgccgctcctggaggcctcagacctgctcccctacacacgtgggcagcaggactcccgagggcctctccccagacttcgggagaaggctcacctcgtgggagggagggctcgctcatgcccatctcctttcgttctttgcgggccactcggccaactgacgtcggcctctcctgtctggatgtccagtttctgtggctcactcctcaagccagatcatctgggactgagggtggcctctgggctcctgtagacttccacagccaggatttcacatccctccccagagcctcggaccgaacagccacaagcagccatgagtgtcgtgcctggactaagctggagagacaaaggcgtttgtggcaagggcccagctggaagccctggcaggccagagcatgcatgtgctggcttgcacgagcatactttggtgtttgtgttggggacaccgggcttctgagggactggcgtggctccagggtggggagcagcctggttgaagcgcggccaggcactcactctgttgttcagatcccagctccactgcctgctgtgtccacagtctcctcacctgtcaaatgggaatatctatgtggcgggagggtgctgaggtttccacgagctaatctgcctgctgtgtagtaactagtagcttttcttactgttagtgaacttgttttagtctgaaggaaggcacccatgccccaggtgaagtccagctgagttcagtgaggacgatggagacccttggtcttggcacccttctgccttatactgggaatgcctcaggcttgctcctgctgtgtgtctgtggttgcccactttctgctggtctccgagagactgattcaggtgttcaggagtctgttcgctattacatcacctccttgtgagaaataaagtggagcagcctcatccagacagcaaagcaaggagggagcgtgaggagcagccaggtgagctggtggcatggggccgcctgtgcagaggccggcctcgctgcttcatgtggctcagggaggctcagcacgtccgtcatcacacctcagggcagcgagagtggacctggtgccttcagaagcccacccgaggcctgctgctctggcctgcaaaggtggagtcaccaaagctcattacaaagtgtttgcttatttttgtctgccctgcatttttttatttcttgcaaaggcctcagaggatgtgggccccagcccaaacacatcttgttttcactagtagagcttttcctagtgtctgcacaggggtgcttccagtggctctgccatagccccagacaagctgctgacacggcagccatgaggtctgggacaggttccagggggtgcttttggcctgctccagcaggagtggaggctggactggtctccagcaggagtggaggctggactggtctccagcaggagtggaggctggtctgggctccagcaggagtggaggctggtctgggctccaggagtggaggctggtctgggctccagcaggagtggaggctggtctggggagagagctacacctccccaggcccaggtctcacgaaaggagcatcgaagggcaccgaggaaaaagccacttagccctctcctgtcctgcaccattatctgggcccattggttcttgggtccctgtctttctcaacaggcagccccagttggggaattaagttgattctggactggctatgcctaatgatagctgcaatttgaaacccataaagttcgagttcagcaataaagttggggaggcagtgtcaacaccttccttgtagaacggc

SEQ ID NO: 846 - DNA, 2590 bp, Homo sapiens
cttctcctcgatgtccacgagcttggtgatgaagtccttcagctgcgccacgccctggcgcacggtgggctgcagcggctccatccaagcctccttggccctggaagccggcgtgtccatgttgcccacgttctggactgcctggaggtgacagcaggaaggaccaggttctgctaggtttaactgacgctgctgcactggataccccaccccggtgccgggcacataggtgcagcctgagagtaagcagacctgggttggaaggtcccgcgattcaccaccgacaggatgggcggccttggcaacccccgacccctcgcaggcctgttcccttatccatgagatggaactcggacaaggtggccacaggaaggctttgcaaactgtgaagtgcagtgcctacgtgggcgtgccagtggcctcgccggagccggtagggaacactctgcagtccaggccagggccccggtaggacacccagctgtgcatcccgcccgtggccgcaaggcccgcaccttggccaacaggagcagggtgcggctggtgcgggcgtccgcgtggcgctcccgcaggtggaagagcttgggcgacatgatggcgggagagaagaagcgcaggcacaggaagctggtgacggcgatgaacggtacattctggaggggtgcggaagagcgcgggctggagtcccccagaccagggctcctggcagccccctccccttaggctccgtccctgaccctcgccgggacacagcctccctggtcctccccagcgctccctggttccccaccgctcttcgcccgcccctcgccccagcccagtccaacccggcccagcctagcccagcgggtggagggcgcacctcgtgctgggcgccggggaagcgctcgcgcacgcgccggaagagctggcggaaggtggcgcgcaccacggcggggcacgcgggaaccgagcggctgagcgcgctcagcagggcccccaggtgggcgcgcagcgtctgcgcgctctgctccagcacctcggcctcggtctgcgggcggtgcagcccggaacacctgcgtggaacggggcgggttggcagaggaggtcacggtcagcgccagggccacgacaggaacagtggctctcacagcagccgggacacggacacaggggacaatacacgggtgggcagaagcacaaacacacatgctgacagggcctgatcccaacccgctgccgctgcgccccgcacccccccggagttacccccggcctcaccctacatccttaacttccactttgctggggtccagctccacgtacttctcctcaaacaccttgttgatgatggggcccaggacgccgtgcaggtactgcatcccggccacctggggaccaccgcaggtcacattgatcctgtctcccccagtcccactccagctgcccaccttctcccggcagccgcccttgcaccgtttgcctgccgtatccgcccaggagggggacaggtacacaagcagggcaaactgtttattcatgaatgaatgaatgagtgagtgaatgaatgactagaattcttagcccttgtaatcctagcactttgggaggccgaggcaggaggatcacttgaggccaggagtttgagaccagcctgggcaacatagtgagactgtctctaacttaaattttaatcacacacacattcttttggggggggggggtgcggggcacggagtctagcacggggcccaggctagagtgcagtggcgtgagctcactacaatctctggcttctggttcaagtgagtctcctgcctcagcctccccagtagctgggatcacaggtgcccaccaccatgccaggctaatttttgtatttttagtagagatggggtttcgccatgttggccaggctggtctcgaactcctgaccttaagtgatccgcccgcctcagcctcccaaagtgctggaattacaggcatgagccactatgcccagccacattcttaaccttaaagggctctcaatatggagatagaacactggagtcgaagtcccagccccctctgtcgctctctctgaagctcagtgttgtcatttgcaagatgaggacaatatagcatgcaacctcaccttcagaaaagactccatggactttgaggccagagagttgctccggaacagggtgttggtcttttgttacttggtcataagtaggcgttttccttttgatttggttctaggaggttagtgtgcattggcgttctgttgcctgcttccagcccctattctcctgcctcaggttcattagaaaagactgagtttggggccgggcagggtggctcacacctgtaatcccagtactttgggaggccaaggtgggcagatcacgaggtcaagagatcgagaccatcctggccaacatggtgaaaccctatctctactaaaaatacaaaaattatctgggcatggtggcacgtgcctgtagtcccagctactcaggaggctgaggcaggagaattacttgaacttgggaggcagaggtttcagtgagccgagttcgtggtcactgcactccagcctggctacagagtgagattccatctc

SEQ ID NO: 847 - DNA, 1612 bp, Homo sapiens
aaccaggacagaggctgcagcacccagggaggaacgccgtggtccctgggacggccaccaggccaggaggctgcagcaccagggaatctgtgctcacgtcttccaggacagtgcttcttctagaagctgacatggagctgaccacagctcttggaggcatggcctgaggcttagaaaatagacagagatcatctgagatttcagcagtggggccacgtggcagcgcccgaaggcctggagcaggagcgacccagggactcagagcagcatcttcttaggagacggaaggagagccgccggaggagcacggggcacctgcgatcgcgaagagcctcctgttctggatgggagcgaaggctccgagaggacctaaggttgctcagtgggccatggaaacggcagtgattggggtggtggtggtgctgttcgtggtgactgtggccatcacctgcgtcctctgctgcttcagctgtgactcaagggcccaggatcctcaggggggtcctggccgcagcttcacggtggccacgtttcgccaggaagcttctctcttcacggggcctgttcgccatgcccagccagtgccaagtgcccaggacttctggaccttcatgtgacgcccgagtccccaggatttgctgtgctgatgggtcagactcacccgctcctcagcaagccttccctggccttcccctcctcccagggccttctccctgtccttcccctccagtaacctgtgaacttcccgtctcctcccattccagccttctgtgccctccagcctcagggatccttgttattgggacagcccagctggggttgacccacaggatggggcttaggagagctctgaggagtgagtgaacagacagcgccggagtgcacggtgggccggctctgctgatctacaccaggaactgaaatatcactggaatttattgtaaacggtgtgcctatgatgctggttctgttgccacctgggcacgcagcaccctcaagtggacatttctagaaaccgcttcttacttgctcctaattgattacttttgcacattgcacagaacccaacctcgaggcctgctccctgccagttgcctgaaatcagccctgaaattctgaaaccaaagagctgcttcctgagaacaagttatttaccttagaattgaaaatgtatatccttttatgggcctttccaaatctgattagaaaaaccacaaaaggaaacagaagagaaaataagagccacagaaagtacaatatgttttattaacaggaaagccagaaataagatattttaaacatatttttaatgagactttattgctatattccaacaggtcactcctattcttagagaatgtgaatgacttgtgtcacttcggagtgacagaaaaatcaggaactgaaagataattccagacaagttaaaatgttatgttacattcaaagctcttgttttcatcacaaataaggggatattcagtttttattaacagaaaacccattctcccatggccatggaataaatgccatgctatatttaaggagtttggtttgaagggtgcaaaattgtgagcctcctggctcttatgtctgtatccagccctgaata

SEQ ID NO: 848 - DNA, 437 bp, Homo sapiens
gcgtgaacatccagagttaggtctcaaggctcttctggttctaagtcctaacaaacaatgatcttttcagtgaactgtagaattctggaaagaataagcgtacctccaggctgcttacatcaatagcttacacgtgcttcctgatgcctgccttaacaacaaaaaattcgtgtccatagcaaatatttattgcatgcccactctgggctaggcactgttttagaggacaccgcagctatcaaggcagatgtggtccctgttcccatgaggctcctacatttgagtggaggaagatgtacttgtctacgttgggtgatgattagtgccatgaagaacaaaacggatacagtgagtaatgtggacagggctatcttagctatcactctaataaggtgatatctgaggagagatctgaatgaagtgaggatacaatggat

SEQ ID NO: 849 - DNA, 292 bp, Homo sapiens
gccgcgtggtctctcacgcaggggcgccgggcgggggaacgcggccaccctgagtctggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgcacttt

SEQ ID NO: 850 - DNA, 954 bp, Homo sapiens
agtgcaatcttcggttgcctggactagcgctccggtttttctgtgctgaacctcaggggacgccgacacacgtacacgtcccttcgatagctcagctggtagagcggaggactgtagctacttcctcagcaggagacatccttaggtcgctggttcgattccggctcgaaggagacaagtgcggtttttttctccagctcccgatgacttatggcactttccttgggtgccttcagtgacacattgcattccaacgagcagtttgaaagtctagcgctttctccccattttgggcctcccagcctgcacgggactcatctgaggctaagctgcccatagttcggggagacccacagggaaaacaaaacaagaaacagagaacttggaaacggacgctgattactttgaacgtttgctcaaccgaggaagcaggaactgttcggccccatctcaagtccgcagggcggactgcctggctctgggcagatccgaggtggataggacaaggcaaaaggtagccctggagaggtgagtggataaagtccctggacacaggggctgccgttggaggaggttgtaatgtcattgtcctcctgtggaagttaactgtggagaattaactagagaccagcgctgagagagaattaattggataaaagttctatctaggacagtccttgagcgtaattttgtgaagcaaacacaagacaacaacaaaacgagtaaaacctaaacacacatccacacactcactgaaagattcagagattgcacagaacacaaagacttttctggtaataaaatctccctatcctaattttctagaaaaaaagctgttgaagccaccgcgcagttcttacaagacataacacaaatcttccacacaaaggcagaaatacagtatcaacctttgtgaggagtacagcaaataaatgatgtttctttagggtccta

SEQ ID NO: 851 - DNA, 738 bp, Homo sapiens
ggaggagggacccggcggcgcggcgtgggtcgggagcgggcgcctgggactacttctcgtttgaaagttttcagaggccaaaagtttgagccggggctgcggaaggatccggctctggcggttgccgcgctcggcgacaactggcgactgaaatttgcatagaagagagtggcccattcggtgtccacccgtcaggccacccagcagccaggcacgctcataagcccgcgttacggatggtgcggccgggtgcacaggcccgagggaagcacaggcctcggcctcccagctcccaacccctgcaccacccacagccgggagtaccccatggacagctgtggccgaggagaagccagggatgagggggatgggcctcacctccccaccagcctgggaagggggtaggcccctggcaagtaggagggaagctgaggctcagagacatcatgaggatgccagctcaaggcccagccaggccttggtcctcagctgctgtcatccagtagggtaagtgggacccccaggaggtgttgggggacactcctcccctcccccacactcacagtctgttcaccgcccaaggcagcaggctggactcggtgcagggaccatggcttggcgtggccaggttggagtggcccctgggactgaaagcagggggcgtgggggctctgaggcggggccgagtgcggggacgtcctgtggcgggtaccctgctgggtcctgggtgggggccac

SEQ ID NO: 852 - DNA, 2388 bp, Homo sapiens
aaacaatctcgacagcgcatttcgggagccacggctccgggcgctttgctgggggctaaaggggtttatccctttccttgaatcccagcaggctagaactaccccctcccagtcttcaggcttgccacgctctccacccgatccttccattgaaaggcagagaaggaaggatgtgcttgggaactttaagacccacgaacgacagcgcactgatggagcagcccagtgtctggggcaaagtcctcgaggttcattcattcaggaagcctctgaccagcctttaccatgcgctgagtgagaagctgaggataaggaaagagcaagacccccaagaaaccctgatgtctggctgaaagccgaagcatgacgcaactttgctatatttctctccaacaaggatttgtatattttcgctttctcctcaagtaacacctggacctgctcctttcccttcaaacgctgagggctcagtctccaagttcctttatgaaacagggtgtaccatcagagacgcaggtatttattgaaacctgctttgtgctgggcaatgtgccagatgttggggataaaatggagacttcagaaatgaagatgcaaagacaacaggggaaaccatatatgtttatggacagtcatgccaaagtatgattggaagacaaaaagacctgtgatctcactatgttgcctcggctgctctgaaactcctggcctcaagtgatcccccctgccttggcctccacagtgctggaactataggtatgagccattgcacccagccaggaaatacaattttcgaaagactaaacaagtttctaaaatcatggcacaattaagtagcaaaattagaatacagagtgggcttgttggaaagcgtcaactattaatcaccatgccatacttttgaggagcagaccccacacttgtaaccaggcccttcaatttatcattcctgcaagtcaagacttcacctgtgaaccagctgccctctgccagcccaacttcgtggatgtgcaatctctacagttgcacagggtcccgtgtttagtttagtactttgcttttgctatctttaaatacttaataatttttaaacaagagattccatatttttattttgcactgagcttcacaaattacaaagtcagcgctatccacagtacccaagctataattaatacaaagctttaaaagctgcatggagtttagctgaaattgctgcccagtccgaagctaattttggaagatgctgttcggtcttaggttatgaaaaacggttctgcccttttacaactccagcaggaagagctaagctcccaatattccgtccattaatgtccctggtgagagtcttcaaaactcacgagcaacaatgcaagaatttcccagccttcaacgtgtgacccacttctacattattgactccaataaactgaccaattaaatgtttttgtggtcacagaacttgtaattatgtggttaaagatgtttcagatatatcacattctttcacactgtggcagaaactattggttaaataactcagccatgtctatcttccttgtccaatctgcacaaaagagactggaaaaaagctggacacttgcttctttcccatcctcctttgcaggtaagcatcgctgtgtgacttagttctggccaatgagatgggaaggcagtcttctgggatgcaaaaagcttttttctttgttaataaaaaggagaatgcctctataggaaaagatctttttcaataccactctgttgcccatttcctaccttgatgttgtttggagctacggcacccatcttgagataataaggtaaaacacatcactaggaaaaaccaacagctgaatttagagtagacaggatggaagggacctggtgatattgtggagcaatgaacgaatgctgtcgactgcctagttaacctattacttgtttaaatctctgataggctatatttttaaaattttgcaaccagggttattcttagtctaagcatgcaactttgaaaaatgtgatccctttgacaagataacaagccttccattacctgctgcaggtgacccagtttgctggctgttgtgggtagctcagaacaggaccctaaggcaccttggccctccctctgctttaaaactcaacaccaaactgtattcattcttgtggtactgcctgtgtcttaacatgcatcccaacatctggcacagagcctggcactggcaacctcttaggaaatttgttaaatgaactgatagtgtagcattctgtcactttcctcagcgataaaattctcattcttcaaaaaattttccttttgcaactgaatttaaaaatgaaatacctaccacctaccacttcaagctttgctaggtgacggcttac

SEQ ID NO: 853 - DNA, 14667 bp, Homo sapiens
cttgtgatagggagacaggagtcctaggaaggaaatggaactggtgatagggagacaagagtcctaggaaggaaatggaacttgtgatagggagacaagagtcctaggaaatggaaggagagcacgtttcactctgtccagcagagggcagcagctacccacaaatcaacagctgagcaaggccagggctgtgtgggagctatgcacaggttctgcctccagaagccttcagtgcctgcctctgagccagagggttccaagcagaagaggtcccgcccccggagagggacctcagagaggtcctccaagcccctctcagctcttacttacggcatcccagatgccctattcctcttctgcagagagaaggtggttcagccactaaatggtgctgggacctcgcagtttggtgggaaggaggaagcttactcaagcaaggaatatgagacaggcaaaaacccacgcataagccaaaagcccctccaaagcgaggtgttgttccaggctgacaagtgtccagcagggtggacttcagactccctgttaggaactgaattgtgtcccccaaaaagagaaagtcaccccagggtatgacctaattcaggaaaggtcattgcagatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacggtgagtcgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagtgagttttctggcaaatcaaataaatactaataagtctgtatgcacattatactttatacaaatcctatgagtgatgttccagaaataacaagttttgaaggcaaaataagtccttaaattggcaactttgacacataattccatgtagtagttaatcttgctagaagatcccaatgttgttattctaatacaatctgataatgttcactggcattttccactgttggcatctttactatagcctacagttgtttgtttgtttatttgagatggagtcttgctctgttgcctaggctagagtgcagtggcgtgatcttggctcactgcaacctccccctcccaggttcaagcagttctcctgcctcggcctccctagaagctgggattacaggcacgtgctaccacgcccagctaatttttgtatttttggtagagacgtggtttcatcatattggccaggctggtcttgaactcctgacctcaggtgatcagcctgtctcggcctcccacacacagtgctggggttacaggtgtgagccacgattcctggctgcctacagttctttgtaaagcagacaaaatagtttcattttttaaagaaatgaacatatatgaggcaacctgtacctaacttaggagttcagaaattccctggactgcctatacattttggtttctcattcctaattcccaaagattaaaatctgtcaggaatttggaaacattgaatcacaggccaaaataggaccatgtctccattcattcattcattcaacaattatttattgagcgcatgctatttttcaggcactgtgccacatattgagaatagagtagtgagtaagacaaagtcatcactttagggagtttatattttagaggagagaaagacaaatgaaagtgtttaggctgggcatggtggctcacacctgtaatcccagcactttgggaggtcaaggcaggtggatcacctgagctcaggagttcaagaccagcctgggcaacaatcccatctctaacaaaaacataaaaaattaaccaggtgtggtagcacatgcctgtggtctcagcaacttgggaggctgaggtggaaggatctcttgagcctgggaggcagaggttgcagtgagctgaggttgtgacactggacttcaacctgagtgacagatcccatctcaaaaacaaccctgggccgggtgtggtggctcacacctgtaatcccagcactttgggaggccgaggcaggaagatcttgaggtcaggagattgagaccatcctggctaacatggtgaaaccccgtctctactaaaaatacaaaaaattagctgggcatggtggcggttgcctatagtcccaactactcgggaggctgaggctggagaattgcttgaacccgggaggcagaagtagcagtgagccgagattgcaccgctgcactccagcctgggcaacagagtgagactccatctcaaaagaaaaaaaaaaaaaaaactcagaactatttaatacaatgtactggcaagcggtgatgagcactatggaaacgtgaagcaatgtttgagtgcagcgagtgaagcggtgctgttttgtttgtgattgtcatgaggacccctcagaagagcagagagctgaatgcagtgagcatagaaccttactgaggcctgggcaaggctcttccagacagcaaactgccctgaggcaggactgtgtttggcgtgtcctggaaacaggaaagaagccagggcctctggaatgtggtgaaggagagggaaaagtagtaaatgaggctggagagagaggcaggggccagaacatacagggctgtgtaagtcacattgagttctttagattttcctgtaagtgtggatgggaagcagttggagggttttgaggaggggtggtgtgatctgacccgcattttagaatcatcccgttggctgaagtgtggaggaaaaaagcagggggcagaagtagaggtgaggggcagccagttaggaggctacaggagtagcccagaccagacaggagggtggctcggccctcagagatcttggtggggcagattagagagtgatcaagttagagctaacaggacttttttttttagactgggtctcgcttgttgcccaggctgtagtgcactggtgcaatcatggctcactgcagccttgacctcctggatcaaggtatcctcccacctctcagcctcccaagcagctgggactatgggtgcatgccaccacacccagctaatttttgtatttatggagatatgggtctcaccatgttacccaggctggtcttgaacttctgggctcaagccttctgcctgccctggccttccaaagcattggaattacaggcctgagccactgtgctaggccagagccaacaggacttactgagaaattatctgagagagaggggtcaaggaagactccccctgttcaaccaagcaacgaggtgaatggtgctgctgcttcctgagatggggaagactgtagaggaaacaaaccaggaacgacaaatcagtaatttagctttgaatacattaggtttgagatggctagtctgtacccaaacagaccacactgtggcatctgggcagcaggatctgcagaatccagcaggatggatgctgatgccaagctgagtagacagttgggtctgtgagtctaaagctcagggaagacctcagggtctgggatacaaatctggagatcatcaccctgtccatgaaagccaagggaatgatggaagatactatgagaaaaagtgaagagaggaaagagaagaggtccatggaaggagacctgggagaatccaaccttcgattagatcaggaagaggagaagaatccagtaaaaaactctgagaagtctctgggaaggaagtcttccttccttcccctgtaccaggagaggtgctatcccagaaattagtaaagaaacagtttttgatggggagaacaggatcacctttgtcaactgctgctgcgagacttggaaaaataaggactgggaagagagcaatagaaactttgaaagccattggttatcttgataagagttgtttctgtgggggtggtgagaactggagcctgactggatgggttcaagagagaatggggagttctagccaagaaggctgatgaggatgagtcaaattaaaaatgttttctttttatgagtcctctcatatttactgatacaactgatatattgggtctccattctgccacattactttatattgatcatgtattgtatctgctatgcaattgtattgcatgtatctgcatggcaattgtattgccatgcaatgtatttttttttactttaaaaattatatttataaaggtttgtaattttattccagtggttattttatatgtacactttttaaaatgctcttaattttttttttaagacagggtcttgctctttgcccaggctggagtataatggcatgatcctggctcatcaaagccttggcctcctgggctcagtaagtcctcccacctcagccacctgagtagctgggactacagtcatgtgccaccacaacaagctaatttttttgtattttttgtagaaatggtgtctccctgtgttgcccaggatggtctcagtcaggcgatccagcgcacaagcaatcctctcacctcagcctcccttggctcttactcttattttcttgtttaagcttttactatctggtttataaatactgcagtattcttcatctcccatccattgctcatacaacaatctaggggcatattccgtttttctctatttcccttgtcccatttttgagttgcactatttccttatcatctcttatcagctgaagctcattctctagtataccgtcagaaaactttttattttttgcaaggggccagatagtaaatatgttcagttttgcaggcatgcaatctctgccacagctctaccattgtagagtataagcagccatagacaatatgtaaacaaatgggtatggctgtcttccaataaaactttatttgcaaaaacaggtggtgggccagatttggcctataggctaaagccctgtcttagagtagcagcagataaggagacagaaaaactgtacaggaggtgagagaaaactggcaggagagctagggggatattgacaaaagaggagccctttaaatcttccaggggtagaaaaaatgaaattctttgatgttactcaatagtttacctgctcggaaggaggaaaagtgtctcttccatctcagagttggctcagcatccatcctgctggattctgcagatcctgctggccagatgccacagtgtggtcagctgaaagtgatttgctcatcctgaaaacagcaggtatagaaagcgctctttcagcgccatggcaaccagatcgtgtttttctaaaaaaggatcagatcagcgggtgtgtccctccaggcattgatccattaatatgcactgagctcatttcagagccaggccctgggctgagtgcttggaatacaaagatgcaaaaggctaagtccttgtttttaaggagctcatagactggaggaggaggcagacatttacagtaaacagtgtaatcacacgtcatcaaaggaagggacacacaaagggctgggtggggagcatctcctcctctttgggagaaactgacctggagacctaaggttgagctgaattttggagaatcagtcagagttggtcaagaggacaaactgggatgggtcaaggaaaatggagaagcttgagagctgtggcagctccgtgaaatggcaagtatggccagaggatggcatctccagggtgccggagatggccatggagaggcaccgaggccaggccatgccgggcctctgctgcctctgctgtcaccaaggtcaaccacaacctagtgcccaagccagtggcattttccagcctacttttactcatcccttcttttagaaaatgctgccttgacagtctgattttcatggtatcatgatccgctatctcctgatgtgtcctctgtacatccagctgctctttctcactctcttatttgtgctctcacttccttaaattttaaccttcttctcgtgctgcactttctccaggtatatgagaaacctctccatttttcactttcatctgtattgctctttgcctgttggcctcaatttctcccaccacaagatgagcccctaaacgtatctaagaatgtggcctcaagaaccccagtgtggcaatcccagtgaaaagccttttcccagtactcatctttccatcctggggaaggcatgggattgcttttggttggttgtgtacctaccctggcacacagcactattatcagagtgatgggccaatacaatatatggtgagggaaatgaggttccatgattggccccatcagtcacaaggatggaaaggcagtttcctaagacagatgtatcaggcaggagagaggagctatacaatgtcaacagggaaagtgtaatataaataatcatgaactaataatagagggttagccactaagggataaaaagaagtctaaaggttacagaaacaggtgaatggataaacaaaatgaaatgttattctgccataaaatggaatgaaattctgatacatgctaccccatggataaaccttgaagacattatgcaaaatgaaataagccagactcaaaagggcaaatattatatggtgccacttatacaatgtaccatgaatagtcaatccataaagacagaaagcggaatggaggttttcaggagctggaggaaggggagaatgggaagttattgtttaatgggtgatacggtttggctctgggtccccacccaaatctcatctcaaattgtaatcccatgtcaagggagggacctggtgggagatgattggatcatggaggtgattcttgtgatagtgagtgagttctcatgagattcgatggtttaaaagtatgtggctcccttctgtctctctttttctctctctcctgccactttgtgaagagatctgccttgcttaccttcaccttccaccatgagagtgtttcccaaggcttccccaggcacacagaattgtgaatcaatcaaacctcttttcttcataaattacccagtctcaggtagtatctttatagcagcgtgagaacagactattacaatgggtatagagtttcaccttggactgatagaaaagttttggaaatagatagtggtgatggctgcaaaacattgtgaatgtatctaatgtcactgaattgtacacttaaaagtggttaaaatgataaatgttatgtatgttttaccacaaaaaaaaaaaaaatacaggccagcctggccaacatggtgaaaccctgtctctactaaaaatacaaaaatgagctgggtgtggtggcacatgcctgtgatcccagctactctggaggctgaggcaggaaaatcgcttgaacctgagaggtggaggttggagtgagccgagatcgtgccactgcaccccagcctgggcaatagagtgagattccatctcaaaaacaacaaacaaacaaacaaacaaagaaaaaacaggaatcgtggatataggggcaggcactaggtctagggctgaagcagagaacccaaggaaggaaccaacttggaaaaaggtctccgcaggaatgagactcagatgccattggagatggtgtggctagagcccgcaggatggcagagaagtttgttgtagtgcttgaggccgggctggcatgcaagaaacccatgcaccggtgggggcagcagggtgggggctgacaacactcactgagaagctgccctctgaggtgcaggcattcactaggacttcacccgtggtatgttactgaaactccggggagccaactgctggagcatttatgagacacactatgccaccatccggggcttcagcagcgtttggtgaaaacctgcctgtggggttgctgttgaatttgctggagagctgactgaggtgctagcagaactcctcaggaaatcaccaggaggagcatccctgggtgccccatgcaccagtcaagagcaggagcaagaggaaaggaaggtagcctcttcttcctgcagtgtctctccagagccctccattgacagcacttaatatcgtgctagcaggcaaagaaatgtttacaggattcatctccagtatcacaaaggaggataacgaagagtggatttggaattcagaggctctaaagtgataactgtcacagcccacccctttggctactcagtttccatatgcaccctcctacacatacctgaacttctatatgacaacgaacaaaatacagctatccttcttaccagggaaaatattcctaccctttctcccaaatgagaagatactcgtgccaacaacaattttatctatctctggctatattcattactcgaatttgatcacagtccctctaaatattctgttaccaaaagaccaaattgtaaagctaacctccaacaacttgtatataaactgataaagggaagaaggagagagagataaaatggatggcattttcccatcacccatctatcagtgggaaagaactctggggaagtgctcttgaggaagtatctttgggaagaatccctgattggccctacttgggtcatgtgtgttggaatctgtgaaagtcgggaattttgcccatcttacaagctagtaagcctgttatggtttcatggatgctggcagatgacatgagactggatcagagacaaaggactacactactcatggcagaacaagttgcacgaggtttgtgttagttagcattggttttccttgtccccaagtcccacaggggtgatgtggaggggcccaggtggttactgtacacgcagtgtgtttgtactgcagctaaggaacactgagcttgggaacatacaatttaatagtaagtggtgagcaagtctgccctttgtctggggcagggggatattgctttgtcaaggctgtctactgcaaacacaaccctgagaaatatcccaagcaaggaacagtcaggaccttgcattcttgtcatccccagcaagagcatgcagagacaatcagagcctgtggcaaattgcctgtcacaaaaatccaccacaaggcctgacagatccttggccaaattcacattttcccatgagtatgctacctcatcagctgctctgattagtctgaccaacagagggaccaaatctgtttaatttgattcctatcacatttaaaattaaggctgctattgacaggacttcaagcaatacagtgcagcaagtctgccatattgatctcacccatgtccccagggtcccgggctcaaccaactgtctaaaagttctgggggcaagggagaccagtcattcctatttcagatagctaggataaaatctaatatcagtctagtattcattatgacccactcatgggagtttagattcactgatatcattgccagtgactacaggaggcaatgtagggagcaaagaccctcatccctgatggaaggacattcatggcctctccctttcaaagagacaatccaaaggggagcaggtcactctagtttggaatttgttgttaaatttgatttgaatcatcattgcattggtttggttaggtaagatggttaaattttacgtgtcaacttggctgggtcatgagactaagatatttggtcaaacattactctggatgtttctgtgagggtgtttttggatgagattaacatttaaatcattggactttgagtaaagcagatgactctacctaatgtggatggtcctcaaccaatcaattggaggcctaaatagaacaaaagactgacctcttccaggcaagaaggaattctgccagcacatgaactttgcacttgaactgaaacagtggctctcctgggtctccagcctgccagcccccaccctgcagattttggacttgccagcctccataatcatggcagcccattccttaaaataaatctcactctctctcttcctctagaatatacatacatatatatatatatatacacacacacacgcacacacatataatattatatatattttatatgcacacacaaaataacagatagatagatatcgtattagttctgtttttttggagaaccctgactagtcctagttgcctttcttttctttttccacttttcttctgagctcatgttccaccttctgatatcttaacatcatttccctgagctcactttatccttttccttcttaaaggcgaccatttcattaagtttttaagtgcctggtaattgcttggttatgaccggtgtctgctccatggcagcctcttcctggtgagtattccacatctgccattggtttttcctatccctttcctacatttgcagagatcctgcatgtcttcctttttgatgactcatctttgaacaagtggaatttttttttttttttttttttgagacggagtctcactctgtcgccaggcaggagtgcagtggcgcaatcttggtgcactgcaacctccgcctcccgggttccagtgattctcctgcctcagcctcccaagtagctgggactacaggtgcccgccaccatgcccagctaattttttgtatttttagtagagacggggtttcaccatgttggccaggatggtcttgatctcttgacctcgtgatccacctgcctcagcctcccaaagtgctgggattacaggcgtgagccaccacacccggccaaacaagtggaatttttcctggaccagctctttgctggtcatgtgggaggagttggggctgtgttccaagtcagctggaatttttcttataacccaggattttacatgtgagcttgatcagcctttacttctcagcttaagcaggtctgggcatgtttggcaacctggcctgcataatgaagatttccataatttggtgttcatctatttattcagtttttgcccgaatgatgaaggaggaagtttacatcttgctccctggggacaggcagagacagtgtgtgcacttccatcctacagggaccagatctgaacagtctggagagaggagctgtggtggcagcagacagatctctgcttcaggggccaggtgtctaggtgagacgccacagcgcggcagagagaacagaggcttctctgcatgcctgccagggaattggcaccatgtcaacagaaatcttaggttacaggaacaggaaccagccctgactgacgtgtgcaagcccggagctttcctttctccttgcacttcccacatgttccccacataaccagcaaccacagagccaccccctgccacccaacaactccctcctgagctagaaacttgtaagactcagctaggagtctgaatggttggatatctaaagcaaagaataatctagtttgtaacatgggaccaaaggaagaactgaatatccacaatctgtgtaaaaagaggccactttggagatttctatgcctctcaggggctctatctcaggatggctcagctgtaattatctttggattcccatacagatccaacttccctggaaagagaaagtctcatgtttgttaataatatgaggaaagaattaaaatatatcagctgctatgggctaatgtcatttattttgacttttcttttgtagaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtaaaaaacaatcatcctcttcattatgggtttcaattttaaatgtaatacatttttagaaatgcctatttccttttataatctctttatataatctaggttattctggctcttaggtcttcatttagctactgaaaagatttgatctcaaatcaatgatctaaccacccatgaccatctcccacctctctccccgtacaccccccagcatgaattctgggaactcaggtaaaatgctttctggaaacctgcctgtattagtctgttgtcaagctgctaataaacacatacccgaaactgggtagtttataaaggaaagaggtttcctttatagttccacatggcttgggaggcctcacaatcatggtggaaggcgaatgagaagcaaagtcacatcttgcatggcagcagggaagagagagtttgtgtaggggaacacccctttaaaaaaccatcagatcttgtgacactcattcactgtcacgagaacagcacgggaaagacccgcccccatgattcaattacctcccatgacacaagggaagtataggagctacaattcacaatgagatctgggtggggacacagacaaaccatgtcaccgcctaaaaccaactcaatagtctaaggaatttgactggggagaatctggagaggatttaattaatttggcaaaaggattagcaattgaatctaagtgagaaaagagaattcttggaggaaaaaaagatgtttagttacactgagaaattaaaacctgaagtaattgcctttgagatttttttcaggaaatgagtattgattgcctactgtgtgtcaaattatgtgtttcatgtcaaagactccaaagtagataagatataggcccagccttggggagctcattgagtcacagagaaagtttgaatgtttcagaggaatcatcaagaacaggggatcagcaatctattatattttaattgcgtcttttcatgattataaaagcaatgcatgcgtgctgaagagaatttggaaaaacaaagaagaaattaaaaatcgtctctgatcctgccaccagaaataaccactgttagcaattgtatcacttctgtaggtctacatggttatcataataagctctagtattgattacatgcatctcatgtaccagagattatgctagactctcatttaatctgtacattagccctatgaagtagggaccatcattctcctcattttacagatgaggaaacagaggcttggagaggttactctgcctaaagtctcatagctagcgagtggcagagattggactcacccaagctttgtcttattctcaagctctcaaccaacccggtggtgagaagagccagcagcaaagcctgtcatctttgtcttctttttttttctaacctcaaatcagggagaaaatgccctttgtcattagaagggcaaggcaattctgaagacagcccagttggcttgtctccgatttggctttcaggggcctgtctgatacctatggagagacgagggctgaacaagctgtactctcaaaacaaaacaaagcaaaacaaaactttagtctctttagggactctctgatagtaatgcagagggagaaaggctttctttgtctcactgggaggaaggttccctacggaaattgaaggcagtgcctgttgacatagcgctgccacctggtggaaataatggtgtaggacatcatgtccagcaccactagcgctgagacactccctgggaagagaaatgtttggagagaaatttgcaagaagttggaagtctcgcagtagcaggtaggaacaagaattataactgctactgtgaccccctaaggctcctcacatcctcttaaggcttggagaaactcacactatgtatattttcctgtatttttgaaaaatgttttcctttatgctttgttgtaatgaaattacctctgatggtcacataccttaaatatttagtatatatatgaatactaaatgtccattttcaggagttagtttacctgcatctaaaatcaggaataggtcacagagtaactgagcaaaaagtgctgttaggtttgtgcatttcaccctttgcctgggatgagaggacctcaatcatcttggtactaatgacaggaaaagtgccctcctatccatgtgtatcggctacgtgactcaagtctccttatttccttttctagcataacaaggggttgttactgttgttttacatctgtgttaatgagataaataagtttaaaataaaaagatgtgtaccaggca

SEQ ID NO: 854 - DNA, 2744 bp, Homo sapiens
ttacatgtctaggctgtgtggttggtggtgaataggcttctttttacatggtgctgccagcccagctaattaatggtgcacgtggacttttagcaagcgggctcactggaagagactgaacctggcatggaattcctgaagatgtttggggtttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatgcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagcttt

SEQ ID NO: 855 - DNA, 2144 bp, Homo sapiens
ggctgccctgacgtcagcatggccgcggcccctgactacccagctcccttctatccctcgagcggcaggaatccgtccccacgcccttttcctttaaagggcaacgggccgaaggtggggcgggcggcgcggctcccgcgatccattcaggtcaaaagggagagtgatcaaacaggagagccgaggggacctatattcagagacttaaccggacacctggacagaccattacaacttgggacttttcaggagaatgagggaaatgtagttattgcacctgagcctcactccagctctgaggtcctcttcacttctctttggaagaaaattggatatcttttcctagttgaaagagtagagatctgatttctccaaggatcatcgctttttgacacgggattattagaagcattcattcatctatcaaggagttttgggatacttgccataagccaagccctctgataggtgctggaaacatcaagctctgtgcccaggaagttcatccttggactgcacgcatgaacgagtttgctgtcttcccattggattcagccagtccgcggtcctggagcaaattcaggacctgacacataagaactggtggagaattacctgcagaatagatgctgaatctttgtgcctctctgctctccaagaagatggcatgctccttgatgacaagagccacctctgatctcccccatccagtcaaaatcttccagaaaacagaccatcaatatggatttgcagcatgtattgtgattgtttaacataattttccaacagccaattatgtgtggccactatacgtagatatttctttagctcatattttaatacctgtcctgtcattctacattacatatgtggaagacctttaacccagtttagtttatatataataagtacaaaagggaaaaaagaaagcttccttttttcacctctttggggacttcttcagtctttttccagatgtggaatccagatcgtgttattttctttccagactgggcctaggagcaatacgttaagagtcagcaaagcctcaagaatcatccagctcttcagcaaagcctcaagaatcatccagctcttttctcctcttcaaagttgcccttcttttctctgaacattaatgtatctctctgtatcacttatccattgctgtgcagcaaactacctcaaaacctagcactttcagtcagcaaacacttatcagtttacagagtttctgagatcagaagtcaaggagtggttcacgtcggtggttctggctcagtctctcatggggctgcagtggaggtgcagaatctgacggggctgacgattcacttccaagctcacctcactggtgcggctgttttcaggacaactcagctccctgccacatgggcctctccatagaaagcttataacacagcagctggcttcccccagagtaagtgattcaagagagcaagccaccaaggctgggtgcggtggctcacacctgtaatcccagcactttgggaggcggaggtggatggatcacctgaggtcaggagtgtgagaccagcctggccaacagagcgaaaccctgtctctgggaaaaatacaaaaattagccaggcatgatgtgatggtgggcgcctgtgatcccagctactctggaggctgaggcaagagaattgcttgatcctggggggcagaggttgcagtgagctgagataaaaaagagagagcaagccaccaaatgggagccacacacccttttataatctggtctctgaagtcatccattgtatcctattctgtagaagtaaatcactaagtccagtcccggaagggcaattagactctatctcttgaaggaagaagtatgaatttttgcatggacagtcatgcactgcctaatgacgttttgtcaatgatggaccacatatgtaacggtggtcccattagataataatggaactgaacagttcctgctgcctaatgacactgaggccaccataacatcatggtgcaagacattccttatgtgtttgtggtgatgccggtggaaacaaacctactgtgctgccagttgtacaaatgtctaggccatacaattatgtacagtgcgtaatacttgaacataataacaaatgactatgctacta

SEQ ID NO: 856 - DNA, 269 bp, Homo sapiens
ggagctggaactcagctcgctgaccccaagcagtgttcccttcttttcgccaggtttgcatccaagagaggggaggacaggggcaaaaggatgcagggaggctgctgatttccactgaagagctaatttcctgtgagacattaacagtgatttaagaaaaagattcctgtaactgtaatgtcttacaataacagaatgcaggagagcacatatcaatgaagaaaagacaaaatgtacttatccatgaagctgaggttaagaaaccagtg

SEQ ID NO: 857 - DNA, 516 bp, Homo sapiens
gtttattttgaatgaaacgggatcttacactcaatgagcggtaggtttagttgtgctttactgtttgattttgcatctgtatgcctgcatatatcctctacaagagatattctatctctgttagaaatttattttctccatttattaacaaaagactaatatatattgagactatcataactttgctgcttttatagatgctattctaaaaatgtgaaatatgcctttgaactgaattggaaacttttattttattttttatttttatttttgagacagagcctcactctgtcacccaggcgcgatctcggcttactgagaactctgcctcctgggttgacgccattctcctgcctcaacctctactactacaggcatggtggcaggcacctgtagtcccagctaatcaggaggctgaggcaggagaatggcatgaacccgggaggcggagcttgcaatgagcccagatggcgccactgcactccagcctgggtaacagaatgagactccgcctca

SEQ ID NO: 858 - DNA, 572 bp, Homo sapiens
ccctgtgcaggacgccgacacgaaaagatgaagagttcaatccgtgctgtctgaactcacagtgtagcaggcgagatagacgggaagatcggtagggtgggagatgccggaaaggcttcccgtgagactggataagaaatcaaaaatctggtgaaattgccggcaagagggagttaaggacattccaggcagaggcaagccacataatattacctttggctgatgatctattctgtaggaagtctgctggaactggcgtatctctctgatgatgtgtgatatctaacagagaaaaaaacaaaacaaaatgacaacaacaaaagcaaagaaagtcatagcctgtgttttctagagggcatggttcagaattctttcccttcagatgtggaggcctctgcacttctggttcagttccaatagagaaaagatttgcttctagtcttctggcgatgcttgggcattgatgaacattccaggatcctgggttccccaccaccatcactaccacgtctatcagcagtatcaccagtttaataattgtgcatttataatgacacaccaaataaaaggaa

SEQ ID NO: 859 - DNA, 1342 bp, Homo sapiens
ataatcaagtcatttctctccctaacaagtgaggattacaattcaagatgaggtttgggtaggaacacaaagcctgaccctatcccacagcatgtccaggctgccctagcaccacccaatagaagggaaaatggcagagggaaagtcctagtggaaagagacctcagtctcagctaattgtggtgacaatatattgcttttgcaaattgtacataaacatatgaccaggtgaatgtatcgccaaggctcctgccaaggcctgggatggaggcctagagaagatgcccgaaagtttatgctgtgtgagcttcacagaagacctgccttccatgtatacccattttacaggtgtctgtgcggtgcagaaactgtacaactgtatacagtgaccatttctactctgggtctctaaacaagggctggtatcgttacagagactgaagactgaggaagaccatctctgtaggatgccaaggattgactggagaaagtctggaattttccacaaatgagttcatttataaagagaaaggcaagctttgatgacaacaccttcacaaaatggaggcctttgaaaacattggtctggattgaggagttggagaagaatgaagtgcacatcaaccaaacagaagagaagcaatttggaggaggaaaaaatcagttcttcatgaaaggatcacattgatcttggttcatcccagtgcctcctctgcagacaatcttgtcctcagtctttcaattgttttcttcccatgccctgacaagcgaaccagatcaggaatttaggagcagcttacctaatggcacctggttacctaatggcaccctcaacagcttacctaatggcaccctcacttggttctggctccgggcctctcacaagattgtacacatgatgatggccaagtttgcagtcatctgaagtcttgactggagctggagactacatttccaagatggctcactcatattgctaaagcaattacagctcactgcagccttgacctcccaggctcaagcaagcctcctgcctcagcctcccaagtagttgggactacagatctttttcaatgcagaagcttaaagaagacactaaaaaatgtgtttaagatctctttaaactgaagtcttctgaacaagtgaagcaggtacatgcctgggaagacagccagggaacaggcagctacatcaaccaagaaggctgacaacatgttccatcccacaactatgtggtaattgcaaagatgagaaaatagcagagatcctccagtcagccctggaatgagtttaggggagagaaatcatgcaatctcttagtaacatggcatctgtaaattca

SEQ ID NO: 860 - DNA, 4374 bp, Homo sapiens
ctctccaggaacagatgtcctgcgttctaaatgaagagtgcagagcccacagcaaacaactgtccccagcagcccggatccctctgacatcagcccccaggaatgtgctgcagaccctctagcacgttcaggcctcccaggggataccctcccctcccctcctccatcccagtgtttcactggggacaggcctctgagctgcagacggaggcccacggagggtggaagacagcccaccccgctccagacctggagactggaggagtgactggagtgagtgaggcagccttgagtggagtggagcgggaagcctgcctgtgaaagaggcagctaggccaatagctggactgtaggaagaacacggagctggactgattcaaccaagagtcctaccgaccggtgctccccttgccaagagtgaaggcagatgccgtgggattctgccagctgctgagtacatctatttccatgatgctttccggaagtggggaaatagcacagaatgggtttcagatggacgtaagctaaaaacccataagcccccactttgatgttctgggtctcctagaattactgtcagctcagaaccagtggccagtagtccaaaagatctgattatttccttttctccaatgcacgctcatcctggtgaaaggtgtctttggagaactgggagaaagaatacagtatagatttctggcaggctacgagggtgcttccttgagggtacccagcctttccctcattcaagagcttccagtctgataaaactggctcaagtacgggaatggattgaggggtcatgactctactctgcttttatgatttgggatagacttttgtttgcttgacctagaagttttctgcttatacagattaagtacgaacttagtaggcttcctgtctatttcacttcgaggaacatcatgatcaaccagccaacaccacaggtctgcagcagtcagactgatttctgctttgactccactgtccaatagggtcagcacgtccaccttgcctttggtagtactacagccacggggcccccgccaccctggagccaattactccggtcgcattcaggttactggttcagtggctgctgttcctgctgtgaggtctggccttcagagaagagtgatcacagctcctcaaggaggctggagctcctttcatatatttacttctcaccatcaaggtgaaaggcatgtcttcaggagcttcccagcgtgggtgaggaggtcttaaagggaagccaaacatgccgcagaccacgcgggaattcttggccgtccagtgcttgtcacagatctgcttccaggtcttgccctccttcacctccacgtagccctccatcactggggtgcgcttgcgtccttcagaaaagcaatgcattctactgcttccacgatgtaagagaaaagcaaataaaaacattcccattggagagattagaaaaccaaggaaagaaacggaggctcttcaaggtcgataagcaccccggggccagtctcctgacgtccaggccctgctgaaacgtgtctgttctcacggctgctggtcagggctcaaacgacagcaccttggatccattgtggagaacaaagagctaattgaaaacatctgggctgaggttttccaactggcttctcattttggcccggtttccaagcagtcaagctccactgaaacatacactccctaatcgattgctgtctcaacaacaaaccaatgtttgtcttgctaagttactagcaacagggaagaccctccatgttctaagcggaatgttctgtcgcaaagctgccaaagtgacagagatggtgaaaagcagtggcaccctattccatctgcagtgagagaaacccccctcgctaaggacctggaagtcgaccagtgcatcatcaaaggaactgagaacagctgcaaaccagagaccctaaggagcctgccccaaagagctgctctcttatgaaacttccatggacccccaataatcttccatggaccccttccacatatgcttggtcaatttctacttagatggcagatatgtgaatctgtacttagcccaagacagcatcaccatgcatggtatactcgtttggcctgatttcataacaaaattttttttgttttttgagacagtgtctcactctgtcactcaggctggagtgcagtggtgcaatcatagctcactgcaacttccgcttcccaggttcaagcaattctcccacctcagcctcccaagtagctgggaccaaaggcgcatgccaccatgcccagctaatttttgtattttttggtagagataggatttcaccatgttggccaggctggtctcgaacacctgacctcaggtgatctgcctgcctcagcctcccaaagggctgggattacaggcatgagccactgcaaagggcccttttttttccctctacaggcttagtgcttattaactagactactccgattccaatgcaaccagcttctgggtctgcctgctgaaaagcagggcggttctaggtacaatccagtagatgcctcctcagagctgccaggaaagccgtgtccttgggacacaagatgacagtcaaactttggacacaagaaagccattcaatcagaagccaaattttatgttactctttgcttccaatgcctctcctgatgaaagaagagataaatatatatatacaagttaacagatcattaggaaggtgaaaatcataaatgaaattcagttggaatgccagagcccaggacaatggatattattcaagttagactgtgtggggtcacaaatgggtgcagtgggtcacgcctgtaatcctagcactgtgggaggccaaggtgggcagatcacttgaggccaggagtttgagatcagcctggccaacgtgggaaaaccccgtctctactaaaaatagaattaaaaaaatcagctgggcctagtggcgcacacctgtaatcccagctactcggggggctgagatgggaggatcacttgaattcgggaggcgaaggttgcagtgagcctagatcccaccactgcactccagcctgggtgataaagcaagactctgtctcaaagaaaaggaaagaaaaaaatctgtggggttacaacaatgtggttatcgctggcttcgtcgctgtggtctaaagaatgagggatgtgactgggaataggcttagcctcctgattctgaagacaggtgaaggagagcaaccaccttagcttcagctgctataacctcgaacaggggttgagaatcaggacagctgctccctccagaactccctaaaagggcctgtggtttacctgagctcagagatgctttgggagaacagtctgtgaacaggccaggctagaaaacccagaacgtccctggtgccctccctggtttcactgctccagcctgaagttcagaggagcttgaggggtcctggaggggcagtcttatccacggtctgaccggcacgttaagcccctaagccccaccggagcaagccctgggcgctggccactttctgtgctcactatacccagaactcttttgccaactctttttcctattctgccaaatcaaaatgaatcaattagctaatattcactgagtgcccaccatgtacccagtgataaagatctggactgatgctggtgaaattcaaataaatttagatgtaaaaaggtctctcatgtcataaacgaagcaccacttcacgtaagcagcttaactcgtaaagccgtgaacacaagacagagttttttttttttcaagcatctgtttctttctcctctctttgatgttattccttttataaaccttgatgatttccatgtccacaaagatgacctttccagtactcctggtctcttcgttaatacacctcctctctcagagactgtcctccatcctgctccagccgctgtcccatggtcatagctcaggtctctcattaccagagattgcacccacccttcaatctccatttcacctttcctgctctgcacccacacacagctcccttcatcttttagtaaacttcttgtatctccatctgaacagagactcgcaatccagtgatcacagcagctatgcacaatccttcaacttctccacttattacaaccctccttacccagcacagtctccttggaccatgagtttaatccttccctttcatattccctccactccttggaacttttcactcttcaccacgcttggatggcaaagtcccacctgggtaaaaacctgtctcctactaccccgtgcctgctcctgatagggaaaaaccacaacccccttgtctgacaacaggtgttttaaattgaggttgaaataaaattaagttgtcactggaaaaata

SEQ ID NO: 861 - DNA, 442 bp, Homo sapiens
cagaagtctggcaagaccaggaccactttcccaccaggcagcaattggctgaagccaaggagcagctgtgctctatagacaagtcatgtgcctccttgcctgctacagggcaggcccttcctgctgctcctgcctggccatagtcacttattggagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggtaaagttgtgaaagcctttctgaatagcagcaacaagatgagaaatgtcacagcgcaatgaattaaactctggctgcgtatta

SEQ ID NO: 862 - DNA, 974 bp, Homo sapiens
attagggctctggtggcggcggcggcagacacttggggtctggacgcaacggaggcgggagcgtgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgctttctgtacagcctgcagaactctgccccagagcacatcagctatgtgccccagctctcaaacgacaccctggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccaggccagaggccagctccatgtcctccgtgttggcaatgatacccactgccaaccaacaaaaattggctgcaaccatcccctaccaggaccgagcccctacagggtgaagttcctggtgatgaatgacaaaggacccgtggctgaaacaaagtggtccagcaacactcgcctgcagcaaggacagccacagtgtggaagaccctgtgccccttctggggtgaggagtaccaagtgcacctgccgcccaccttccacgctgtggctttctacgtcatggatgaggatgccctcagccgggacgacgttatcggaaaggtctgccttacaagggacaccatagcttctcaccctaaggatcatgaagaagtcatgctacccacgctggaatgagacgtttgaatttgagctgca

SEQ ID NO: 863 - DNA, 640 bp, Homo sapiens
attcaccaaatgtccaattacatatcctccctgcctggaccttcagaacaatataaaactgaatgaaggctatgaaagaagtcacaggaggatttttgcagagcttccatccagttcagaaacaaagcaattcaatacatgtcttcaagatttctaaaggcaatgacttaattctaagttccatgaaagcaggcattgtgtgaatttctcctgcatctggaactggcctagcacaccaatagaaccatggagaattgccaagattgctgactagatgtggccaggagaaatatctcccactgagagactgggacattggaaagactataacacacctctgagtagatcttctgatggaagacattaagagtggatgcagagaggatgcagatgctgggctgaagagagaggaagctggaaaccctgcatagtgtggctgagcctcaggacttgtacctggccctcagagactcctgggggaagggtgagtttacaggtgaggagtggcctgctctcaccatggacccattctggtaggtccctcaacctctatgggcatctgagatggtaggaaaagctgctcagagaggtcatatgggcaggactccagcctatgcagagcccagagtggtgggagaac

SEQ ID NO: 864 - DNA, 674 bp, Homo sapiens
tgaagaaggtgcttgtttcccctttgccttccgccatgagtgtaagtttcctgaggtctcccagtcatactgctggttaagcctgcagaacggctggtcttgaactcccagcctcaagccatcctcccgccttggcctttcaaagtgctggattacaagcgtgagccaccgtgcacagccaagacacaattttaaatcgagcggtcaggaagcctcctggagaaaatgacgtttgaacaaagacatgaagaaagtggagaatatttggagaaaagcatttcaggcagaggaaagtgccagggcagaggccccgaggacaggaaaatgagacccacagaagttcaagtcaccaggccagttattgttgggctagcacttgaagccaggtctgcctgaatttagggcctcagctctttcccacgcatttttagcccagaaccaagctgttcataaaaggtgtgcctgcaaataggaaactagagagcatgggccctcagagagagctctgaaccccatcttcgacctcgaacctgtccttggactgaacctgtctttaggaggtctgcccatacggatgaatctggagcagaggccgggctcagcaggagagcttcacaaaactgagattcgatgaagcagagccccgttttaagggctgcacaaatccacccgga

SEQ ID NO: 865 - DNA, 3472 bp, Homo sapiens
gttatttgactggagtgaggtctcatgtctgcttatgcggtggctcgctgctcagaacaggatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaa

SEQ ID NO: 866 - DNA, 863 bp, Homo sapiens
ctcctgggcacagagctgaaggggaactggaggctgcggcgttcctctctccgttcccctctctctggtgactcgtgataacgaaccgaccttttggagacattctgtgccctcaacaaaagcggcccctgtctggaaacccccccgagggagactgacttcctcccctgctgcctgggctgcggtagctcttccggcacctgctcttcaggcacctgccctgtgctggcccctcctgcaacaatcgggagccctcacctcagtcggcgctgcagaaccagcccaggagagcagctggcctgtcatctgctgaggagcggaggcgtgcggggatccggaggggaagggggtctggagtgctccgggggagaccctcagggactgccctgctgctggcagcgcctgggcccacggctgatggaggcgtctcctggcccccagggctgtgcccaggactgcaatggcctcccacactacctcactaccctggtccaggctcactgacagatgaggaaactgaggcaggggccccggtctcacggccattggtgcagagctgggatccacgaccaggtgggctctttgttattacttcctccaaggacaagcccaggttctccagggtgtggggtccacgtgtggccacagcgggccttagagacagacaggcctgggtagggggaggggtgggtgggcaaggccttagagacaggcctggcgggggaggggccgggcctgtgcactggcagtggtggcaccacgggcccttggggacaccaagtgagctctttaaagtggctaaagtggtaaaccttgtgttttgtatagattctaccaattaaaaaaaggaaatgtgggccggg

SEQ ID NO: 867 - DNA, 5637 bp, Homo sapiens
tgctggggtagcccagcctacgcctccgggggccttcagggaagagaaccagctaaggctggggggaccaggagaagggtcccccaaggttggaaagtgcatgcaggaggatgctcagcaggggctgcaacaggggggccttgggagcccaccaggcagggatcagcaaggggtctcactcagcgagggactgcaaagcctcacttcagtctctaggtccagggatcaggctcaccaactccctgcagaggccccagcagcaggggaccgcaggctcacagcatggacagtgggtgatatctgttgtaagctctcctcttccctctcccgctccccatggcctccgctatcagaacatattctgcctcttgcaatatggacagagtgggtccttaaaaaaaattacctaaaatgttagctcagggttcacttccagaagagaaaacaggtgtaaggggttctgggacaggcctgtggaaatcgggagtgataccaaggctgactgtagcattggggataaaaaggagggaggagtcccagagtagggtggggaccacataggacaccacttccttagggcccagacagaggcaggaggtctgatatcagcagtcagttgggagttcctaggggtctggggtggtggagagagaccttcacaagttgggcaggctgctctgcttcaccccagattagagggcactgctggacacccacatggcaaagtggccaaatcccaagggaagacccaaggagccgagttgaaactgccccctgctcctgaactcaggggtcagcgatattgctgctacttgctaagcccagttgcccctgtgttatccactcccccttggagacctcggggcagcatagattccccccacccaggacttggaatgggtcatcattcaatgctatttaattccaagggtagcctggactccagacgacacattcttttactactcttcctactttcccatcctaaattaggtccaacctcaaagttcaaatttgagtcagaggttctgcagatatataagatgccagatacccagataaaaagtcaacctagaaatgtctttcataaatttcctagggtcaaattcaagtcaaaaaattaagttcccttgtccttttaggttaaagtccaaagggaaaaaaaagtcttaaggtcaaaggattcaagcccaaagcaatcaaagagagcccagggatccgtcagagcccagtggtgttaacctcctccccgaggctctgtgctcacccagtgagcaaagtggcccagtaggcacgggagggctgggtgtcctggaaagtgagatccttctctccacatctcagcattttcactagcctgccatgtgctccagttttaaaagacccagagttactaggaatgagcagatggtgatagcctcagcctcctgctcgccaaccacagggaagtccttagagcagcatgcaggccatgagatgtctccaggatcccggacccagccccatgtagccctctcttcctgctacctcagtactccagcaggaatgccctggcagctgatggaaagagagtagacagggaagacaaaccctagaccccacagcatatctaaccaggtggagggttagcattagccctggcgaccccgctggggtggagcaggaagcaatttctgctgtcctcctccctgagcgtatctgtacaagcagtcatcacctgcctgggtcttatttataataccttctccttttcatatgtgtgaaatctcatcatttccatttccctctgtatgcccattgcatggatgtcttcagtcctaagagatcctgccccagtcagtgcagcacagcccagcaggttgctgagctgagcaccagggagcagtggctgtgtcccactggctctcaggacactagctgtcctccactggggatgttcccagtcttgagcagcactgtttctgcagcacagttgtcagcagttggggacagatgtccacagctgtgcttcctcatgcgactgctggcttgcatccccagcatggctcagctggggccctggcagttgtgctggctgctggcagtcttcacacacagggctggtcatttgtgttcaaccccagtgccttccctccttttactttctctttgctttccggcccatatatttactttttctgatctgttcctctagattttgtcacttgggggtctcccctggcaacagaaaacaaaaccaggcaatcccaggtttgccacaagaattgctgttgaaacagtcccacagctgcgcccaagagatggcggccatggccatcagcctccctgccgtcagcccctctctcctgactggctgtgctctcctcagggaggactccactgagccctccttgacacctaatccctacatttaaaaaatgcattcccttaggtcctgagcaaccccagacacccacccacagtaactatgctgtccccaggtatacctaaaatattttcaatgtttgatgctgatcttctgtcctttaatttgcccaaattccctacagcctctgagggctgccctggctcatggaatggcttctgattcttacggagttgctgtctgcagcattgaatggccccccctcaagagtgttctgggtcacctggttccctggtggtgaccttgtctgttcccaacgtctgccctcccctcacatcagggagctttcctgtcccctaagttggtctggcccactccagggtcccatgatccctcatctctgcacagcctgcctcctgacaccactgctcccattctaagggtaagactgtggtgtgtttttcaaaccattccagttccttctggatctcccaagtaaacccaattccctgggacagacggttctcagcacaagccatttgtatggcccttgctagctttggatgcgtattgatttcattgtttctctatctcaacccaagaaaatagcatattctctgaagggccctgattccttttaatgctgttgtccattaacaaactcttacctttctgtgggcaaagccacgactttagtctcccaattcctgggtcaaaatgtacgtaatagccaggcacggtggctcatacctgtgatccctgtaatattctgggatgccaaggcgggaagatcacttagggccagcctggggaacctagtgaaatcctgtctctacaaaaataaaaatataattagctgggcatggtggcacaaaactgtagtctcagccactcaagaagctgtggcgggaagatggcttaatcccaggagttcaaggttactgtgagcttgattgcaccactgcattgcagcatgggcaacagggagagaccctgtctctaaaaagaaacaacaaattaaaacaaaatgtatgtaaggcacaaatcgagagccaagctgagccgcacaaggggactaactcagcagacctagggatgtgtttcgtgggctcaggagggaccctccccagtccctgttctggcaggaggctttgaggacagctcatctggcacaactccactgtgggtggtacaagactcataccaggttgcaccggccccttgctgccttcgcagttggaagtggtgatctcagacctggctgagaacacagtaaaggcagcaagcctgggcctgccctcctccattcatgcctcagaggttgggacccttctgtagcctcctctgcactgtctctctttggattaataggaggcccgtgcaggagtcagagaacacggctctgagctgtgaccatccccaaagcactgccctgagttgccaaaggtcatatccccacatggaccttactttataccagcaagatggaacctccggcctgggccactagttaaaagccaaccctaagactgtaaggatcagctcgtggctccaaagctctgtggggaactgccaaggccagaagccagtgtggtccctgtgaagcccccgcgcacacaccaggcatccccaaagcctcagactttatgtggttacttgaggactcaaagctcaaagcctctgctggatttaagggggcttaaatagaacacgcctttcttcccattccaatcctggggcctccaccacagttgtgagggtcatagcacatgccagaaggcagggagcacacagcaaagcagggcccagaaagactgagctagacggggggcgctaaggaggtgcttgtttagggacataagcacctcatggggaaacaaggaggtgaggaagaacggcccccactcccagcagaaacactgtggtgggaagctcagggaggctgggggtgggctggggaagaggccaacaaagtgggaacagccctccgtatgggccagtgtctggcaaggtcttagtgggatggggcagttgggcagtgcttctgcatggcacggtacccaacggtcggcctggtggtggtgctcttcacttcctcttcactcccttctactgtgcatgttaacttttgtatcagggagtatgagatatggaaaaatgcataaatgcataaggtttaataaatatatataggcacttgtaagaacagagagaaaaatactgcagcaccctgccacctcccaaatgcccctggccagtgggaccgctgtcctgacagtgatagaaatcatttcttggctttcatcacaattttcccacctacacgtggtcctctgaacagtacagtttgggggtccttgttttcaaactttatataaatggaactgcattatatatatatatcttgtggcttttgctcaatatgtttatgagatttgaccgtggtgatatttgtacctatagcttgttcatttcactgctgttgaatattccatgaatgaacaagcataatttatccaattattgatggacattgggttgcttcgagatacaagtttctccgggataaatatatcgaggagtgggattgtgggcacgttacagctgaggaggttagtagtggtgtgtcatggtggttcttatttccctgatttctactgacgatgaacaacttttccattggatattctgttttgtgaagtggcttctaaagtcctttgctcatttttttaaatagggtttcctaataatgtaatgttgagataggagatcagcagaacttgttttccaagcactggtcaagaccttggtcatgatcccgctgatcaaaacagaatctggtcggaacaggatgcagtgaagaaatcagctgaaaccagctggaaccaagatggcaacaaaagtgacctcacttttgtccctcactgctcattatatgctagtgataatgcatgctaaaagacattcccaccagcaccatgacagtttacacatgccacggcaatacccaaaagttatcttatgtgatttaaaagggggaggaaccctcagttccaggaactccggatccctttgctagaaaattcatgaataacctgccccttatttagcatataataagaagtagctatacatatagatagctggtagtccaggagtgctgctctgcctatggggtagccctgtaaaccccatccacctgtatggatgctctatgaaacccacttttctgtactctgttgctctaataaacttgctttgctttcactctt

SEQ ID NO: 868 - DNA, 2859 bp, Homo sapiens
ggagggaggtaaaatccccagacctgaggactcgaaggggcagtcaaggagaggatagctcttctccagagcttaaaggcaaatattttctttttccctggtttctcaccttattgctttgtgtactgagtgaacttatttgtttttgagatccagtaacccatgcaagaaatttcataacacttctcatttagtactttaatactagttgaagaatctagggttacacacacacacacacacacacaccaggcttagttccattacctatagctgtaaaaatgagatttttttctcagttttgtgaaaatgaaaggctgctggactggaactcacagtattgtatatcaaaaagtatcagattgtgataaaatagaaacccagaattaaacttggccttatgatttttagaaagtcaacagattttgaaggagcccacccagtgtattcatttcatttttactaatcctttctttcatgctaagatagagatgaaaaagaatgacagacttcctgttctcatttcattacagcaaaataaataagttttagtgttccatagctctgtaggatgactatagttaaaaataacatataatttcaaatagccaggaggacattgactgttcccaacacaaagaaatgataaatgtttgcaatgatggatatgctaattacactgatctgatcactatacattgtacatacataaacatgactatgtacctcatggatatgtacaactgttatttgtcagttttagaaaataaaaaagcagaagagatctgctaccaaatgcaggaattttctatagagtctgttatagctagccttctacaggcttaactcttctcatgatggagtattgaccatcaccaacaggaaatcttttgttttaggcactccaggaaattatcagggagttctctctgtagataaccaaagtttccctagttgtacttctacccatttttcttagtgtgatcatttaaagcagtgcctcaccaactatcagagatgggggccagtaatttttgtttcatttttttccagttcattacaaatcaatgcatatgtctgtaaaacacaaaatcacacccttaaatgtgatggcaacatcaaattgccataaaagtttctaaacttttcaccccaatttctgaatttatcacagactggtaaaaaacagctcacaagccagcaccacgggcagaccacactttgcacagtgctcaaacgtaggcctaacaacctggcttggcttggcacttctaaaaaccgatcctgaggcaaggcttcttgtaaaagagtttatactggaagttaaaaatcatcaaattattagatactgggaatggagtagtaaagtagacagagcagggaaggaataaagtatgaattttcaagctggttacccatctgggcaactggagctcagttttgctgggaaagtctggaagacagtgtcagatataactaagagttattcccatcaaggggaaaggaaactgtgcttttcatccaccaaatccttgcttaacattggaatacagatgcttccaagacattaactttgtggcacttctggcttttcctacacacttattgtgtatgccaccatgtctagggggaaaaaggcccacaggcaaagaggtaccagcattcataccaccagctttcagcttgtagaggtggccgccaagaggaactcgtagttggcagtgccaactacaactactacaccaaccagctggaaactatacaaagagtatgaacaaagttcacaggagaaacaaggctctgcaacatatgaaaatatattctacttcattcataatgagacgcatgaaaattgtaactgtatcaataccatttctcacctagtagatgggcaaaaatccaaatgtttgagcacacattctgtgggtgaggctgtggaaacgtaggttcacatacattgctcttggatatgcagattaggaccgctcctgtggagagcagttagggaatatctttcaaaattaaaaaatgcagagttaagttttgatccaggagtctcactcctgagaatttatgctatagatatgcctacaagcatttgagatgaaaaagaagcattgctatttgtttttcttgtttttcatgaataacattgtaaaagtagaatatgggcagtgattcaagcattcatctttgggactggttaaggaaactatgatgctttcacagaatgaaattctatgcagctgtttaaaacaaaccaagacaccttctttcacatatatggaaagatgtccaaaatatactgttcagtttttaaaaaggtacaaaataacatatatagtatgattccttttgcatatgtgtatttgcttttaattgcctaaagaaactctcagaaggattcaaaagatccataccaaacaagatgggagaacagaggagtagtgacaggagtagaagcactgtagaccttttcatatcattttggtttttaaattacatgagtaggttacctaattattaaaataaatttaatttaaaaggtaatgggggataggaagaaatttgttaaaagatacaaaattacagctagataggaagattaagttgtagtgttctatagctctgtaggatgactacagttaacaataatatatattctaaatagctagaaggaggatattgaatgttctcaacagaaagaaatgataaatgcttaagatgatggatatactaattaccctaatctgatcactgtatattttgtgtattgcaatgtcactatgtaccccataaatatgtataattatcgtgtgtcaattaaaaatttttaattaaaaaattataaacaaaaaa

SEQ ID NO: 869 - DNA, 618 bp, Homo sapiens
cacttgtaatcccagctactcgggaggctgaggcaggagagtcagttgatcccaggaggcagaggttgccatgagctgagatcgcgccgctgcactccagcctgggcgacagagcgagaatacgtctcaaaaaacaaaacaaaacaaaaaagtgttatttataggaataagaactaaaatgccttgttaatatattgttttggcattgccaaatttagcctatttgagtgcatggattgcatttggggattgctgttttcttttttgttttgtatgtttgctttagatgcgtagacagagggagtggagtaaggctttacagagattactacagaaggcatttttttttttcataaagaggggaaaacgcacccatctcataacaagaatttggagtcaaaacgagacagattccattcctgccttccacattaattagctaggtgactttgggcaaatcacttaacctctaggttttctcatcagcagaatgaaagcgttggcctatagacacccatttaaatccctcctccaaatactcattcgttcgatattttctcagtgtctactaagcacaatcattgttaataaacactatgattcttggagagctccaaa

SEQ ID NO: 870 - DNA, 451 bp, Homo sapiens
gccagctgtcgggcactgactctctgggctacattctcccgtgggttctctttaacccgcttggtttcaccgcaggggaatgctgaagagacacaagtgtttttgttttctctcttaaaaaatacagaaactgtaatctgttttacatctgggtctgactgcagacaagcaagagcgggcggaatggagtgatgggcaatccagctgcaagaagaggtgcatacccctctgtagacagcacatctgtgcaggtgtctaacagccgcctcatggaaggagtcatggaagacgttaggcccctccagttgggatcaagcaactgatgcaagctttggaccaaatgaaacatttcaagaactcagattgtaaaatcacaatcagctggaggaattcggatctgcatctggcccagaagaacatttttgaggatcttttgaaagtatcactaaga

SEQ ID NO: 871 - DNA, 1166 bp, Homo sapiens
cgggcggatcccggagagggggagccgcggggacgcagcgacagactcggggtgctggcagcggcagcccacgcctcccagggattgcaggcctgggcgccggggttggaccagtctcccgggcatggcacgccctggttattctgtacccgtgatttgtggcggggcaagacgttaagttgggtgacaccgaggtgagccacggtcctcggcaccagatgaggaaccactgtctcaataaggtctcagtgctgtgtgtgtaatggttaccgtgagagcttccctgcaatccgaatttgtgtgtctcattctcagtgacaccagtgatgctgttaaacaaggacaatccggttcatggattgtgacaacgcacgctgacatcaagcagaccctgccgtcaggtacagagggcaccacagtgaccaggaactgctgtcctttcataccaggttttaggaggctttaccagaaggaatggaaaatgctggtgggcagtaagattgaaacagcatctgaggactggttctgcacaaaaccttaaattcttcaaggactttgacatttgtttattcttgtaacaaattaaaacctatcctgtgtgttggttagagatcttcaaactgtaaataccttgaggcaggagtgaggtttttatcttttaaaggacaggcccctactctcctacgtaatgagtttctaaaaatggatgtgagcaccaatcaatatttctctggttgttaaagtcaagaataaaatggtatttttaagctcgcaactgtgtaggatgaattctgtacacttttatttccctctgttctcctttcctatttgaaagtttattagtttgtggacttgggatcggattattcatgcattattttttgatgttgtatgtctcttggttcttgggtatttttgacacatattctgtcttgtaaccatagttaaacaattgttttagaccaactctctgtgtgtaattggcttcaacactcactgctagtcctttgacgctctgtttttttccattcttgagtaattttaagtcatcacttgggcagttgaaatatattttaaagtgatttaaagaatatgtgagtggcagacattctgaactcttttggttgtctgtcctcaaaaactaaaacttatttgtgagtaaaatt

SEQ ID NO: 872 - DNA, 1838 bp, Homo sapiens
atgaggaggaggaagcctgaacagaaattcctgaaagggctaagagagactccccaacacagccaagcctttccaaaagccaggaggaggagagaggactccgactccggccacaggcccagggcaacgtgctgggccccggagcgtcctgctccctggggccccagggtaggtgcggcccagctcaccccagctcacggtcacaggctcacatgcagctctcacacagcagcagccaaggcccaggcaggaaccacaggcagggcctggggaacatctctgccccctcccaggccccgtctgtactcgcctagctaaaaagagccactctcgtcattagcagtgtaaaaacgacaccttccctctcagtttggatctggcctggcacacagggtcactgctgagtcacctgtgacttgggggtagggaccagggagggtggacacagttgagtcagaggcaggtctgtgggcagcaatgtctgcctctcccccaaagggagtgagggctgccctccagggacaacctgggcagggagagaagggcccagacctgccaggccaccaggagcactctctacctggggagtagctaggcaaaggacaaatgcatctggcctgtctgtgctgcagagcggggcaaggccaccaaagcatcaaagggaaatggccccaaaaccggctctctctagaggaaagccgaccagcaagctggggttgaagtgtgctgttctcgcctcctgtgcaacagcaactggcaaagcccactctatgggcccagatgagccggcagcatgagaaggctgtgagatttctgatgcacagatgtagaagctctgaggggctctgagaaacttgaaccaaaacacaaaaggggcgtgtgtgacggtggtgtctgcactccctggcgtggtctgcaggagacagaagcaccctgggtctgctgatgccagggttctctcagaccctacttcagcaactggagaggcgtggacatttaaaccttttaggaggccctcaggcctctctgctccacacggaagtcagcagccctctctgctctggctggcttctccaaggcacctcctggccccacctagggctcggggcaggactctctcgtgcagtgagccagcggggtactaactgggctcacttctgacagtaccgctcccagcatgcgctcggcttccagccccagagaccaacactgctaagtaggataagggatccggagccctcgatggcaccctccactcggcagcctgctcccgcaccactccaacccctcccgctcctcaccacgcaaacctgcctgccaacacagcaggggccacagaaagctgccaccagagccaccacagggatatgtaatgggcccagccaggcctaagggcccatcacagggagacgcaagaaagggagcaggtgacagaagcacggcggctccctccacaaagctgcggcccccgcagggctccctccctggtgaagagttccaggaccacagcgggaggggcataaagagccaaacacacccggtcccctcggccacagcaggaccagcacacagttggggcagggcgggcgcatggttcggactgatgctaggaaaaactggtgacaccaggtctgtccactagtctgggcgggactgggttgacgtgcatggagctgggtccccacggcaacgagggcacacggaggcctccacggagcacagagagcaagcaaagcgaccctgaattcctttgtgtttgttactggttttgttctttgtgtggttgggtgttttttttcttcttttcttttaaataaaaatgctgcaaggtttccgcc

SEQ ID NO: 873 - DNA, 576 bp, Homo sapiens
agcttctgctagtgtttaggtactagtgcagtgtagaacccttttctcaggcaaaacctaacatctgaccgcaccctttttgctattaaaaaaaaaaaaaagcttctatttttttcctgctgtcgataagataaattctccagtagacaacctctcccactaattgtgtattagcaacgtattttatcttgagagcttgtacactgggctctcaacgtggtgtggaaggtagcctgttacagtgctggattcataaaagggcctttatggtttgtgaaagaatatctgtgtgcttagggaggaaactttttgatctgcagaaaagccagaagacatctaggacatccataaaaattcatcagagagcattttactactgagctgcaaagggaaaaacttaaaatggatatgaaaagtgaagaaagtgatcataggagaaaaccatttcagatgacaagagcacctcaaaggcagcagcctcaaggagcagccatggccccagacttgtcgcacggatgcagaaaacttaatggaggaggctgaggctggagtgcaatgacgcaatctcagctcact

SEQ ID NO: 874 - DNA, 1333 bp, Homo sapiens
gcggccgctcagacaccggagccggcagcctggggaggcgcgccgggggcggggggcgggggaggggcggggcgcctgagatgggacgtgtggtccgtggctaaaggctgggacggaaaggcgcatgagccaccgccgcgtcaggctcggctatgggtggggggagcgtgatcgcggacccggggtgtggggcgactggaaaaacgggcctctggaccagcacacgccctgtgcggagagacactgtctggcatctcgggatcatgtgaggggctcccactgcccagtcacacgtctaaagcatcctagttcttacctattgtagcacggccggaaagtgagccgccttagctgctgattgtactagagcaggcaatacaagagtcggcccatcctcaaaaccactgataggatgtgagtttcactaaccccgttttacagatgaggaaattgaggcaaggccagggctcacacctgtaatcccagcactttgggagtccaaggttggagggttgcttgagaccaggagttcatgaccagcctgggcgacatagtgagacccccatcttcccaaataaaaataaataaatcagccggacatggtggcatgtgcctgtagtccctgctgctcagaaggctaaggtggaaggatagcttgagcccaggagttcgaggctgcagtgagctatgatcataccactgtactccagcctaggtgacagagggagaccctgtctcaaaaagaaaagagacttacacgaggtcacatagctaataagtggcagatagggaagagaacccttgtccctctactttaaggccctattcgcttgccccattatcccatgctgcctctctaagagccagagaagtaggaggtagaaaaagagcatctctgcagctctgggactgatgatgtgaatgaactgggtagatggtaagtgtgtaactgggtgatcttggacatgggatggggtgggtgaggaggcttaccaatgctgagaggagtggaagctccaaccccagctaatgctagacaccagactccaaatttaaacacacagtggaaactggcaagaatgaaatactgacttcaatacagatttcaagagacatgacattagcactggtggagaatggcaagcctaaggttggaaaaggttcagggaaggaagatgaaggtctgccatgttctactgaggaggagtttttcaaacagtggggtgctgtctgcaatgtgtacagccttaaaattattatataagtaatcaatactcattgttgaaaaataatatatggataaacaggaaaaataaacaaaaatcataatcca

SEQ ID NO: 875 - DNA, 2348 bp, Homo sapiens
agttagaaaaagcccgggctaggaccgaggagcagggtgagggagggggtgggatgggtggggggtaacgggggaaactggggaagtggggaaccgaggggcaaccaggggaagatggggtgctggaggagagcttgtgggagccaaggagcaccttggacatctggagtctggcaggagtgatgacgggtggaggggctagctcgaggcagggctggtggggcctgaggccagtgaggagtgtggagtaggcgcccaggcatcgtgcagacagggcgacatcagctggggacgatgggcctgagctagggctggaaagaagggggagccaggcattcatcccggtcacttttggttacaggacgtggcagctggttggacgaggggagctggtgggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctggggggttatgggcccgttccaggcagaaagagcaagagggcagggagggagcacaggggtggccagcgtagggtccagcacgtggggtggtaccccaggcctgggtcagacagggacatggcaggggacacaggacagaggggtccccagctgccacctcacccaccgcaattcatttagtagcaggcacaggggcagctccggcacggctttctcaggcctatgccggagcctcgagggctggagagcgggaagacaggcagtgctcggggagttgcagcaggacgtcaccaggagggcgaagcggccacgggaggggggccccgggacattgcgcagcaaggaggctgcaggggctcggcctgcgggcgccggtcccacgaggcactgcggcccagggtctggtgcggagagggcccacagtggacttggtgacgctgtatgccctcaccgctcagcccctggggctggcttggcagacagtacagcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcgggcggcgacggagccgggatcggtgcctcagcgttcgggctggagacgaggccaggtctccagctggggtggacgtgcccaccagctgccgaaggccaagacgccaggtccggtggacgtgacaagcaggacatgacatggtccggtgtgacggcgaggacagaggaggcgcgtccggccttcctgaacaccttaggctggtggggctgcggcaagaagcgggtctgtttctttacttcctccacggagtcggcacactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctggaaggtgaagctagaggaaccagacctcatcagcccaacatcaaagacaccatcggaacagcagcgcccgcagcacccaccccgcaccggcgactccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagcaa

SEQ ID NO: 876 - DNA, 438 bp, Homo sapiens
ctcgcgccctcttcaggaggggacagctgagggacctgtgcacccccaccccatcctgatatggaaccacagggatgagagatcagatgcccccctgtagccatgggccgtcggaggagagggcggatgatgggcatccctttgtgccccaggcatgaagggtctgaggctgaattttcgaggctctcggttgtctttttcctctccttcacctttgggtctccccacggctcattagggattctattggaagagacgcaaggaactcaaattccacaatttggtttctgtggagaaggtttaattaggagggtgtattaacttaattggctatcatcaggcttccagcttctttgtgtattttaagtaattttctctccttttttcttacagccagtagagcatgcctttaaaagattaagtcttttctttggtctc

SEQ ID NO: 877 - DNA, 2362 bp, Homo sapiens
aacatgagcaaaagatacaaagcaacatttcactggagaagatatacagattgcaaataagcacatgaaaagatgtttgataccattagggaaacgcttctttaaaccaggagatatcaccacgtgttagaatcaacaaaataaggccaggcatggtggctcacacctgtaatcccaacactttgggaggctggggcaggcagatcacatgagatcaggaattcaagaccaacctggccaacatggcaaaaccctgtctctgctgaaaacacaaaaattagccaggtgtggtggcacacgcctgtagtcctagcaccttgggaggctgaggcaagataattgcttaaacccaggagacggaggttgcagtaagctgagatcatgccactgcgctccagcctgggcgacagagcaagattatgtctcaaaaaaaaaaaaaaaaaaaagaatcaccaaaataaaaaatagtaacaatactattgtcaaggatgcaaaggaactgtaccactcaatcactgctgtgagaatttaaagtggtgcagccactctgggaaacagcttggctgtttttttttatgactgaatgtgcaactactatatgatgcagtaatttcatttttgcacatttatcccggagaaatgaaaacatatattcacacaaaacctgtatatgaatgctaataaaagtcaattggccaggtgtggtggctcatgcctgtaatcccagcactttgggaggctgaggcagtggatcacctgaggtcaggagtttgagaccagcctggccaacgtggtgaaaactcgtctctactaaaaatacagcaattagctgggtgtaatagtagccacctgtaatcccagctactggggaggctgaagcagaagaacctcttgaacccgggaggcagaggttgcagtgagctgagatcgtaccactgcactccagcctgggcgatagagtgagactctgtctcaaaaaataaaataaaataaataaaaagattagataatctgcaaagttcctgtgagcgctgtcattttgtcactctggtttttcagattcttcccctggaggctggagtttccaggatgtcaaaattacctctgcttgggtgagctatttcaagcagctgggatacctgtgtcactcctgctgtctgccagtgactgcccaggtgtctgctggttcctccccaggagtagggaggaaccaggtgggctggctgggatgggtggatatttaaagaccaggccttggacgctgcagcacttctatctctgcttgatgcctgctgccacgtggctggtcctcctcctcctgctgtggctgagccttggggtgaagacagctgctcccaaccccagaacctttgctgtcttgggacggatcaccgctgcaagaggggaagttgctactgtgatgaattctgccatgtggcaccagactgccacccagaccacagtgtcctctgcaaccctggtaactcacatacaggcccgattccacctacagcaaagctggatgcgatggctggcagaggcaaaccctttgcctgcacttcaggccaaagccgggatgtggcctagatggttcctaaggtccctgacaatcctgagatcttgcatcttgtctatttcaggtcaaaggtgcctacatgctccttctagctttgtttccctgatgttccttgccacctgctactcctctctgagctacttttccaggttccacagggagaggttcagctgtccgtggtagacatgagggtagagaatgaggtggttgggttccacttacctttctatcatcttgcagtatggatgtctcttgactggtaccgtgtagacttttgagggcacacaggagtctgcagagagatactggggacattgagcagcagcagtggggttgggaggcagaaatgaggacaggaacatttaccttgtgtttctctcagcttctcagatgaccaagatggtgctgcagatggtgctgaggatggagaacccaccaagccccgctaggagccacctagactggatgcagagcatggttcagtgagttctccaaaccagcctcccaggaatgccattcaacatggctgtgaggagaataaagaagagagcctgactcctctcctgaggccccttccccaccctgagccagcaggatccacggagcagaggtcatctgtccccagcttggcccactgaggccagcatggctgggcccaggatgcttgtctctcagctcccatcctgtgtacttccacattggtttaaccagaggaaaaccgaaatctacaattgtcataaacacatttaaatgtgcgtagaatcagccatacaaattgtgaaacat

SEQ ID NO: 878 - DNA, 1471 bp, Homo sapiens
cggcctcctcgcttcttaaaatgtctgagctctacgaagtggaactgttagccctccgtttattgccttacttcacactgaaataagccaacgtttattttattttatttattttattatttattttattattttttttcgagacggagtctcgctctgtcccaggctggagtgccgtggcgggatctcgactcactgcaacctccgcctccgtgttcaagctattctacctcagcctcccgagtagctgggattacaggtgcccgccaccacgcccggctaatttttgtatttttagtagagatggggtttcaccatgttggccaggctgatctcgaactgctgaccttgtgatcctcccgcctcagcctcccaaagtgttgggattacaggcgtgagccaccgcgcccggcccccaacgtttctttttaagcctgtcatatctcacattaaatgtgtaagtctctgaactgtagggctttgaacaaaggaaagttccatgagaatactatatgatgccaatttctactgttaggaacgcgataacagagtgcagtgggggagaaaataccgtcctcaagatctgagaaactggagaggaaaagtcacaggacaaccaacttctctatgacatagcccagcatctgaggaaagtcctgcaatagtggaggtggagcagagggtatgagctgggaagcaaatggagcaggagctggaggctgccccatccactccaagccagagaacaagcagaggctgccacaggagatcctgggcaagtaatcagccacagcatctagattagcatgaaggaaacactggccaaattaaaagatgaaacttccaaaagagtctcgatctattgcccaggctgcagtgcaaaggtgcagtctcggctcactgcaacatccaccttccgggttcaagcaattctcgtgcctcagcctcgcgaatagctgggattacagtgcaaaggggaagagtcagaaggtgaataaatactcacagccgaagctcttcaaaagacttcaccgagtacagaggggagtttggatcccgctgcaggacttccacttggtttgtgttatcaacaaggttgcttctgatcagcttgttgagtaaggactgggcagctctgtcctctgtcaggaaaaagaaagcaaagaattttaaaaagtccttgaaacctaccaggcgtttactctaattcaactgccatttgtattttaaataataatgtactgaacattcaaattcaaggtacgtcatagttttgacttataaattaaaatagttttattaaagaaaaaagttatgatacatcacccatttaggcctcatattcttttccagactctattctaacagccctcttttcctgcagttatctattcctcctatccagacccacatatttactccccaatttgtactatatataaacctaaagtaattaatgtagcaatcacaa

SEQ ID NO: 879 - DNA, 1901 bp, Homo sapiens
cacaatgcaccgctcacggcgtcggttgcccgggcaatgggccgcacgctacgaggcccacacacccagaaggtggagccccggccgggttacgaggaccacccagctgtctggagagatgaagaaaatgaggttcaaagagatgaagtctcttgcctaaagtcagtgacagaaagtgacagagctgggatgtgaatcctggtctgactctacagtcccacatggtagatggaacctccgagcaacacctaaacaaaaggagttgatgcctccgaacagagtaatgtcgctggagacactaagcatcgtcggcccctggcaggagctccctaaatatgtgttggatggatggaagaaaggatggatagttcagagtacttcagccttgattcctccgcaacagacacctgaaacttgaccctacattggttcttggccatcgtgatcttccttggacagaatcacctttcagctccggtcatcagactttcccagggccctcagaaagcccttcagagttgttactcacaggcaggctgagggattccttacggggtctgcagctctcctcacctcatccacaagtaggaccgtggcctgttcctcactactgccccaggatcactctgttcccagcccagtccagcaatcacttgtctagctttctggaaccttgagtactttcttgaaccatgagtcctgtgaccaccctagcagctctaaccctcccttatctgaaaggaagtgtgaggtgaccttgcaggtcccagagttgattgaagaccccatccagaaagaaggcaccctgtgggagagattgcaaggcctaggtctgaatccggaagcttccaccccatggagaagggctggcaccagcctggggctggcagtggagctgagctttggagccaaggactgtactgcagtgcagggagagtgaggccagaaaggctgagacaactcagggaaagaaaacctcccttctggctaatagtcaagcaccgcctgagtagaccaacactctcctgtccacaggggcagcagatgaagacacaaccagagaggactaacaggccccctcagctctcagtcagagggcagagcaacacagaatagacattaaaggaacagactttgaggccaggcagccttgggtgtgcatctgtccctactaagccatgtgacattaaacaagtgagtccacctctctgagcctcaggttcctcatctgtaaaatggggattataagagttcttgtttctcagggacaatgtgaggattaagtgagatgatacacatagagaatgtggtgcagtactgggcacatggcaaagatcagtgatgctagctaccacttatcattagtgttcctgtagaccaggacttctcaaccttggcactattcaccttttgggccagaaagttttttttgttgttgttgtggggagctgtcctatgcatttgaggatgtttaacagcacccctggcctctacccactagatgccaatcacaccacacccccagtttcaacaaccaaaaatgtctgcagatggtgccgaatgtcttctggagggtgaaatcactccccagcagttgaaaagcaccaccctaaacaatctggactgaatttgaatgtcacagatcccaagctcacagctccatgtaaaggccacaaggcaggcaggcctacttgcagatgaaggaacggaaagagcaacaattacagatcaagcggctagctccggtgtagactaagaggcgggatctgtagtctgctctaggagctaacaaggcctctgtgactcagtaggtgacctcagtgtcactctttaattatatgcaaagtggtcttgtgttaactcttaattattctagggctccaaacaagaaaataggtagt

SEQ ID NO: 880 - DNA, 3951 bp, Homo sapiens
aacatcgagaaggagagggaacgatgactacaaacaagatggccttctcccccgacccgacctccttcccaggcactcacacgccctcctgtccacaaccctccgcgtgtgtggtacctgacgggagtcgcagtccatctgctgccttcccgctgccatttctactcgtcaggaacaatggaaaggtgaaaaggaaagaggactacaagcaagatggcggaagagggacatacacctgactagtagtcgatcttacgaggtgcgatgggattagtagttttatagccttccagtgttccttaagaatggcggaaccaggaggacgaggagactaccgtaaagatggcaggctacctagcctctcccggtctccgctttccaccaccttgggcacctcgcccgcctgtggtctcgaaatcccccccaccagtggcgcacggcctgacgggagttgcagtctcccggctcccgtctatcatctcaagtcgagacaatggaaggggatggggcggggccaccggcaaagatggcggctgcagggccggggcgactgcgacatgggatgtgtagtccaggcgtctggcctcttccctgcggaaatgagggagaggactacgaaaaagatggcgacctcgcccctcgacctctgcgccggtgcctgctgggaaatgtagttccttgccgagtccaacagagaaaggacgtcgctgttgaaatgtgaatcccggcggacacgccaaattgcgaggcgacggaaacggaaagactcttttctcctctctccgccaccggcttctgaacagcctggcgggaaatgtagtcccaagctttcactcgcgagtggaggggaaggatttatgtcaccagtggggatcagtgcgggtgggggagaaaaacgtcgggcgatccgggaataaagaatgtccgcctctccatggggcgaggacttcgcgtttcaggggagggcccttaaaggaaggcagcaggaatcagtcttgtcgaacaggggggcgtggttctcgtcgagagtgcattcacactcttgttccctagaaagcctgggcacctcccactcgattcctgctcctcagacctccgggaatcagtgtcttacaagacgtgcgggctccggggaaaaggacctggagtcacagcgaatccccgccccgccccgggaagccaccaaaccttgctttttctcatctgcaaaatggggacaatggggataatgatccccacctcgaagcacagttgtgagtgttaaacaagccaatgttcttgtcaccaaagtgcccaactctggcacggggcacgcggtggtagatccctttctaaggtcccttccagcccagccgttctgggagcccaggaatccatgatgccggacagagttcgctcctgtgagaagaaaactgacccgcaggctcctcccagattgaaccgacccccgcccctcctcatcggggtcctccagcgtctgttaccgagcactgctcccagggggcgctcaatctccattcgactgaggtactacaaacacgatttccgcaacctggagttggaggcattgcaggctgtccagcctcatcccctgcctgatatccagtcagccttggaggcctctgcctagacacttcaactgcctatgcaaatggaacggcttctcatctttctgccgttttttggttttttttgtgtgtgttttaaggtcttgctctgtcacttgggttggagtgcagttgcaggatcatagtttgctgcagcctcgacctcctgggcttaagcgatcctcctccctcagccttgtgaatacctgggacttcaggcacgcgccactacacccagctaatttttaaactataatttttttttgttcagacgaagtctcgctatgttgcccaggctggtctcgaactcctggccacaagtgtgcctcccgccttggcctccctaagtgttgggattataggtgtgagccagcagccatacccctcttctcaatcttccttctcccctggaaaacctgctcacttctgaccccaagacagccccctccccttccctctgtcttctgtgtttggcagaccagccccagcgaggacttgttggttgtggtttttctatcagggaagtcaatggctggccagtgtagtgtgaagtcccagcttggcagagacttgcccaaggctggataggaggcttctttgccgctcaggctttatcagtcaggaaatccttagccctccctagaggattggctgtcccctctatcctcactgcttgaatttggtgttgcatgattgatttctaccctgttccctctgcttgagggctatcctccccatgcccatctcacttctccaccaagttcactgttcatcatttacaggtctctatttatgtatttattatttatttttctactttcccacttttctaaaaggtctctatttaaatgccactgtcaatcccagcactttgggaggcctaggcgggcggatcatgaagtcaagagttcgagaccagcaatggccagtatggtgaaaccctgtctctcctaaaaatacaaaaattagccgggcatggtggaatgtgcctgtaatcccacctactcgagaggctgaggcagcagaattgcttgaacccgggaggtggaggttacagtgagctgagatcgtgccactgcactccatcctggacgacagagtgagactctgtctcaaaccaatcaatcaatcaatcaatcactgtcctggccagttgcagtggctcacgcctataatcccaacacttcgggaggccaaggtgagaggataacttgaaactaggagttcaagaccagccaaggcaacatagtgaggccccatctttacaaaaatacaaaaattagctggacgtgtagtcccagctacttaggaggctgaggggcaaggattgcttgaggctgagagattgagcctgcagtgagctatgacgatgccactcgctgcattcaagtctagatgacagagcaagaccctgctcctggacatactactaagtgctttcagcatttcatgtggtcctcataaaaatcttgagggccgggcatggtggctcacgcctgtaatctcagcactttgggaggccaaggcaggtgggtcacctggggtcaggagttcgagaccagcctgaccaatatggtgaaaccccatctctactaaaaatagaaaaattagccaggtgtagtggtgtgcacctgtagtcccagctcttcaggaggctgagaaaagagaattgtttgaacctggaaggcggaggttgcagtgagccaagatcacagcactgcactgctgcctgggcgacagcgagactctatctcaaaaaaaaaaaaacccacacaaccttatgaggtagaattccattttagagacgaggaaactgggaccctcaattatgcagaatggatgagtggtaccgccaaaattcaaaccccagactcccgaactcatgctcagaactattacaacatgcagaaacaacaaatccagtcatgtgtgcatttaatttggcatagcaacaacaacacatttctcaggcaaaatggatttccagcttctcttgaaaagtcctgaaatctagtccaggaccgtggattgtatttaaaaaaataaaaatagaagaagaaaaggccgggcatggtggctcatgcctgtaatcccaacactttgggaggctaaggcagctggatcacttgaggccaggagttcaagaccagcctggcaaacatggtgaaaccccgtctctattaaaaatacaaaaattagctgggcgtggtggcgtgcacctgtagtcccagctactcaggatcctgaggcatgagaattgcttgaacctgggaggcagaggctgcagtgagccaagacaatgccactacactccagcctggacaacagagcgagactcagtctc

SEQ ID NO: 881 - DNA, 287 bp, Homo sapiens
aggaaagaggtttaattgactcagagttccatatggctggggaggccttgcgatcatgcagatggcgaatgaggagcaaaaacacatcttacatggtggcagaagattccatgaagctcatcaccaggttagagaaaaaaggatccttcagcagctaaggtgaagataccatccaggatgcagaaatgggacctggaaagactccgtattccttttagggaagaaaaggtccatctcgaattacctcattgttcagagaataataagtatttgttcagcaataacaa

SEQ ID NO: 882 - DNA, 1711 bp, Homo sapiens
tgccggggggcggggacgcgggcggctccgggcgggcgtggtccctcttgcgggcgcctgggctggtcgggcggatcccggagagggggagccgcggggacgcagcgacagactcggggtgctggcagcggcagcccacgcctcccagggattgcaggcctgggcgccggggttggaccagtctcccgggcatggcacgccctggttattctgtacccgtgatttgtggcggggcaagacgttaagttgggtgacaccgaggtgagccacggtcctcggcaccagatgaggaaccactgtctcaataagtgacaccagtgatgctgttaaacaaggacaatccggttcatggattgtgacaacgcacgctgacatcaagcagaccctgccgtcaggtacagagggcaccacagtgaccaggaactgctgtcctttcataccaggttttaggaggctttaccagaaggaatggaaaatgctggtgggcagtaagattgaaacagcatctgaggactggttctgcacaaaaccttaaattcttcaaggactttgacatttgtttattcttgtaacaaattaaaacctatcctgtgtgttggttagagatcttcaaactgtaaataccttgaggcaggagtgaggtttttatcttttaaaggacaggcccctactctcctacgtaatgagtttctaaaaatggatgtgagcaccaatcaatatttctctggttgttaaagtcaagaataaaatggtatttttaagctcgcaactgtgtaggatgaattctgtacacttttatttccctctgttctcctttcctatttgaaagtttattagtttgtggacttgggatcggattattcatgcattattttttgatgttgtatgtctcttggttcttgggtatttttgacacatattctgtcttgtaaccatagttaaacaattgttttagaccaactctctgtgtgtaattggcttcaacactcactgctagtcctttgacgctctgtttttttccattcttgagtaattttaagtcatcacttgggcagttgaaatatattttaaagtgatttaaagaatatgtgagtggcagacattctgaactcttttggttgtctgtcctcaaaaactaaaacttatttgtgagtaaaattttcatctaagtgttttccatataaaaactctgtcagctactgctccattgtagtagacacaaaaaagtcagcacaattttcatccctccctccctcccttctcttccccttccccttcttgccctccttccttccttccttctttccttccttccttccttccttccttccttccttccttccttcctttttcttttgtttctgaatgtacaaagaaaacacttaaaaatttgcttgtaatttaaaaacttgtcaggatatttctggatttgagtgtttcttggttacttttacctggaacctggtgaactgagtccattcctctgtttgccctttctgtacttttttggaaagttttctttaattatatcttcaattattgtttctcttttgattgttctagattcttcttcagaaacataactcttaggctcaatctctattcctggtcttccatagctatcgtcttctttttaaagtactgtattttattgaatctaagctagtatttgttgtaagaagcactattattatatgtacaactaaggaag

SEQ ID NO: 883 - DNA, 3018 bp, Homo sapiens
ggaattatcagagtaacaatagttcctgttactgacttgatatggtctctgccagaatagcttctcagattaatggccactctcaggggaagcatttctccttgcattggtttgctggtatggatggcccttagattttggcatgagtgattatgcagcctatttgaagaaaacctgttttcaggacctttttaattaaatatggcctgttacatgagttaaagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacaccattatgaatggtttttgattgatctcacaaagagcatgtgctttagacattaatgcagcgactaccatgaaacagagtattggattacctaaggaaagaagcagaggatggaatttgaggcaatcaggatgagtgaaaaattgatttgcagctgacctgcaaatggaatcatcaggaacatccctttctcatggagtcccttaatttacaagttaactgcaaacataggagatgatagttccaagaaggaacattttatcgtctttgtttttaatctcaagaatggtacctaccatcagtgaatgacctgttgcagtgctttcattgaagtgttcttcgttccctcagcaatatgattgtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacaggaatattccctctgtatacttgcatttttttctatcaattgacgcttacaattatttttgcaagttggaaaaaaatgcagtattaatttcatttgcaacaaatttaatagattaattaggagagaatagatatctttaaaattgagtcttctgtccaactgcaagttatagctgaggtggtaccagtttaagaagtgagaacttcttcactgactgaaatttgcatatcaatccaaatcattgtgcttatttactatttttgtagacgtcattcttcaaaagtgctgcatcttcaatagtcaaggaggacaaagacatctttcctgcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcaccaaagagatttcccctttatccacgttaccctggttttcctttgttttctgtttaacctaaacgggcttaatataaaatagtgcttatttggtgttttaattgtctgcttctataacataagctgcactgtccattggggaactgctcaccatattgcccaacctgtcttgataggtttatacatgggaggcattcagtaatattaattacctctctagaccagtgttagcaataacaaacacttgctagaattttaagactatataatcaatcactttgatgtcagttaatcctaccaacacaagattaaaggtttaaaaatctc

SEQ ID NO: 884 - DNA, 971 bp, Homo sapiens
tcttcaccccgcccctcccttgcttagtcgctcggctggcccggctcaccttcggggtgaaggctaccagcgagcgttatagcagacgactttaataaatgcaggcggcagcaggaactctgggaacttgggtgcccttgcctggcagtaagggttgaattatccggatctgaaatactttacagagccgaggggtgataggctctgcaaaagcactttttgcccctctcctttatgccaatactcgctgactgtgcacacaagtcatattcagtattaaatacaaaccggtctgtaattcaatggctctagcaagacgcctctgagagggccaggtggcgggtgcaagttgctcattaaccctttagagtcgcagtttgcagatctgagttagatccccggctttgaggtccttcagttgccctcctcccccacctccccccgccactgcgagaaaaatgtgcaaagagaaggaaatttgcacatcaaacgaggggcaatcgcggcggtagatgaacttgattaggcagacgcgtgagatcaaagtggccgggaccaaagcggacagggtccaacgtgccagcactgccaagagaaggccttttgtactcaggttaaataagaacatcctgcaaggagtctgttcttttatgcagcctaaagatcaagtaataatcattgacactgatactgagcatgtcgattttgaagagactagcatttcctggtaatgaagtggagtatatatccatatatttctgttttctggatgagaagactaacctaactaagtaggaaccttgaagaatcatgttcttcctaggaattacaaatcccccgattccatgtctaacataatttctactggcctctttgcttctcatgctttagtaccagtgcttctgaatttgaaagtcttcatgcaaattgcccagctgacagggcagccactgttgaggaaatgctgatca

SEQ ID NO: 885 - DNA, 497 bp, Homo sapiens
aattgtgtctttgagcgcgcagcatcgtgctttgtgctgccggggataacggattctgggtctcacacgcatccgtcacctaaaacacccttaaactgaaccagggtctccacagctggaagggaaacaacgtgctgggacccaggctgctctgagctacaaggatcccaggagtgaaggaaatgtttcagggagcagcccaggcagcggggggaggaagaaagccctcgcactcttacctccacattgaaatactgctccgttccgcagactgtagcacataaaatccaaagcaaggtttgcaagaaaaacacccccgaatgatgcacgaaatccaaccgtcttccagtgctgaatccagcagaggggaagaggagcccacgggaaagaaaagcaggcgaggttaagaataaagagtgttccaggatagcacagaagcagagactttaagtctaaacagacctagattcagagccgacccgatgctgcttgaagaa

SEQ ID NO: 886 - DNA, 789 bp, Homo sapiens
caggtctgacggggactccggctcggagctgggcccccgaggccgccagggagggggccggtgaaggttatacgagaggctccatctgtccttattgaaagtgctcttaacgcagggaccagccgtcttgctgacgcctgggccaccgagcacagggacaggacggggttgctggaggtgcaagctgggagaaagcagagaactgactccatgcagagttgggattaagagcccctggacaaggggccgaggcagtgaaggacgtccatcactcatctgccactatcctcctcacatttaatcctcacaacacccctgtgaggtttatccgcttcacctgttgctggggaacactgctctccgggggacttgggggacgacactgtaaacatgacttcctggcctgatggtggcagggctgtgtgtgcgagtcactgtccagggacagcactgaggtagaccacggtgacatcgaggatgccgctgggagctgtcactgcaggaaggttggtggggagggaagtcatgtcacacccaagcatcaggggagaccccctgccaggtcaggaccctgaagtccaggtcaagaatcttctaccttgctacggtcccctgtgttaccctcctgtggtgagaagcgtgggtgacatgcctcttccaagttggacagctgcccgccatgactccaacaaatgtggagatgacaagttggccatctagctcaagccaagtggacgcagaagcaagcaaccgggaaactgacaggactcacactaactgggcttctgg

SEQ ID NO: 887 - DNA, 535 bp, Homo sapiens
aaatggaggaaaaggaaaccgcctttcagttcaaccgactcactgcatgatatattggcctttctgggtctttggtggctatactcgtttggcttttctccttcccagcttggaggctgctttatccaaatgctttcttcagtcctcaacttggcgtttcaacccgaatccgccttttcttccatcttagatctgccttcttatgtgtttctccagctcttcgtttaaaactccttcaaatcgtatttcagttttgactggtatagcatacattggcaactgttacacgcagcggctcttttcctcataataccgtatttggtttaatttgtgtaagtcctgccttgcgaattggattttaagttcgagaagggcaagggcagaaccgttcttttgtctgttccacaccccgggtgcggggcctgggaagtagaggctttgcttactactccatactgcaaaccttagtgtacctgcctttgcagggcagctattctcatgctcttaataaccctgaataaacctcagaattgca

SEQ ID NO: 888 - DNA, 541 bp, Homo sapiens
aacgaagaggacactggggcatttaactgccagtgcccagcagtcgtagttgagtcctgctgatgaaacagaaaacctgcaacctgccctgtttgcaggcagaacagacagttaaatatatcagccaaggaacagcaggggctggtagctgaagtttggacagtcgagcccgtaaatgatggagtctggctctgtcatccaggctggagtgcactgatgcgatctggctcactgcatcctccatcctcctccctgattcaagcgattctcctgcctcagcctccagagtagctgggattacaggtggaagaattctaaaatcacacaagaaaatgtaagtcaaagaagctgagatctcaatggatgacaagatcagctcaaagttacaaacacagacttagaggcagggctgaaccgccatttcttagcatctccctttatcatcatcctattttaaagagtaacactgactcgcaaacaatttagttttactttattacaaaattcactgtttctatttcctatacatatggtttacctt

SEQ ID NO: 889 - DNA, 1677 bp, Homo sapiens
gtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaagaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagc

SEQ ID NO: 890 - DNA, 430 bp, Homo sapiens
cagctgttgagataaaaaaatttgttgtcatttattcccaggcacagctgtttgtcatttgcattgaaaaagtctccattcaaactgctgtcacatataaaatctatttatgtaagtctgtatttttctgttgtcttggccttggtgggcagtagtgtgttttaactgagcaaactgtctttccaaataatgaagctgaagtcagcctacctgcttgccatttttcttccccttccatttttctaatctccggataattgtaagaatgaattaagatttgtgtttaaggccgggcacagtgtcttaggcctataatcccagcactttgggaggcagagacggacgtatcgcttgagctcaggagttccagaccagcctgggcgacatactgagactctgtcttgtataattaaattaaaatttaaaaaaa

SEQ ID NO: 891 - DNA, 712 bp, Homo sapiens
agccagggccgcggttcgcctgcacgtcacggctactcaaacccaagcacgtcccgaaagcggtattttctgcgtctgggaggtttttgcatcctcagttcccaccgctggggctggcggcgaccaactaagtcccactttatcattaatgatgacaataactaaggctgccaggaacagcacatctgctgagctttatcaacaccagattctctcattttgccttctggatctccatgcttttttataccaacaaacaagaggaagaatattctctacccacttccttgactgaagcctgctcttttatgaagacatggcatctcttccaaccgtgtcaaacagatgcaatttatatgtctgctgcttccataccctgattaaatgggtcagtggcagaatcagtatccttagtctcccctttggtttcaaatatgtactccttatttcagtttcatgctcacctttctgtagagaccaaggcatctgcctttgcagctttacctcttcctccaggttatagtttccattcatggaatcttttagctgctggctggcagttttcctgtctacctgacttccattcctcttctcatgacttcagctcccatgcagatgtcttatcctgacatactagcttctccattctatttctgtgtgtgtgtgtctgtgtgtttccctactagttcatccacatttccctatggtcttt

SEQ ID NO: 892 - DNA, 705 bp, Homo sapiens
aggattttaaaacaatctatcacctatctttgaccatatggactaaaattgatatccaccaatagacactgatgcctgcaagtcaacagcataaagagtggtaaagtcagtgctgcaaaagatgaaatgtttttaatgtgctctggaggctaaccatccaagaccaagatgtcagcaggattggttcctgagggccttgaggaagaatctgttccaggactttccctttggcttgccattggccatattctctctgtgtcttctcacgtcttccctctgtatttgtttccaaatttcctcttcttataaggacagtagtcatattggaaaaaggaacaccctaataacctaattttaacttgattacctctttaaagaccttatctccaaataccatcacattctgaactattaaagattaatgcgtcaatatatgaattttgtgaggggcagggagacagaatacaaccaacccacaacacccagatacatagcgaaatcttcttcttctaggccccctgtgcctgtgtccaccacttcatcccccaattagctatatttgaaaaagtaagagggaaagaacagttggagggggaagagagagagaaagaagacagacaacttagattatgtgccctagatgttggccttacaaaacgggagcaaatcttaaccaatcattgtagcaaaaccttttgtttatga

SEQ ID NO: 893 - DNA, 472 bp, Homo sapiens
ctggcagttttcctgagtacatgggagttagggcagagaacatgatgtggtgctggtagtcaacgcaagctggcacggcctcagccagaagactggagctaggagcaagcaaagcaccaagtaaatgaatcaaattaaaaaacaactacaacaacaacaacaaaggaggaaactagagaacatcttgggaactatccgcttttggaacttatcccatgctggaacattgccctgagacagacatccatgaagaagcctgggatgaaagaccacatggagagaaaggcccaccatcattctgcaccaactaccaacggcgtaagggaggttgacttggatctcccaccccagttgactctccagctgaaagcaactgcctgagcccaaacaaaacctgctgaggaacctccctgctagcaaatggaatcaggagaaataataaatagttctgttgttttaagtcaccaactca

SEQ ID NO: 894 - DNA, 555 bp, Homo sapiens
ccaccatctcttccttttagagtttgccatctccgtaccaccaccaccaccacacacagcaccctcaagactccctgtgatcctgggatgcactcaacgaagagtgtgtggcccaggatttgatggaaatgctacaagagaagcaggctctccccttctgaaatgatgagtgataatgaccatacaggtcaacttttccaccacttggagggagcctgtcaaagaacaaaggcaacagagaagagagcagagctgaggttgggtgagagggagaaattcctgagtgcttgaatcccacatgccggaagccgcaccacacttggacttctcaatacaggagccactctgcaggcatttattggcaggctacacctaagactttctctgcagaaaaatgttctagatgcacagatttgggggcttgattgacaacctgacacctcactctaaatccgcatgggtctgttgacctcagggaatatgccctagacacagccctacaatcgaccctgtgctgacctggtgatcctcccacttcttcccaaaataattccg

SEQ ID NO: 895 - DNA, 422 bp, Homo sapiens
acctgagttctaaatttatttctcaaagaagccaagctcctgagagagaaatgatactgtaagagtatctgcctggaaaccctgttgcctggagaccactcttgaagaacatccactgctgtggcctcttaaagatttaagacatctaatgaacagctgacagaaatcatcaatttgctcctcatttcagtgtcaaatcatgatgcaacagcagagtgaactcagtgtttttggtatgaagatctccatgtgtttccatcatcagcatctcctgtgctcttaatcttaccctggacacctgacccaggtgcccattctgtgaattctttcattgtaggaaagagaaacagatgttgacaccatgctcttggacttcccagcttccagaatcatgagccaaataaacctcttttctttataaa

SEQ ID NO: 896 - DNA, 566 bp, Homo sapiens
acaacaggagaggcaagcagagcacagtaggaactgaatggggtttgcgtgaaagaaaaatccagggaaaggtgtcctgcagaacgtgcacgagacggggcttcaccatgttggccagacatgttggccagacgggtcttgaactcctgacctcaactaatccacctgcttcggcctcccaaagtgctgggattacaggttgcctcccttgaacacacctgaatttgccaacatccctcttaaaaagaggcaccaagaggaatgcagaaggccagcatgcaatgctatagcccaagttccatgccagcacttgaactttgagatgctcttagcttttctagcagtcataaggcacttttgcccaagaccaagcttgcagtcagggaaagcctccaggtttttcgaaatggccttgaacaggttttaagccagctctcttgcttttaatcagaggtcatttggccaagttgcagcctgttgttccagcccaggatttctccacctaagcagatacttctaattggggagagtggagaagcggcaacttcaattgtcccccctgacat

SEQ ID NO: 897 - DNA, 866 bp, Homo sapiens
ggcttggtgaaccctcaaaaaggctgtcaaacacccagaggccttggggatcaggaaggagctatcatgtggtctttcatctaagagagaattgtcctgcctgatgggcttcaaaccaccagaacatcagttcttcctggttctgcagtagtctccaaccttcagactcaaacttcagcacctgttcttcagattttggacttgcagcctctataatcacatgagccaattccttatataaatttatttatacatgctgacagttggttctgtttctctggataaccctgactgttagagctgttacctcaaatttgttttcttatatttggtgtctgttttggagtacttacaagtgcttaaaatgttctttttcaattaggtgagtctcagtctctaagataatttttttattgttctattttatagattacatgttaatgtcaattaagctataaacattttattgctgatacattatcaaaatgcttttcaaacagccatttccaacagtctattctttggcaaaaaaacaatgccattctcttgccatggccaaatgtgagtgctactaacaggtaaactcttaatttgtaagtgaggctgaaatcttaaaatgccttcctgaaacttatacatgattgattttgtttatttgtgtaatttctttgttctatggtttcagcttcaattgctgagaaaatgtcaagattatttcctgagaatttcctttgtggctaagacaaaggagaagttttaattttactagaaactgtgaaacgaggcttttaaaaagtttcattaaaaaaaaaattagggaagaataggcatattcagaaaacctactttcatttaggctggattgg

SEQ ID NO: 898 - DNA, 1151 bp, Homo sapiens
tgggtttttgccatgttggccaggcaggtcttgaactcttgacctcaggtgatccgcctgcctcagtgtcccaaagtgttgggattacaggcacgagccaccgcgctcagccaatttttcctcaactctctctttcctggacgggctgcgttggggggaggtgcagggaaagaacacctctttgcttagacattggtgtcgacagtggggatactaagttcatctcctgatcctgctaggcctggaagcaggaaagaaatgtcctggttagagataaaattgttctatccttttagaaaagcctgttaaggaatatgatgcaaagccaccttcgacgaaatctgaaatgataccccacagccttgtccaccccaattattcagtgacagggctccagttgcttaagccatagagaaggcccctttgcagtgggagtcactgaagacagaaagggaagcccaggatgaacccagtcctaagggctgctgggggccaccaaataagactgttttagccctggacacagagggagacacagtcatcccagatccttacaaagaatacattgccaaggaccccgaaggaaatctgcttgtcttaagagaggaagacccacgaccagctctctgggactacctgtcaactcagcaggtgcagccagggagcagccatgcttcttctgccctcccagtaggctgggctatcagttcctgggaggggtcctgtccccatgtaaggggatatgtacattgctgagtacgctgatatctttttcatgggtatgattttttaacaagaaagctaaatggttctcgtgtaacataactgatatagtttggctgtgtccccacccaaatcttatcttgaactgcagctcccataatccccaggtgttgtgggagggacccagtgggaggtaattgaatcatgggggtggttaccgccatgctgttctcgtgatagcgagtgagttctcacgagatctgatggttttataaggggctttccccctccttcgctctgcacttctccttgctgccatgcgaagaaggatgtgtttgcttccccttctgccatgattgtaagtttcctgaggcctccccagccatgttaaactttgagttaattaaacctctttcctttataaatta

SEQ ID NO: 899 - DNA, 649 bp, Homo sapiens
caagcatcctccttactgaatttagattttgttccgattttgtggcctgcgtttcttcttactgccctgctctgtggccctgttcttcctgggtttggagatcctcaaggatgggcttcgggaaggcctctggccggatgatctggtgacgtaatcccatctgacgctcagccttggactttgaaaaggcacgactgtcctgtctgatggacaggatgcagaagcctttgggaatgggcattttgccagaataaataaaagaagacaattggcaaaagatggactgtaccccatggccccaggctgctgtgtggagagacttgtcctctcctctgcccacggtcaccagtgagcaccagggacggggtttcctgctgcacctgggcctcttcctgctgccaggagctgccttgctgcctccacctgtgacagtccaccccccataccccccccacccgcaccatgagaggatttccagggcccacccgcctccagtccccgttctctctgctgctttcgaggtcaccctgggctggaaggggtgcctgggatactgctcagacgtcttggccgccctcccaccccgcaacaccccgctcctggttttcaggatgaaattgtcctcaaataaagcaagcttttgagtcaa

SEQ ID NO: 900 - DNA, 1439 bp, Homo sapiens
agcacaaaataattcccaagttcaagatttatttctgccttctggagacatggtctctgtcactggaaaagaaaaagagtcagggccttccgtgcttgtaggatttggatgtagaggtggtgggaatgtctctggacttgggacagcacctccgatgtctatgaataggacggactcactggtgtgtcctccacatgttcttgaggaagttaacaaggctaaacaaggaactcactgtcctgcctgctcagaagactcagcacaagagaacacacagcaagactcaaagttttggaactgcaagaaagcagaaacctggctccttctggctctcagatcttatgactcaacaaagaatttaaaaagaatattctccctattgaaaggtctcaattttcccatctctatggacaggcggtaaaatgagatagtttacatgaaatgctgtctggccctcagcaggagctcagtaagtattggtcttcttccctcttgcagatccactccccagagtctgtctttccagagtttctctgctccaattcatttcatatcctattgccagatgacttctgctaaagccaacctcattctctctcctccgtgctcaagccttgtggcttcccactgtctgtcagagtgaagtgcacaccaaaggcctaggttttaggcccttcctgtgtgactctcctcaccagcacaatctcctttctctcttccctccttcacacactcagtgccatagccaactgggcagctggctcacccttctccatgccctgcttcatgccctgcttgtccgcagcctttgctgacgctggagagaaggcacttcctctccagccttgcaaccttctagctcagcatgacccttagccctcagaaagatacacttatcttctaatgacatggaaatgatcaactgagcttgatttgtagcaaataatagaataaataataacgcacacatataattgacccaacttttggaactctgcagggatcatttaatttctcaaagttagataatgtttatgtgaagcagatgctactactaaatatataaatacacatttataataacttagtgtatttgtgggtatgtgagtatagatagggagagagatgctcagagaagatggagatagatataagctagacaatagctttctatataaacatttacatctttctatctagcaaattagtttgagaaggaaaagtcatttgcagatactctctagtgaagtattaatttccaaatgttatcggctgaccaactatatccttttatgtaagaagcatattgcagacattaaatactctattgtgaagactgaaaacgacctaaactattccaacaattggtatatggttatagaaattatggtatactcacattatgagctattacacagccataaaaatgatgtttttgg

SEQ ID NO: 901 - DNA, 943 bp, Homo sapiens
ctacgctgggaagagatgagctgatgcccagctcagctgctcttctgagtcttcaatttccagaccaacctcccttaaggtgactgacagtggggacctcaacctcacctacagggatgtggactgatcccatggtctcagtgagagacccaggcaatatttctacatgaagcatgttggatttctgaattatccagcctcaaatgacaccgggatgggacagtgttaacccagataagaaaactgaggctctgagaagttgagggacttggtcaaggccacatgtcagtgagtgccagaagtttctgctactcctacaaaatcagaagttccccaaatccaaaccatctcgacctacccctgtgacccgccaaaagaagctggccttccccatcctcctgtctccgcagtgccatttgcctttcagtctcctaaaaagaagcacttactctcttccccaaatcgcagagggaagcttcaaatacacttctaatcatcctcagtacccagcagtatataggaagttattgtcccaaagttgtgtgtcatgcccgaagtgtctgggatccccgagtgcctgtggtgcccaagagctatgaatctgctatcatcaacacagagggtaccttctgaatgggctatgtctacagtgatgctgcaaatggaagctaaccctaggatgactggcctctgacacttgagccatcccatcatctgtcatgggttgacccatccatcccctcaatgagcctgaccttcaggaccactgacagaggagcagtcaatagaaattaattgttaaatacccagaaaatctgaaatggtatttaatatgcagttcatcaagagcaaaagttccttaaatcttcatctagaaaagttatttataagggatgaatatgttgtatgaatatgttgtatgcaaatattatattcaagggca

SEQ ID NO: 902 - DNA, 628 bp, Homo sapiens
aacgaacaactccagacgcgccaccttaagagctgtaaccctcaccgcgaaggtccacggcttcattcctgagccagcgagaccacgaacccaccagaaggaagaaactccaaacacatccgaacatcagaaggagaaaactccagatgcgccaccttaagagctgtaacactcaccgcgagggtccgcagcttcattcttgaagtcagtgagaccaagaacccaccaattctggacacgctacctcgatccagatgaaggtaccccaagcagcttgagatgtgatgatggagaccagtttgagaagacccatcatctctgatttccctctgattatgaagtaatacaacaaagctacagtaagtggactgatacggtggtgattgcaaactgtttctaacttctctcatttactggctggtgtctttagaggtagcattgcatttcattggcatatgttttatttagtctttctaaattaaaaaagtatatatctgttattttcacacattaggaagtaagaaaggatgttaaagatacctatttctgtttttagtaaacaaagcttattgaaaaagtcttttttgtatttgctaagaatgtttttcattaacaatggctattttct

SEQ ID NO: 903 - DNA, 557 bp, Homo sapiens
agactgctgtgctagcaatcagcgagactccgtgggcgtaggaccctccgagccaggaccctgggccagggaaagaaatgaatgaagatgccaccttatgcccagaacacatctctcattcaatgataaaggatttgtggttgggtcaacttttgtgatgctcaactctttccttcgtaaggacgggctctttctcaggaggcttttgtactcccaattaacgcactgctaatctgatgaagctctattttgtagctatgccatctggatcacatagcctccaaggccagcagagcagaggaagacaaagagcagagcaagatagaggtggaagttacacgtcctttgtgcttactttctactggcctcatcgggtcgcaagatcccactctgataggtgcatgggggcttggaaaattagaaaaacatgtgaatatttggtaggcacttacaatctctgccagcatctgcccttctaatcagcaaattttcaattacttttttcttcacccacataagacatcttaatccaacctcaggggacacatcctgatgtc

SEQ ID NO: 904 - DNA, 2705 bp, Homo sapiens
aggctggtgggggcggtgttgctcggggctgcgatgccccttaggttgcgggcaaccagaggcctcactcgtgggcaggaagcaagggcggaccccgagagatgactgattgtgggggtggggaccgtctgctcctcctaatggctggggaccgtgcacgtctgcgcgggccggacctgctcttctcgggaacttgcgcgggaggaggcccggagctgcgccgctttaccctctgctccccggtgcctaaaacgcacacgcatcaaagtcacaggacgagttagaggagaaaggcagagggagatttgaaacacagaggaggtgatgagaagacacagcagaagatatctgaagactggaaagaatgctgcaaccaacaggagaaggaaaagacagaaatgtgttttccatttggagcatccagagggagcacaaccatatcaacaccttgattttgatccagtgacattgattttggacttgtggcctccagaacttttagagaataaatttgcattgttttaagccaacaggttggtggaaattttttacagcagccacaggaagcaaacacagactcctaactggtgcttagtcctagaatatcagtttctgttccacttctggatctcataattgcatctcagacatcaacactgacttcatattcttaatgcaccaattctaccatttcttcaggctgcaaacagagaaaaacttatttaagcattccagaattgacccaatagaagactctccagaaaagactgcatggtctctgaagcagcatgatcagcatgactggctgcatctgggctccaccgtttgccacttcagacaggtccttagcctcttagaggttcattttccttgctgtagcccggagtaagaatgtttagcctacaagatttattttgaggcatcaatgaatcactatgtgagcctcacacagtgtctggcactgatattacaaaatatggttgatcttgccatccttgttattgtcctggtggggattcctctctgttgaagatacggagcctctaaaaatgagtggcagaggctcccagctcaggatccttgtccaggtcctaaagatcctccactctgcttgtcactctgttcattatgtttgcatggccaccacggtcaacactactgcggcctacctcaagttctcatgcctcactctctgagctcatgaggacacaaggatcctttggcaacacattaactacactctgtggccatcccttgacttctgagaggatgtttccctcctctcaatcaaaagctctcttccctcctgggcaagatccttgcatgcacccagcaccctcacacctggtgccctcacacccagcactctcacacgtggtgccctcacacccagcaccctcacacccagcaccctcacacctggtgccctcacacccagcaccctcacacctggtgccctcacacccagcaccctcacacctggtgccctcgcacccagcaccctcacacctggtgccctcgcacccagcaccctcacacctggtgccctcgcaaccagcaccctcacacctggtgccctcacacccagtgccctcacacccagcactctcacacttgcactgtcctcatcccaactctgtggttcctctggggaatcactgtggaatccctcatgggaggatgttttcaaaagaaacaacagcccaatgaagggtatttgaggatgagaagcaggaaagaagtcagtgggtggctgagttgtgtccaggttttgcgtggccatggaaaatcaggtgaaggacattaaatatcttgcagtggcttctccattaggagcatgaaatgaggaaaggggctgtcctcacaggccagccaagagggatgcctatgccaaacagaaagactgacagtaaacagaatccaggatgacatgactgaggtatggtgtgcagggcatggcccagggaggagggtagataagtaagcctgggtgcaccttcagaggaagaaataacagaggctgcaggcgagagagttacaaggaaggaggagcaggaagacacgagaaaaattcagataaactcaacatctccagcctgggggaaacgtgagagggtggtatgaagatacacacgatgcatgttgcttagtgaaagcagccagtcggaaaaggctacgtagtgaatgaccccaactatgacattctgaaaaaggcaaaactatggagacaggataaagatcagtggttgccagtgaggcaggagaatagggtctgggggcagggagcctaaggctgattcatgctgacttcatgaacggaatcaaaaggaaaaccctaaatttccatgcccacgtaacaaaaggatcagaggctactccctttgcaactccccccaactttctgtgttgcagatgaaaaatggaaagtgcctcggattggtcccctcctgcaaccagtcagacatctgcatagagcgtaactttgtaacttcacttcagcctctgcttggtcaccttccacaaccaatcagactggtcatgggccactatttcatagggtgtaaaccaagtgaccaatgggaaacatctagagggtatttaaaccccagaaaattctgcgaccagtgcttttgagccttgcttgggcctgctcccactctgtgaagtgcatttttgtttcaatacagctatgcttttgttgcttc

SEQ ID NO: 905 - DNA, 659 bp, Homo sapiens
cccgcgcgcccgcgcggcggaggagaggtgttaagtgtgatgcttccataatacatttggatgctgtcagctaagttcacttctgaactaaggggttcctccaaatgttggctgaaattcatcccaaggctggtctgcaaagtctgcaattcataatggagctactgtactggctattggaaggaggagattctgaagataaggaggtaaaacctgtttagaaattaaaaatgagttacgatttaaagaaaattcagatgactcattgtgagtgctagttctcttgtaggatgccactggaaatgttgaaatgaaaaatattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttgacttttttctaaaatgtctttattggattgaatgaatgtttatacctgaaaaaaaaaggttc

SEQ ID NO: 906 - DNA, 582 bp, Homo sapiens
accttctctgagcactagctggaacacggcggctcttctttcttccactctgagacaagaacacatgcgcttttcctagtttcgctcttgtggcccagtctggagtgcagtggcaccatctcagctcattgcaacctccgcctccccggttcaagcgattctcctgcctcagcctcccgagtagctgggattacaggcacccgccaccatgcccagctaagtttttgtatttttagtagagacggggtttcgccatgttagccaggatggtctcgaggtcctgacctcgtgatctgcccacctcagcctcccaaagtgctgggattacaggcgtgagccaccccgcccgggcaatttgtaaatttttaagaaacgccctttgttgtacacaaattagacttcaataaagttagccttaaaacagaaaactagaggaaaggagaactggctcaaattttctgtacttttctcctgtaaccacccctcatttcctccttgagctgtctccctgtcatgtgaacatggtcgtcaacgagtggcttctataattgctcagactatctttccctcaactgaattcct

SEQ ID NO: 907 - DNA, 4489 bp, Homo sapiens
cagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgcccgacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacaccccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctc

SEQ ID NO: 908 - DNA, 3473 bp, Homo sapiens
atggaaatactgaaccttggataattctctaagtcttatagaggccaacagattaaggaatactttcaagagtatcccttacactacttagactactggtcatccttcctctccaagacctttttcctacctgctagggtagccgaagctgaaatgcaaatgttaattagtcctatttccacagtggcccctggcatgggtaaattggatgatgccagctgtcacaaacattaagttgtaaatgaaaatatttcttacagcaagtataaggatatactttacaagaatattaagcatttcagaatcagtagtgcttttgagtcagtagtgcttttgcagtctaatggtgaggtacaaatctgcttttcaactttcctcaaggggtagaatataaggatgacctttacagctaatttccaaaggtaaatttgcagatgggacctgaccatgtttcaggacatatggagaaatgtgtatagaactatggcctgtttttctagtgtaaagagtattagaatacagtcaaacacacggaagctgagttcgtacttagggttcctcatatgcagaatgaattccgttagtctgtaggattacttgccttacatccagtagcttattttgttgtactaatcaaaaaacccctctttgagaaagagtgtgtcagagtgaagtctctcctgattccagcaaaattgaacctacgccctaaatcgttgcccaaagagagactgttggctgtgtcacagtgaaaacccatgatgggaggaaagagcagtgttcagattgctgactctgaacctgttatttggacctctgggatgaatacctttaaatgttggtgttattcctcatttttgtcagagtagaaacacagtgtgggcttcctgtggcactgagtcttgcaaacttgtcttctagcctggagtgtgatgtgcttctactagctacattatttttctatggctgattcttttcccttggtaggatgtgtgtgattctaaaaatgccttttactgcctgttttgcctgaaggtcaccacttgggaagttttccccacttttgcaggaactatggcaagaagaatgttatgtttctattatggtacttatcatgttactgcttatcatgcttttatgaacagttttataatggagcactttcgtgatgaggtagggcatgttgctgataacttactgaactgctgaaccaagagagtgaagacaggcagacagaagcaactcactatgctatgaggccaccttgggcaaacatcttcaatagctttataatcatgtgttacttcatggctacctgttttctctatgggaagaagttcttcacatgagagtttattttagtagtgatagataaagcttctactctcttcagggacttttcttaaagttgactttactataacaacagacagttcttcagttttcagttttattgctatttctgctagaacacctcatccaccagcttggccccataaatgatagtggtctctcaaagcatgtcccaccagacaaatgaagactgtcattcagactttgcctccagcaattacctaggattccctggaataagaggactcagtgtcattatcccctccagaaaacagccagtcctgagcatgcagggttgccagcctcaatttcatcgtttgcttttctgcttttaaatgtttgcaaacaatagcagtccatgtcacatgttttattctttttagattaatgaggtggcctgttcaagttagacaggccatattaatttcagcgaatgcggtccttagcaccacaaaagcaaacaaatgattttaactcaactggacaaagagtcttggcatagtaggtgcgtaattgttggtttttggatttgactggagagtgagagttgtgattttgattctccaaaagcagactatatgagcaccaagtatattttaggtcatttagaaagtttgttgtttgaacaaatgaggataagacatccatcagtttttgacactgcaccaaatctgcttgatttcaaaaggaactaactaaacactccatcacaagagtcctgacaaagatgcacggatggctatattaacgagactgtgtcaaaatgaataataataaatggctgtcttgagaatccaacgtaaatttccttatctaaaatagtggtttgtttaaatgatgaagcaaagatggcattggagctgttggctgactgtccctttttttctgctaactgcagaagcacggaatctgatgccctactttgtggggtaatggtgtgcttatctccccctcctcaaacagagtttggcacgttgctaataacagccagcctactgctaaaatatcaatgacagaacagaagaaatagatatttaggaaaacataaatcaaagctgaggaagtaggcaaaaaaaaagcactgatagaaagcaaataaagaaagatctataatattgggacaggcagcatctccctgctcacatggtaattttctttagccagtaaccaacgaggatgcctgccatgggaagaaggtgtgattttgtgatttaatgatccaaagcccatttttagacaccacttagccataaagagaggcccaagtttctgtggtccaggagtcattgagataagtatttatgacaaggtccacccaaacacaaggggacacaagaagggggcatgtcaggcacagggaattttcacagtggcttacaaaggcaagtcttactcttacctaacacagtagttctccacactggctgcatgttagatccccacagaagagcttttaaaatccccaatccaatattcttggaattggggggcaggagagagtaggagacccagtcattagtggtttttaaagctccccagttaaatatttaactcccatttgaagaggggctaataagctgagattaagaaatactgacctaaaacaacatgacgtagacaggcaaatcatttgtggaactcaggccagttaattggtcatctccctgaaacaattcaaattggagaaaattctgtacaaatgtagtaatagtgatgttttatatgtgtatagtattttaaattttaaggtgtttttatgttcatgtcagggtgctctcaggaaaatgcttagcatcttgtaaaactgcaaatgttagatatcatcaacccagtgttataattgagaaaacaagcagagtgcaagtctaggacttatttggagtctcaccaaagaagtggctggcaaagcctaaaattggggcactggacactttcctatattcttctatcctgggaatcatgatttcctttgaagaatgctgtaaaatgttgagtgtatttgtttttgtctgttatgaactgtgattggcctcacacataaataatgaattcttttaggttgctttaggaatgtgttactttagtatctcaaatcaataatacaatcacaagtgaaacaa

SEQ ID NO: 909 - DNA, 150 bp, Homo sapiens
aaaaacaaacaaagacatggatttactgtgcatattagcagatccatactggaaaatgcatggaggtttcatatacaccacttacagttttcagctcctcagtagtgacaaagccatccccatcattgtcgattcgatcaacaatcttcc

SEQ ID NO: 910 - DNA, 723 bp, Homo sapiens
ttggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttgctgttctctggtccaccaagggctatgaggctcaccccttggatggtgctcagaaccacaaggaatactgaagaagccttgcctatgatttcaggtggcatcagacattgggctaattttcaaggtgtctctccttcccaacaggacagtcggagtctggttctttaataaatagctatatggatc

SEQ ID NO: 911 - DNA, 1039 bp, Homo sapiens
aaagtggaagaggaaagagttaccccagcgagaaccgggaaccgggctgcagactctccggcccgggggagggatgagtttcactctggttgcccaggctggagtgcaatggcgcgatctcggctcaccgcaacctctgcctcccggattcaagcgattctcctgcttcagcctcccgagtagctgggattacagatatgctctaacttatttatccccaaaggacgtgcatttgggtcattttcaatcttctgctatggtaagtaacacttcagcaaataaatctttgctcatcactgtctctcttatataaactcctgggcatggaatttcaggtcaaagaatgtgcttgctctgaaatgtaatggattttgccaaattgctattcacagaagatatacccacttacactgccccaaagcctacatttttctcactttagtttggtcacattgtcctggttggatactttctgtctcccgtatctcatagttggagatatcctaaccatggcctcctggggacactgtgcagtttcctttctgctcatcctgctgcctccccccctaatccaaacaacccctcatatctgtgtatgtcagagggctgtccacacagcatctcatttgatcctatcttgtggggtaggaaggaaaaccgtatcagcacagtctggggtatgaggaccagaggtgaaacaactggcccagggtcctaggatggaaggagagcctccttgctgagcactttcccaccatacaccattgtccaaagatggcctcctaagtctgggaagggtagtaccaaggaggtatatcagttggaagtgatgccactaacacactaacacttactgaaaacactgatgtgggccagagactggggatatagaggtggacaaaacctcctccctgcctccagggagcatgcagagatgggagtgcaatgtggggtagttcctaggcagcatggggagccatctatataagctgagattggaagggtgaatgagggttggccagactaaggaatggcattt

SEQ ID NO: 912 - DNA, 1048 bp, Homo sapiens
cgggcgcgccgcgtgagtccgagccggccgctcagagcgctccaggctgggttcccgggccccgccgcgccgcctccttcccagctcgcccgcccaggcctggcctcctgcttttccatttgattccctgcctctttctattcggactggaatgccgggccaggctccggggcgcgccgctgcggcagccgcacctcgcaggtcccccggccgaccccgacgcggaagcggcggccctcctcgccgtcggggagccagggagccggggacgatcagtcacataaggcttagaggatcaaggatcctgcccagatgacttaccgaaatgttacagattaagttggtgtggtaacctgggctgagcactctgggagaggaagagaagagagaagacaggaaacaactgaactatgaccaatcccagcacggaggcccagaaaactttaagatttgagtattaatgtctcaaggtcaggagcaacctcaaggctaaaactcagatctcaggactcaatttcacagaagttccactataaaggcaataatctaaagctttaaatgatatgaaaattttgtaataagagttcagtatttctgccaacattggcgcatggattgcaaagttcacaggattgaaaacaccatcgacataatggaaattgaacagcatctgattactgagtgctatatcagcaagttaaaaggatcttttgcataccttttaatggtatatatcctaaaactgaagtgttcaatatagacatccagattgaaactcaggcagtgaattacatacacaacaaatcagttgaacatggcagagcttgtcagacttatgaaagattaaatacattttacatttccacaagtgtggtattcacaggtctaaattggaaaattcttgggttgaagaagaataatcataatcttagcttcactcattgaggaaacattattcagggatgataagaggtaaaatcttaaaaatattgacaagctaatgagagaactttgaggtaagctgatatgcaggtatagttaggactgg

SEQ ID NO: 913 - DNA, 549 bp, Homo sapiens
ggtctggggaataaagaatgggatgaaatggtgagagtccagaggggttgagcaaagaactcactatcacacagcaaggcactaatttgaaatgcctgggagaagtagaagctgcatttgactctcatattcttattggaccaggaaggcaggaggagacaccagtgtgcaccagagaaggagaagtcagagatgacagtccctgcctgaggccatctctggtccaccagacaactcatcaccaacttcccaacagccactgctctaggccagacttggatctgctcttgaatctgcccctgcggaaagagggccgtttggacaggctgtgcctggagatttctggcctcataaaatcctcctggtctcttaggagagctggtgacactctccaggtccttggtggagcctgatgattgacatcttaagcaaattctctggagaagtcgatgctcctgatggaggctcacacattgataacccctggtttagagacactactaattgttccagctcatccagctaataaatgacagatctcagacttaa

SEQ ID NO: 914 - DNA, 5109 bp, Homo sapiens
aattacaaggaaggagattatatccagggattctttttgttttcaaggcaaaggttaccaagttacaatggaccaaagtagctggaatgcaaaggagtataatccttgtctttgaaaaaagagcatttgtttcaatcatatggcatatcaaagtaaactttctcccttcctccctcctttcgttgctgctgcttcttttttttctctttttttttttctttttttggagagggtctcactctgtcacccaggctgcagtgcagtagtgcaatcttggctcactgcaaactcagcttccctcaaacaatcctcccacctcagcatcccaagttagctgggaccacagccatgctccaccatgcccagccatccttgcttctttactacatttcttttttcaacaaatatttatcaagtaatattgtcaagtaatatttatgagcttcccctcagataggcatttagcatcatgatggcaccatcctctaacaataatgggaaggctattttccactgttattaatcattaattctccaaatcattttagtattattattaattctaataagtacagagattaataaatgcattcaaaccacatgtgaatatttgctataggtttatctgtgcctactgtatgttcagatttttctttatatctgaactttgttataaataaatgacagtaaaaatggaatttatagttcaatgaacttgacaaatcacttattctgccattcattttccataaagaccattcattcttccttgttttacaggtaactgagctccagaaagctcaagtgactttagaactcagttcttagtgtgtgaattatgctcccatctcatccctcttccttgatggagcactttcctcctcattttttcttggatagtctgtacaagctgcctgaggtgtgcaggaaagtgagccacgtcgaagtgtactgcttttaaatttttgccaggatgaagcatagcccaaagttgccaataaaaatggatttctttacctttctgaaattgtgtgatgacaatttctaagtaaaggacccaaatcatgtcaacttcaggaaatataataatgagggagccaggagcagtgaggggctcacacctgtaatcccagcactttgggaggccaaggtgagcgggtcgcttgagcccaggacttcgagaccagcctgggcaacacggcaaaaccctgtctctacaaaaaaatacaaaaaattagctgggtaaggtggtgtgtgtctgtggtcccagctattcaggaggctgaagtgagagaatcgcttgagcctaggaggtcgaggcttcagtgtgccgtgatcgtgccacagcactccatcatcatcatcctgggtgacaaagtgagaccctgtctccccaccaaaaaaaagagggagtttcatctcccaagaaaatgaattagataggaataatagaaaatttactctcagaataatagggttctagctcctgcaaccaaaaaaagatagttcttttttacaacctgagattactttttcaagcatttctccagttccactggcattgaaataatagttagcaatgcatctgagcttttcttcctctaatgagcaggcagagaagtcatagatcatcatttggaggactataaaataagacatagcttagcaaaaggaccaaaatacattcagaggaggatgctattggtgaatgtcctcaaagcctataatctggaaaaatacaaggcatatctctgaaactgtgaggattagcaaactagctaacctgaatctctgtcttctggtagtataaactaggtagtttcaaatctgagtagtttctccataaaagcatttcttcccaaacgtttcttaccaaactcccaaataaatgagaaaaataaaatacagttttataatttttgagaaagattatgggattatggtatttaaaaagaaaagcattctgtagagttggggaaatctggaagactcttgaggacatagctttgccgaaattgctggttgtcacaagactcttcaaaaactacttttcatcagacatctcccagggctctgaggtgaatattaattcagcagaaagatccttttctgctacataggcaggaggtccagacacaggggagtgggtgcaacccagctggtcccattttctgtaatataattaacaatgaagctcatactttctcaacttctagaagcctggaggatggaagcagcccgagagtagggtgaatgatggcctcagtgggcccttcttaatgtgtctcagtactgaatgtgtggagattgtagaaaaatagaaggcccttggaaaaaacctctgttcgtttctctgttcgtttcgctccctgatctccctgccggattgcttttctttcctttctcttccttggctgtcctttacctcatggtgtggggtgtgcagatagcaggttgtggcttggtgagtgctcttcacttcaggtcaaggtgaggcacagttaacatgctaactactttcctcagttctctctgagttgtgtaaagctcccgatgccagacttcctcttaattttgcacattattaaagtccaaagagttaagatttggtgatgaggggcaaagggccagctgtcacagaaatcaatgaaatgatacacagaaatgggtatcatgaaaaggccactggacttgggaaaactgggtgcctgtccttgccctgccatgtacttacctgtgtgactggaggtgagatgttttacctatgggcctcagtttctcattacaaaatgacagagaagactagatacctaagttcctaagtttgtgacatttgtgaatttttcttggccctctgtgagtagagtgctaaatttagaggcttcctgtggttgaactgatgtccaattctcagggaacccagacttctcagttcagaacccagttccagatttttgtgggaatagggaaaggtattaaataactccattgaattctttcctgcataatgccctgctgtggctgagactcaatgaggtcatcacctccaacacacagaacccctcatcatctccttacagccagactggagcttccaaggacatcaggttggcaaggattgtgagtaccctaaacatctaaagaggccctctaataagggacatatttgttcttcaacagtttcctaacttgagaccacaaatgcgtaatctctctaatatcctaaagcttggacaaactgggcagcccctgagcagaccgcacagagcttaaatgtcagtgctttccttccagaaagaaaaagaatggtcctacacctcccaatccatgggctgatacatatgccaagggagccggatgaagaagtgggtgattttaaatagctaagactgcccatgggcaaacgttctttggcttttctcctctgcaataagtataccttcctctctcctggtccttttctcctttcccaggcccctctatcaataataattctggctctcagatgactacagttgattaggtggaactgataggataaaggtgacacccttcccaaggctatctataatgcaaaaagatatccaagaaaaagagaggtagggaacaccttgggaaaccatttctggaagacagccagtccctgctgtagacaagcctcattttccttcccccaaatgttaaagagtaaattcctcctgtagccttagctctcttttctatctttggcttgctttttatgaactatctttagagtgccaaattagaacagggtaggcagaggcaggaatatgcccaaatttgggaagacctggttgggaatagtcgaaagccttgatatgtgcaaagaaagaaccatttgatcaacccagttcttaatacaggatactaacttaaaatttagactcaagttatacgataattcaaacatttattgtatttatactattctatatgtacttttccaggaaccaggaatacaaaactgacatttctctgtacagaggctcagactagtagagaacagttaggtacgccgttaattataaactaatatgtatcatcaattatgggtttttatgggggtttggcaggtggaagggaccagggagagatgatgagtgatgatggttatgtagtctttaggaggatgcaattataacattgctcttcctttcacgcaccacatgatttagcaagtacttcatattggctccaccattaacatggtcaatggcttctggatactcacagttcaggcacagtttctcctgaagattttttacctctcccatctttaagaaattgtctggatgtccatgaaagatgctgacacttgtattaattcattaaaaaacaccaccccctccctgaaataaactaaaaagtaatgaattcatagaaaaaaatttcaccaagattgaaactagagaatatacctagacttgcactttgagctttgagaaatgtgtacctattcaccattccaacgtgaagaagctctgcagtaggaaaaataattaacacacttatagtctactgcccatgtaaggatcagctccggctaagaggccaaagatgggtgacatcgttatgctctgcctttattttttctttcttacccacttagcttcctaattggaggaaggaggcgtggtaaaggtatatgaagactatggtttaattagaccagaaaacactgtcataatctctggggtcatcagaatgtccagttttgtctttgggccaagataagggcagtgggatttatgatgtgttgtttatagtctgaaactactctggtgatcaccagggtcagtttctttaatgatggtttccaactggcctaatacattaagtaagactggctgataacatgaccagacagacataaagaccctgttgggaatgacattgaactctcaaagtcaagatttcttacacaaatctatcagctggagaaaatgaaggcagtgtggtatatgtgtgcaaataaggacattatgaagcttaaatatggaatgtctcttggacccccgatgtcatctgtattctctttttcttcttgtactatatcctttgcctgtaaataaaaggtttatttgatta

SEQ ID NO: 915 - DNA, 1754 bp, Homo sapiens
catgcacaggtatgttcattgcagcactactcgcaatagcaaagacttggaaccaaccgaaatgtccatcaatgatagagtggataaagaaaatgtggcacatatacaccatggaatactatgcagtcataaaaaggatgagttcatgtcctttgcagggacatggatgaagctggaaaccatcattctcagcaagctatcacaaactatcgtaggaacagaaaaccaaacaccacatgttctcacttataaatgggagttgaacaagaacacatggacacagggaagggaactcacacacccgggcctgttggggggtgggggcctaaggaagggataacattaggagaaatacctaatgtaggtgacaggttgatgggtgcagcaaacgaccatggcatgtgcatacctatgtaacaaaactgcacgttctgcacatgtaccgcagaacttaaagtataataaataaatatataaatatttataaataaataataaatacataaatatcagaaagtaaaagaggaaaaaactgaaccttgaatttttttcttttagaatatttataatatttaacgtatttgaaggtgaaggccatcctacatggacatctgaagctttagctaagtattatcttttctgtaatgtgactattggtttgcagttcggttcttcttttcgaatagtatgagattaattttctcagtacttaaatcactcctcagttaagttggatgttcatggaggaacattctttccttcaggttgctgatacatttgctgcactgtaggggagggagtgggtatctgagttagtcagttttaccatttataaaatgtttggtggaggaaattgaaactaattgctaaattgttagtaaccagtgcattaactaggaccctactgagtggactgaaagaatcgaaaatgtttaactggttgagaggcaatgatgttgcaaatggggtattcttcaaagctccttctttttttaaatcttcaaaggcaattattctgaatgtaaactacagaccaaattgcagtcttctgtaagcatttcagagattacctcaaatattttttgattaaaaaactcttccgtggtcttttgtgcttcagaactacccagtacaacagggtcttcagcctgctcaggatctctaaagagagctagcacacagtcagccaactttggctgcttcaactcctaggaacaagaaatgatgctgagataatttgtctggcaggtattatcagcccacaatgactgctgtcatttagcctcaaaatgtttatttttccttttacaatgctgtatttctttagaaccttcctattccgagtgtggaccctaggccagccccatagacttcccctggggacttgtcagaaatgcataattttaggccccaccccagacctgttggaccagaatcttcatttaacaagatgcccagaaaacctgagataatcaaagacccacaactaagtaagacctctcaggatctcaaagccaagtgttttacagagaagagaagatagaaaaggcatattatctaggagtggaaaagaattttatgctgaaaatgttgaagagagaattcaaaatcaaattcaacattccacctaggaggcttccatctctgcttaggagctgagtaatggaggtgattggtgtaagtgttcagtacctatgaagacctaactcttgagggagagactccaatgtaaacttcctactcaatactgcctt

SEQ ID NO: 916 - DNA, 1636 bp, Homo sapiens
ggcccgagctgcacaggccaaggaattccacagagggtgtgacccaaagcccctaacaacagactcgctgggaccccctagacttggcatggaggctgggtgcagacctagaagacagaggtggtgaagcccggccagtgaggacaagagctgcggggaaggacaccgaggtgacttgacggcagcagcaggcctgaaggctctggctgctttggaagatatttcaatgagatgcaaatcgcaatcgactgaccattagtttccactgcagtgtttgcagatggagtcgaatgtaaccccccgggaatggagccgggagggtcagagaacgcggctgcgctctggatctccgaaggggggcgggggcctggaagaggtccgggcccagaatggacctccaggtccctgctgccgcaatctggccctgccctccagcctaccccttactcccagaggaagggacccagggagacccacccagatgccctgaaaggaggtggaggatgggggtggggcaatacgcagagtttgtctggtgaatgcaggaaaggggtgggggctggagaggaaaaggatggagcagccgtcagcttgtcaactccgcatctgctggctgcctcggccgggctccagcctgcgccctcgcccctcggaacagcggtatgtccattctctccgcattcgtctccatcgttcagccaccaccgcaccctttctctattcatttctcctgctcccttgtcctgccccgcccctcgtgcccaggtccatcggtctacacccatgggccgagccctcctcaccagggtcctcctggaaccgctccggccttgggcttgtccgcggctcccacggtccccgcccggcggggcacagagcgggaggggaggggcactagcacaacctaccctgcgctgcgcagctgcaccccttcgcgcatgggcgtggcgtagctcagacccgcccccagcgtttagcgtcttttgtcacccacctagagggtttgatatatcctaagcttttggcccctgggtcctggttccgtgcagcgagtcctcccagcaccccaccctgcacattctggaaagagccagactctggctgggccgagcaagaacagaaccacaagaaggttacacgattatttattgagagcctcctctccccgcccttgcaatctctaggtcactttctccgcttgtagattttgcgcgcaagccccagaaagacggctgggggcaggggtgctgcgtactgttcaatgagagccataatgtggctgtaactgtcttcctcatattgcaagaacactgctggcagatccagctcctcatatagcgccttcacccgggccactttctcagcctccttctgcccgtaattttcctggaagaggttgaaagacaggaaaacgggcttggccttccccagagcctccaggacccctccactcccctcattcacatattccagaacatctccaaagccacccactcctttcctccctccaattttcaagtgtctctacgtagctaaaatcccaagcttcccttccctatcccaaatattgcctcataccaggcatcctctactccagggtttctccaccttggcactattgaaatttgggaccaga

SEQ ID NO: 917 - DNA, 750 bp, Homo sapiens
agactcgagcaattttctcacttcagcctcctgagttgctgggaccacaggtgcacgcaccaccccctggcttttatttttttattttttttattttttggcagagacagtgtcgccttatgttgcccaggctgaacacctgtgtctcttaacctaagagctgtctccagcacaggatgcaagacagccccaaaaaagtgttagggacttaaagccaccagaagcttttcttaaccaatggaatacaggagtcaatgggaacatcctgtccagaggaaaggatatttaaggagaaaggaagcagcacaagttcgactcagccaagaaacagaggaaggacatcccaagcacgaagtggggcaccagtctgtgttccagcgagagataaaagggagagacacaactggctccagcccttttcctgcctcttcctgctttgaatactcacatgatacctggagctgcagcagccatcttgtttaccaagaagaaaagccaagatgatcacagaatagccagcactggtattgttccgccagcgacagcagatacttacctccagatttttggggaaaaaaaatgagctggagtgactctcttggtccctaaggtggaagccatgtgttgaggacactgagcaacaagataggaggagcctggggcccagccagagaacaggaagccacccaaatagctctcaaccccttatagatggactactaaatgggaaataaagtagactgttctctc

SEQ ID NO: 918 - DNA, 791 bp, Homo sapiens
ggcacacagctagactacatttcccaggacctcatatggtgccaccaagacagagctgactgtatcacccaatgccaagccctcagcgtcactgtcaagtcacattggttacctgagccaataatctcatggaactcaatttctgagagctgaagatggaaatgtgaaggcaatccagctcttaggaggagaatatctgccttctctgcaaagagaaattgtcattttattttttaagggtgattttgtcactgggaatggctgcccacccagtgacattttcctatgtaccttgcatccaactgtggccttgcgacatattttcatgaagggaatatgagcaaaagtgaagtaacttccaggtctgtgccttaagaaacagttccctggtctggatacctatctgtagactcctccaatcaacacatcatatgagactctgacttcagagctgatgacgtaaaatgcagggcctaatctatcttggcaatgtggcagtggtggcagtagctccatccaatttcccatggtagcaattccagccacagattcaatgccctgcattgttggcatcagaagcacaacagtttatgtgtgcctagcaagggtggcagtgcatcttcacaggaccacatttgggcatgattctggatgttgttcctcactgtgagaatttcaaacatggctttctactctgttctgaggaagaagattctgtgtgctacataatatcctttaatctactccttttatgcctaaattagcaagagttagtttctaatacttgaaag

SEQ ID NO: 919 - DNA, 650 bp, Homo sapiens
caatctctatctgtgaacctgtagtcaattcagagttccccagactggcgttctgttacagagggagtttagattcaacttcagatgagaaaaatgaggatctgacatgaaaagtgacttgcagtaggtgcaaactagtgtccagggctctggcctccacctctggtcaactttcaccaccccatgttatgctaacccctggcattctgtttgtgcacaaccaagtctttaatttgtcctagtagtcatatttttttcctcttcttcttaaattgatgtcttcacttgctgtttccttgggtgttgaaacccaagtcccatcccctgaggaaccaacaacattgaatacgaatatggccatgaactgattggccaaatctactctgacctgtgctcccaaggtgaatgaccttgttggggttgactaagtcttttccagggaggtcaacatcacctcagctatttcaaaacagagctaaagttccagtccagggaatggctgattcttcaggtgtgtttctgtgtgcacaacttgttctttcaacaacctccccatgagtttctggaatgtgaagactacttttgtctgaagaaaccactggcctacatatttttgttatacacacatgaaaaaattgttacaagaggta

SEQ ID NO: 920 - DNA, 2292 bp, Homo sapiens
tttcacaatttacaaacagctggaatggtttggcgttttcaaaagcatataggcaaagggagttctcaagagagaccgatcagaaaggatttcttaactggcactgctggcagagacggagaccgcggctggggcaagtggtgggggacggcactgaacttccctaaggaccccaagggttcagccgagggatcggcacccactccgctcacagagggctccctccctacagtagggaacgcacccgaaactcagccgacaaggcgcaggggagcagggcaaagacattgcaaccagaagcccaaggccggccgacactttcagaccctggggcagcccctggtaggcaccccgccgagcccgcaggatgcggctccaaggcagggttcgcccgggccggggccagcgcggaccacagctgtatggcgcccggcgccctccggagctgcagcggagcacggccagaagccgcagaccccgagcgcctctctgcagccgccgttcccgcccccgcccccaccaggggacccgacacctccgtctccactccccccagcccacgttcccccaactcttctcaccctgcaggagccggtgaccggcgaaggtacttctttccgcgtggagggactgtgcgcgtcccgcctggctgtgggtaggggtctgggagctctggccgctaacacttctgctccagccgctgggagtcctctggctgccgctgccgccgccgccgccgccgtctccagcagcaagtttccataaaagtcctggtgtgcagcctgttcccgcattccaggcgggcccagcgccggctgcagctgttccaaaacacaaggccagttcccccaaccccccacctccgccgttatcacccggagtgggggtggagagttgaggagaaaagcaggggagggggaccgtggctgccaactttccgccagaatttgtctgtctcccggccctaggtgcgcgagctgaccccctaactttgggcctgcctccacctccagccaggcctggggaaggaaggctgcctccgccatgggaaaggaatgaggctgaaatgggcttcattaccgggctgaagctggctccccctacccgcaaccagtttgctctggggcccacttctctcagctactctacccgtcctagtttccagtcaagaagccaagccactacatatcttctactaccctaagcattgacctttggccaagttttcctttattacaaagagcgtggggcagcaatccgggaacacttcatctgtctattgctcccctgttcttagctccagtctttaactctaaaaggagagttaaaaaagaagaagaagaagaagaagaagaagaagaagaagaagaagaagaagaagaagaagaagaagaagaagaagaagaagaagaagaagaagaagaagaaagttgaaggcagaggaggaggaggagaagaaaagaaggaatatatttatataagtacaaatatctttatattccacctttttcttaattgaaggcaaaccatatctggtctttctaaagcttcataaaggcatctttgactattagacacccacagacctttttcaacttggaccgccagcctgtcaaacccatcagacaataccatattaaaacccgaaatgcacactcggagtatttttggtggacgagatctttaattcttcactgcacttgaaaaaaaaatcgaaatgacatccagataaagaataaagatggattctcgctctgttgcccaggctggagtgcaatggcgtgatctcagctcactgcaacctctgcctcccaggttcaagcaattctcctgcctcagcctcccgagtagctgggactacaggcacgcaatgccacgcccggctcattttttgtattttagtggaggtggggtttcactgtgttgcccaggctggtcgcgaacttctgagctcaggcaatccacccgcctcagcctcccaaagtgctgggattacacgccgtgagccaccgcacctggcccctgggaccattctcacacagagttattattaaataagaattagcaaagttcagaaagtcatatatttcaagtgctttctaattcaaagtgcttctctatattcaagtactatggtatcatttcaaacatagcaaattataaaagttctgtaatttcctaaatataaatgtactttgtgaaaggcttctgtgacacacataaaagacatatttgatgtaccagttgctttgctgtggcttttaagtaaagaataaaaagtgtcatagaagg

SEQ ID NO: 921 - DNA, 315 bp, Homo sapiens
actggcgtcagcaggaaagatcagctctgccatttgaaacacccaactgctaccttctctcagaaatcaaaagatggagtctcgctctgtcacccagactggagtgcagtggcgtgatctcagctcactgcaacctctgcctcatgggttcaagcgattctcgtgcctcagcctccccagtaccctggaagtgctcagtacatcatatgagccagagtgctggccaggaatgagaccacgctttgcctgttggtcaccgcatctccagggaactcagaggcatctccaggaaacacctgaatatgtgagctggtt

SEQ ID NO: 922 - DNA, 3921 bp, Homo sapiens
aaatatttgcatacagacatttgaggctgctctgtatattacaggcaagaactggaaactgttcggctgcagggtgacagctaactagattgtggtttattaggggaatgagcctttctttgtgtatgacaactatgaaaactattgagaagaaatagttacgtgatacagtcataatcctcaaaaacggagaatcaggaattatgatcaaatagtgatagtaacaaggaaaacatctgtctaaataattactgagtagaaataggttcggaatttgtaaatagtcattaatttgggagattggggttttttttgttttgttttttgtttgtttttcattattttgtgctattattcatacgtgtacatttctacttcagtttttattatccattacataacatacatgcttgattatttgcttcaaggaaatacacctttataagtaatactcaataactactgggtttgagaatgaaggtgtcagaacgaatgagattgtcctatgaaagaagaggcaggagccagggaggaggatcccacccggccggggctcagccaggaggcagggccattggggcagggtggcagtccaaggaaccgctctgggaaggtttgcaaaggtcggggtcccccctgccaggtgatcgaattatcgtggagtgtctggaaggcgggggaagttttgttgagttcaccaaataactcagaccaactggaaaccaagtggagtttctacaggaccaactagaatagggatcagctacatgggggcggggggaggggggcagggaacggtgtctgtcttcattgcagctctgtctgcagagccagcactgtgatacctcatagtaggtgctcagtgaatgtctgtgaagtgaattactatctagacaaggatgagactggtatgactctccaaagctttcccacctccaaaacctcggcttgtggggaatctccagtagggggcactgtggacacggttcgcatctgcctcccaaggctgggctccgcgtcaaaaaaaaaaaaaaaaaatgagactgagccaggtgcagtggtcactcctgttatctcagcactttgcgtggccaaggcgggaggatgtcttgaggccaggagttcaagactaggctgggcaacatagcaagaccccatctctacaaaaaaatttttaaattagccagaggtggtggcatgcacccgtagtcccagctgctcgggaggctgaggcagaagattgctcgagcccaggagttcaaggctgcagtgagctctgattgtgccactgcactccagcctgagtgacagagcaaaacctggtttcctaagggggggataaaagagggagagatgagatcggggtgtcccgcttctgtgcatgtggagggggtaactgggaaccgtgtactgtaggggatcgcacaccttggggtggaaacagcagctctccggagttgcatgggagccatgggcagtggtcctggctggtgaaatgattctagccacgtggcccacccagggggcaaaacaatagaaaccttcagaaatgaaacgtcacctggctgcaagaagatagtcccacaggcgccctagagatggggatgccaagtggcttctcgggaagctgtaagaatccacagggcattgtaagatggagggaaatattaagttttcttcgtaaagaggtgaggggggcgagagcagcaaaggacactggaaaatgagaagcatggatgggaagtgttgcattgagcataatttggaggtaaaatctccaacaccgtaactgagtggcctggggacctgatagaaagccctgctcaggactaaggcagagttcccagttatatcgcagatacaaagagaccaggaacacgcttgtaatcacagcacttagggaggctgaggcgggtggatgacctgaggtcaggagttcgagaccagcctagccaacatggtgaaacccccatctctactaaaaatacaaaaattagccaggcgtggtggcacatgcctgtaatcccagctactcaggaggctgaggtgggagaatcgcttgagcccgggaggcaggggttgcagcgagctgagatcgtaccactgcactccagcctgggcaacagagtgagaccctgtctcaaaaagaaaaaaaaaaaagagagaaatcaggaacatcatgaaagatacagcaaaatgttttaccccagcccactgcaccacacctgggattgtgacaattaacttgataaattgttccttttcctgttcggaactgactaggttgtgcgtggatggaccagtgaaaagaaaatcctgtttgggtagggaagagggaagtagaaaacctctttcgtattcttggtgtcaagaaatgggaagagaatgagggagcagagacctgggttgagtgttggctctgcactaaacagctgtgtgatcttggtctagtgccttaacctctctgagcctcagtttgtacatcagtaacattgggataatgacatccacatgcccacttcacagagctgctgtgaggactggatgagaaatgtagagaagtatttcggacaccataaagctcaaatacaaggtgttggttaggaaaagtttcaactgacttgtacccacctgatacccctccatcagcataagcgtgtatgaggatgttaggtacatgtgttgtgagtgaaagctctggaacacccgagtagagctttctgcaaatcagcttctccttcagaggagaccattttgttttgctttccagcagttacttgaagaagccttatctgaagtcacaacagtgacttcaggaatagaagggaccaatggccagcttgctgaaatgtaatgccattcttaaaagccagctaagaatcagaccgtattagttaaggacccataagagtagacatttagaaaaagtgaaaaatggcaagagtggcccaatcttttgagagtttagagaaaatatcatttggaaagggagtagctctccttctattttagccttattattacggtatctataaagcaatgccatattctaaatctgcagaaataaaattctaaggggcgaaagtccaaggcagaagtcaaaagttttgcaaggaaaccgatgaggttgctgacctgagctgggcagggttgaacaggcgagtgccaagatcaaggtctctgattgtctctccttgaaaggtaagcagagaactagggctatcccataaattaagtgggagattggaaaggggtgcggacttctgtattggggagaaggtcttggatgaactggggcagagaactgccagagagagtacctaggaatacgttgttagcaggagaaagaccaagttcagatgcagacttgggaaagtaggtaacttgaccaaaggtagcaaaattagactacccaactggattgtgaatgcagtttatgaaatggatcaggacaggagcaaaaatagattttctagaaactgcagactcctgtgattggagcagtatacaaagtacagcaacatcagactagatctcacctgaggtgctgggtgagaaatcttagggaccagatggaagagggcctgtgtataaagacattaggaaggaggtttgggagggcagcctgacttgtctccagagaaagttagaactggttgacttagcaaccaagggacactgggtcaaagacgaggaatcaggacgtcggtgcctagtgactgagcgccagcccagcccatttctctacattgccatgggctaaacccagtgtgctgtaaactcttcagttcctttggttatggattttgtatcttttctgtgtttcttaataaagttcttttgaaaaatgggaacctttctcagatgggaattttgtatctttcctctgtttcttaataaagttcttttgaaaaattggaa

SEQ ID NO: 923 - DNA, 2626 bp, Homo sapiens
agctgatcggagcctggagccggtgtgtgctgggtgccgagaagagacagcgccgccggccgtggggagcggacgcagtgatttgctccccctcgtgcagcaacccccacacccagcaccaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggttagttggtctttgtgtgacagtgggaagaagtggagagaacactctgtctccccgacttccttcttgaccctccttccgtatctttcattcttccccactggcctttccagatgaggtccaaaagtaagctcactcttcagggaaaagtgatactaaacccaggcgtgaggagtcatccttctgctcttacttttccctgcatttccttaggctggcccagactctagattcctgggcacttacctgtatctgagacccttagacctcctgtctcagtttctccacctgtgagatgggcagtcacacagatgagtgtgcatgagggaatcagaagcccatctgggttgactcagaacccgggctctccccctgctgtgggtggaaacaaaacaccttttcacagaagctgttgtccctcccccatccctgataccatcacccagaagctgggtggggaatgggaagctggaggagggggttagagttagaccaatgcgaggagctagtaagagctcgcctctccgtgacttccccccatgcaagggtggcccaaggcttcccctgatatccaaagcaggacagcagccccttggtgggattctaactgctgctactctgtttctttcctcactttgctttccaaggtggtatgtgatccccagctcaggcctgtgcagacaggaaattctcccctgcagcaagtaggggaggtgggttgtgggatgtgacctccttccagatatcaggcagtgagtgtaaacctgccacctccagccctgatccattctcacctagcggctacaggaagctgtgtctgttcgatttggtgggaggagatgtgcagggagctgtatcttgtcctccgcttgtgaaaaactcaaggatgtggagaagagtagaccgtggaaccctgctcttctgcagccaagctgaggggcaggatgcgtgtgggacagtggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataatataatttaa

SEQ ID NO: 924 - DNA, 567 bp, Homo sapiens
tttgaaatttctgccagttgggtggtgtctgcggctgctgctgggaaaatggggagtagaggcttgcaggtagatcagctggaatacatggcacaggtgacactggaatccctgacctgctaatgaatgaaaacagggcctgatgtccactgagttgagcaacagggcctttgttactgcaaggacgttgtccccacctccggctgtgttaggatcacagaacacctgtcaccagggaacagagctttttcgcaggtccctgatgtttgtagctgtgtgaccttagtcaacacgctcagcctctctgaaatgcaacatctgggggaaaaaatgaaagaaaaatgaagcaaaaagaagaagaagaagaaggaggaggaggaagaggagaaagcaaagtgatgaggtggagaatggacactctctctcccttctggccacaactcaattcccccaggctgtctaagtgcatcctacttctcctttgtcacattcatcagtcatcacgtcacactcattgtgaagtattctcattatcattgcgtcttgcatgccagtagactgaaagct

SEQ ID NO: 925 - DNA, 15145 bp, Homo sapiens
gccgccgcggagccggcgtccgcagcggctgcgcatctcgggcctgcagcggggcgcttggcgggcgggggccgggggagagcctgtttgcgcagtacccccggagggcggaaggccgccgagagaaacagcaagtgacagagcagaggaacggctggcccagccaatcctggagctgctgttgcagcacttgttccccaaacaagtgctcctacattctgatgactcagtgtatcgggagccgggagatggagctctcagcagagtggccaggatgttctgtcaacatgaaagctacaaaaacagctcggggctctgagctgatccttagcctggggtcattttcagggagggctggacagagaaggcggccaccgcccgggcatcaggatgggagcgacaccagaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttttatagttaaagaaacagattaagtgacttaacccaaggttatgcatttggtaagtgaggttgttgagatttaaatgcatgcacttcttattccaaagcctctacgttatctttactcttttgggctgaagtcagacatttttgtgaactaagattctcagaggactgatgtgaaccagagtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggaggaggtagtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaaaaaaataaaaaataaacaaaaatatctcagagccactggttccattttggctttttagtcttgagtcactcttaaaaagatagcaaaataaaacacatgcaggaaagccgaaggtcccaggcccagccagatgggggctaggagtggctgggactctggcctagcttctccatggcagcgttagtcccagacgtacaccacttctgcaaggctgtgtgggtaggagcccctggggctgagggggcacattgtgcaatctgctaagcagaatgtagagttttaaaatagctacctttctccaagacactatctgcttgccgctttgtgggatgtttacctgggattaataatagctgagtgccaccccactgccagtatggaatagcaaacagcgatctgggctaggactcaggcaggagaggaatggagtaataaccatcgtatcagctcacatagttcttttcatacttgctggctcatttggtcctcacacaaccctgagagggtaggtggtcttatccttgtcgttggtaaaactgaacctgagagtcaatcctgccaagatctgactgcttgtagccgcttctcgtgggtctcccatctaggtcctctgacttcagctgttatttctctgggttctgactagtggggcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagagtgggcagaacttgcagcaaggagagtgatttgggctagacttctgggagaactgtgcatcacctctgctgagggttcctgaggaaagatgaagcctctttatttgaggtaggagactcggtgtcctccacaggatcctcccagtcccaagtctgtggcactttgagacagtccctggaacagcatgaggtttgggtgccaggatctagagcaggcatttctctccatctttcccatctgtcttcaagacaggcccaagctggatgcaattgaggggatgcatgggcagggtacaccaatgtggtcatcgaatctggaactttgaccttgtttccctttgcagagagaacttctggcactgatcttataggaactggtgttatttgcatataaaaaaagagaaaggcatgttgtccctcatcttttccaggaaagagtgctgagctgctctaatcctatggtggggagggaggagggccgtgtagaggacgcaaggccagacatggtttgctgggaagaaggtaggaggtgggagaggaacatcccagggcaggcccacaactctgggagccacagacattgcctgctatactaaaggcaaagggatgtgttcaaataggcctactatttagcggtaacccacagtctgaaataaatcagttaatggctaaatgagagttgtattaaatatggaaaatcatattttttgtgtgtcatcaccacctacagatttagcatcaacaggcctgaaaggctgaggatgctgaaatgggccctgtccgtaagatcatgcttattttataatgactttttgtctcttttcattactatttcccactcttattccttaggtctacgtgaatatttatttatgcagttgtgttatttccttggggtacagttcttccagtgtcattggcatcaatgaatatgtgactttgatttcaagtgtaaacaaaccactggttcacggcagggacaagccatctctgagacaagggctccagcagctgcctacagatgcccttcccccaatagccctggactgtttcggccagacgcctgagacgagagtcaagggtgttcttgcagggacctgcccaacgctatgtcatgtgtcctgcctggagggtggtgctcacacatgcatcttccagccttattagctggtactgcttttcagcttgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttccctcctctctctcactcaccctccccccactccccagcctccaaagaatttaatctgctggacaacaaacaatactgttataaaactttgaaaacaagagggcgcggcctccctgacaaggagaagggcatgttgggtaacggcctgagggagcgtgccaggcctgagatggagccgggcgagagcccagttggctgggtacctgggcgcctgcccctgcatagcccactagccgcgccatccccaggccagaggggaaggaaccaaaacaaaatggggggcagagaaacgcttgaaaagggaagttgcacatgttcccctctctctgatctgatgggaatgcactagactgtgaaacttcctcctccacctcttctcccgagtccctccctccctcttaccctccttcctcctctctcctccctcctttctcctccttcctcctcctgctactcactgttcttgagtctggcagacagaggtcctgatagcagaatgaggctggaatagcaccataggtgcagctaccagctgggccagccaaagaggaaggagagaaagtgggcttgcagttggctttggattcaaatctaccctctgtctggcccagcctccctccattctattagggaagtggaactacatcacgccacagggtgtgcccagtccatgtgtgtggaccaggtgtgtgcccaggtactggggagaactgccactcagagattagttcaggaagcaccctgggcttcctggtgccccccttgggctgtgctctgctctggggagagtgtttgacttgttgaaatgctctctcctttgagatgctgtgctctccctccagggaggagcagaggctgtgctgcaagaggctggggcatgtctctggaggagctcttgggaacaggaacgtgcttctcccagcgagagcagccatgccgtcttgtgagtgtggtgcctggtaggatactgcatctgttagttacttcccagtggctgaaggaagtggtcaccagctctgcctgggggaggtgggggagctgggctttggggcgtctccctccctacctccagagttaggtttcacctgagactgtggtttcacttttgactccatcttcactgagtcaagcagatgatttaggaatgaccagggagcagcattggtggtttgcctttggatctgcattggtttggacccatgaactctgtggtgggcattgtgtttgtgtaatagaccattggtatgctcatttttcctcttgcagaaagcactagctttcttgaaagcagttcagggacatgcccatccttctgtgccagagctgagcccttctactgggggaacatggagacacgcgagctccagtcttcattccactcctcctccttccctttgccctccactgtctcctgctgtccccccagctcatcccaggggcagggtaaccttggtgcatcctcccatccagccagcagtcccgacccagggcccccgtgcctggactgagtctggggtttatgtcagtagtgttaagggagggatggaaaactgaacttttaggagtgcagctgcctaggaacatagacctccatacctctgacgcaggggaaaccagaaaaaccgatgctgggtccacgtaggcttggaaggctgttactttttgccttcttacctgaataggaatttgaggggcactgtgggtttggaggatgtgattcccacactggggctcagggcctgggaaatgcagtggtccctgggttctgagtcctcctttgaaggccaccctgccagaaaggaagagcctgatggaggtttctggggactttgggccagccggtaactccatgctccctctgctccacccttggcccctcatgtgtataccattccttttatcacccttccctctgattcacagcccccaccctgacagctaaagacagaatgcccaggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgcagtggcacgatatcagcttgctgcaacctctgcctcccgggctcgagcagttctcatgcctcagcctcctgagtagctgggactacaggtgccaccacacctggctagggttattttaatgtatctgattttgcatgcatttagacaaaatatggcctctccagttcactgtatttctgctgcatgctgttgctgcttctctgtctcaggtttcctgcccaagccctccgagcatttgaatgtgctgtgagcagcctacctcagcctcctctctttacacatgaagacactgaggcccattcagggcaagtggcaggtccctgttctcagagttggggccaagcaggtattaaaaccattgtgttctgattcactgtgtgcccaagcagattaatgccctggtgtgaggtcgagaagcctccaggtagaatgtggggacagaagtggaccaggctagagtatagctcccacacctttcccatgcgtggcagcactcgtaagactgacatgcccacccttctggatgggtggttttcctccccagacagccctgccaaccctttcaccttcagccagtttgtttggagtcattaggctgaggtgggtaaaacccatcaccctccttggatggcagagctctcagcaggctgggattttcatgggctgccttcttacaggtctaggtggccttcaggcatggtgccagggaaagcaagccccttccagcccttaccaaactaactggctgcttcctagtagggaacagccaccagcttgtttcagcgaagagtcattgctcagctgattctgagaggagaaaactggttctgttgggagggctgagacctgaaggaccccttttatccagtggaattggaaaggcaaaggatttcaatactaacatgatttttttctccacttcttttagagtgtttaattaaagtgatgcattgttaatggcttcttatctcttcttccagagagtaaagagttaaattttagaatccaggagtggggacccagactgtggcttctgttaactccctcagtggcagtggcgtcctgctatgcacagcccctctgctgtactccgaatggtcccttacgggtagcaggagagacattaaataatcacactgatgaccaagtgagataagtggtttttgaaggaaagaacttgaggctggcgaggaccacttaaccttctagcaagggctggactcagggaggctttcctgagctgcggggaggatgacaggttccctggagtggtggtgggtgggggcggggctgaggggtggtagccaagggagggtgaaggagagtattccagaagagacaacagcttaggcaggcaggacctcgccatggaggaaggtgctttctgatcactgcgggacacctgtgtgatagctcatagggagggggtactggtaactaaaagttgataaggaagagtggctaaaatgaaaagcagaaaagtgagaatctcatcaaatcccctcatttgacaggatttggactcccagtagtaactgtccttaaacactcactcctgaccttacaaccctggctgttacctggttaacaagccccaggtgttggctacaggtgtcatcactgagagcccttgtgtgcagatctgccccagctctcccacctgtgactgaggctagcaagtcccccgtgggctgtagagcctagcgctggtgtcagaatcgcttgttgcaggttcatcttcagtgtctttcccacagccacatgctggggaaagacggcaaaggcgctagaggagcaggagaacaaagcaagctgccccagaccacccggctttcgcagaacccagatgatgctcctgtctccccctaagtataacgtgttatgtagtcagtatgatcccattcagtgcagaagtatcgcctaggaatttcctgccccacccaccctgttttgttcttaatgaagttcaagaacaaaatgagatgatagtcaagttatggagcaggctgcagtggatacaagggcagaaacacagtctttggagttagacctgggatctgcattgattggttgtgtgactgcagacaagttatttagcctcattaaggatgaatttcttcgcaaaaattggaataatacctgccccatacgactgttgtgagaattaaacaccgcaacttttgatgttcaaattctatttcttctccttctagcaacacatactgttagtgccaggaaccataaaaattataaggctgtatctagaggcctgaaaggaagctaaaatatacagtgtctactctgtctcttttctcttggttatggtatcagaggaaatacacatattttcttagcttcaaaccaccaaaaaagatgatgcagtaaggagatgggaaatctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatactatacaaatgcagggcagtacaaatgtaaatattaatgtattttagtaataattttagcttttatttcatcatatataataatttgtagtgactggtgtgaagttaaatagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagtttatca

SEQ ID NO: 926 - DNA, 561 bp, Homo sapiens
agacatgggaccatcatctggattcctagacgtgcaactgcaagcttagaagaaataaaggaaatatcccaggagcaaaaacaaaacacacacatgctcctctcaagagtcactggcatcccagctgaaaagtcagctctacacctatgggacctatgggcctgtttctgagctctgttttgtctctttggtctgagtgtctatctgaggccaataccacagtaccaaatgcgattgctttagaggaagtcttgaaatcagatgagggagcataactttcgcatctcagtccttctccatttcctgaggcttcttcaggctctggtgtgtggtccaccctggagaatgtctcgctctcctctcgagaggaacgtggctgcggctctgcgtggaccgtttggcagaggctcatatgctggatccactggttggttcacggggttcattcctgtctgttgatcttctacctagtggctccatcactcattcaagccacccgatgtcccttttgattattgtttacacggttcgtctttttccacctttccccgttggactctg

SEQ ID NO: 927 - DNA, 6300 bp, Homo sapiens
gacacaactccacatgactcagaagcccttcttaaaataagaccagaccacattcatggaggctgagtcacctctaaccttccaaacttgtgtcttaccaagaatgaaaggcaacctatgtaaaaactatgggctttctagtataaataaaaactactcatctccagaaaataaacaatgactgctaagatgattgaaaaaagaaaggagaagaaagtagcttgtaaaagcgtgtgaaatgcattcacgttggaatctcctacaggcacttcagaagacgaagtgctcctgatggctgctttcaatcactggaagaaccatgaaagtgcgagagattcctcccggtgaatgaagccagctcaccaccgtcaagggcaagggatcagcgtgtgttcacatggaggcctctcaccgagggaacccaagggggacagcacaggaattgcagagccagcacccatggaatgggcagggatttgggtttcatccaaccagccagttgatcaataatcactgaatgtctgtcacccattgcatcctctcctgagtagtgaggctaggccagtgccagtcacctggaaatccttactgttctgcagttgacattttgagaggcaagtcaaacaatatatataaacaactagaatgtctagtgtgtttcaggaggtaaatgccgtgccgggatgagcagaaggaggatggagccgttgctgggcagatagactgattttagataaagccgtctgggtgcaggaaagaagaccttaaagagggaatgacatttgagcaaagtcttcaacaaactgaacccaggaagaaaacattccgaaagtcagagaaaagaggaagtacgaagggccagagccagggaggacattggcggagatgcagccgcagaagcgtcaggggccctgcagccgcgatgcaaacagagaagtgggcgcatggagcatacggggcagagaaccagcaccatctgaatacactgcttaggctgttggggccatggcttctctcgataccaaataggaggctgtggacatcatcttggcaggaaacgacagtggctaggaccacagtagtcaccgtagagatggagagaagtggccagatcatagatacattttgaagattaagcggacagaatttgctatggattagatgtgggtgaaacagagagagagagagaggatagctccaacatgtgctgtctgagcagctaaaggggtggagcaggatgaataaagtaaagaaaagattgaaatggagacgaagggccactgtaagtgagacatccagacgcagcccaatactcccaggggagcttgcttacggcagattccagtcacaagaagcaccaaaaatgtctcctctttcatttatacatgacgcaaaatcaagaggataagctgctccaatttgaaagccacacgttcctttaagggcagggctgggcgaatgggttcaaccctgactgctctccaccgtccatgcaggaccacagcctagggtgaagggggcccttctctgggtgttgctgggagggagaaatattcctgagatgagcttaagacacagcacttctcccctgtggtgtgagagccactgtgcctacaaggacactcacagaagctgtcatttgggattcgctgccaagagcagagcacggctgttgatgcgtcgaaactgaaaagccttcttcagctgggtgggcaagacggctgtctatggagaccctcctgagtacagatgcacctgcttttagcctcacatagacgggggctctttaggactgtgggctgaccctgagaagaagccccatggaagcctgcttatctccaaatcccccgtcctttctcctgaaagacagtctcagtgagtgaagttctagcattatagatttgttcctttgtaagtctgacaggatttatggtttgcaaacattttttatgagaatgaaaattactttgggaaaagtcattcatttaccacccttactagtccttccataggaactgatttcctatacgagcttgagacatatttggaattgggcaaattcctgcagagggtaagaggaccaggaacaatgaaaaagtgtggctgtccatgcaggtaaaagggccccacaggctcatgtgaattactttatttaacagcatcctctgctgttgctgaggagagaggagtggccctggcttctcagtcatattttccagccctgacttgtttacctgtctccaagaattgacccaaagtaacacctttaaaatggaatttattctctcctctattttaaataacacctggatgaatgagagtctttacaacagatacgactagaaggagagacgctaggaaacacagagggaaacatgggtcatttgcatctgcagctgtgtgtgtggcagctcaacactggaagctaagttttcctattcaggaagatgaagctctcggtgtctgtgccccatcccatgcccctggctacctattcacatccggggccaattagtgctgttgaatttattccaaaatcctcaggcaaaatagaactctttttgattaccttggagttgacttctccctagttcctctccacaatgatttcttgcttttcaccgaaactctttgagaagttctatttttttgtcattggtcagagcagcattttattttgcatttcaattcaatttttagtgatggattttggatttttatgttcacctgccaactactttaacccagaaaatagcagcattgagcagttcctgacgtagcggaggtctaccagttgtcatacagtatcagctgccattaccccttctgttgtgtggtcctgagactggtgtgcaccttcacagctcaagggtcagtggttgctgcaggcaattctgctgttggataaatgcttagccctttgagctttacatatttttaacagaagatcaaagaagctgaaagagtgatggaaattaaactggtcttatctatctatattttaatgactgacttggcatcctagtgtggtagcaagaactttggactgaaaaaaatatcacttcacagctgttcggctgtgtgacctgaagcttttttttttttttttgagacggagttttgctgttattgcccgggctggagtgcaatggcacaatcttgactcgccacaaactccacttcccgggtttaagcacttctgcctcagcctcccgagcagctgtgattacaggtgtgcaccaccatgcccagctaattttgtatttttaacagagtcagggtttctccatgttggtgaggctggtctcgaactcctgacctcaggcgatccacccacctcggcctcccaaagtgctgggattacaggcgtgagccaccgtgcctgaccaacctgaagcaatttaagtggactttcaaattttcaattttcccattgggaaagtgtaagttttgggaaaagtcagtagtttttacattcttttgttctgatgacgcttttttgtaaaatccacatgtggaagccattagatcattttgtggggcacagtttgaagaccacaggacttcatgatttctgagatctacccattcttccaatcccagcttccagcatcctctgggtacatcagaacctcccagtaaaaggatggtgttggcagctgtcctggaaatgctcagcctcgctgggaatgggtcccctcttacttgctgggtgaccgtgagcatgttgatcccacctcagagcccccgcttcctcctcctctataaataggaccatggatagtagcttggagaattcaataaaatatagtgtgctgaacactcagcacgtgcactaggaagaaccaaaaatgagcagaaccctcactgatatttaatgtcccctaatttgtcaagggacattatattgcataagatttgctttaaagaaagtaaattcctttcaggcaagttgtttgagtcaccaataggtttaaatcaaaggaagtttttgtcctcacgattttgcattttttagtgcctttccacaacaaatgtataaaaggagcattatttttaagtgtaactattttggaaacttcttacttaaaagcaattttctactacaagtcaaaggattaaagcaaaaaaaaaaggtgaatctgcagcagcatatattgtatatgttttctagaaatacttttttaaagaaggcagagaaccctaagctaaaagcagaatttaaatttctagcattcattcagcagctgtctctataaggagacagggttgaattgtgtccaagtcaagcatcagatttccagggaaagcagaggagaaattagaaagtgtgcaggaagcagcagaaatggctgttaaaaggtgatagccttctaaaattgacaagacttcttgggtcagataacagatccaagggctagaggtctgaattcaggcatggtcgggggaggaggagggggaagtgtacagaaaaagtgggtcagtgccaagggcatctcagcctgtttggaggaattcaaaatcatttaggtaaagggttagaggtcagaaaaaatgatcagcacagcagtgaggggtcattgggacgtccttggatggaagtccttcaacccagcagtgttgcaaggcctcaggttcccggtacctgtcagtttttgcagctcgaggaggacagcctgggatctcaagcttatgtttcataaagttgccatcctaagctttggcatgacaaagtctctctccttgacaacgttccttagggccttctcagcccttttctcaatgaggattccacgttggctcccatcctcgctgggcctgcatacctccttttcagcaagaatcctgctgaggcagtttcacaagaacttcccacccttaatgcctgatcatcacaggcatcctatcaaatttcatacccctttctttgatgccttatcaccttggcctgccttcagcaaggatttgttgttattttggttgtcatttgtttgtttgtttgttttattgaaacaaggcagattctaggctttatgattaaactctaaactaatccacaggctgagggccagatattctctcaccacaaagcatgagcacatataagttcagtcccatgccacaaacatctgtggccctttcaagccagatgtgaaatcacatcctgaccaaaaatacaatttttttaatgtgacgttttcgagtgcttttaagattttatctgtacctaccatgacattcatcatttaatcagtctcactctgccaactcaaggcgactgtatatcatgctttttaaaaccatcgaacatgctacaatgcccaaaacacatccagattgttattgcattgggtcattgcataatctttctggcttcgcgccgctgcctcctaaacttccccagccaccagcacaatctctccaggagcactatactgtccctgaaagctcctcaccccatccctggagggcagttcctgctccccaaatagctcgagcctccttgcttgtcccctttaatcccccagtgcttggggtacccatatattgacaacgggtgttaagaaacaatgtcatctaaaaccccttccagatgcaattacattttaactcaatgggaaatggcttgtcatacacttcacgaggaatatgaatgttggcattttaggaaactgcagccagtgaatatgaaagagatgctgcccaaagggctggtcatccagggtgccacctgccaaccttgtggtacgagtgtcctgggctggaggaaacctgcctctccagggacatgggaaaagaactcatcatgggaaaaagaaccatcttctgcctcaaagacagcatggttatgtaggaagattgagaagagtaaatagctccaaaagaaaaaacaaagtaaaacagaacaccaagtaggagaatatcaactgtaagtatacgccaaagtgaattaaaatccaccatggagaagaacacgcatgctgagaggggctctctccttggctctgccgtcctgaaggcagtgtggggagagaaggagctggcttttgatagcaatacggacactctgggagctgtgctgaatgtttcatactttccttaatgtaatttccacagcatcaccacaatcattactgtctctgctgtacatggggaaaagcttgagttaacagaagttaaacaattcaccagtgatcacacttacatgaaaaagccaggtattctatctgtctgataacttgagcctggccattacattcagttctgctgtctttaaaataaaaaccctggattaagtca

SEQ ID NO: 928 - DNA, 419 bp, Homo sapiens
caatatgccccatttcgctaacctccactgagccccaagctctgaagatcaaagtcaaagcacgaaatgaacgtgagagagctggaaagctaactacaaagcctctaaaagttacgtaacatgaagaaacacactcgattctgcctctcccattgaatagagcaataaaacatggacacaacacacaaagcagctatttgaggactctgagaaggaaatggcagcacacagattgggggagaagaccagaatttgaaatgctgctgaaccacagtagagtgatacaagatgtgaccgttgaagaatgctggatgaaaggcgactgccttcatggaacccgtatggactccgtgtatattttttgggtaatttcctatgactcagtaattatttcaaaataaaaatgtttaaaaagtgaa

SEQ ID NO: 929 - DNA, 592 bp, Homo sapiens
gctgctgggataccggaggactcgggtcccggctcgactcagtcctccagccgcccggggaatacctctagttcttcccggccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgcactgagaaaacttcagagacctaaactttttccagagaagagaagctttactggtgttccagccctaagaaacctttgttcaagaaaacggcagatgctctgttgaatccactggagattgttctgatactaaggacaagtatcaaccatctttcctgtgaaaaattccctctcgtactttagttctgtggatccaaaatttatagcattcttctaccaccacaggggctcatatgacattaacagacaagacacttttcagaaagacag

SEQ ID NO: 930 - DNA, 448 bp, Homo sapiens
gtaatatgaaaaagttatttaaatttcatttcacgttgtccttttgaatcctcgcattaataaaatcgttttcagtggaaatatcagcagcaagaaatagaaaatactaacagcaagattttttaatgcccataagaagcagcttggaaattgacactcggttgccaggcacgttttacagctttgctctttaccatggaccagagataattttccttatggagaatttacaagtttccagatgcattatgctgaagatagccaggatccagtacaaggttggtatcccactacaaagcaagggcctgccacaaccagatgcatgtttcaacgacatcgaaagactcaccttggactcatcgctgacttgtcaaccagaactccaatatctgagtttgtcaagatctcaaaggacgtggagtgcatttgtattatcatataaagcacg

SEQ ID NO: 931 - DNA, 756 bp, Homo sapiens
gctgccttgcacttagggaaggttcacatgcctcaaggatctctctctctcagatttcttgactttccctcagtcttcagtatagtcctcctctgtgcctggtgaagacctgtggtaaagtgctggcagagaggaagctaaatcacgtaaaaattaagaaacagctcagcgtttcacagctaagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattagaactgcttcttgctgccgccatatgaagaaggacgtgttcgcttccccttcctccatgattgtaagtttcctgagacctcgccagccatgctgaactgaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctg

SEQ ID NO: 932 - DNA, 806 bp, Homo sapiens
aaataaaaggatttgactttgggctgacaatttagcatttaaccactgtctccgcaccagttccacaagagcagggatttagattaattggaaaaacctcattggtttctgatggagggggcattcatagaaacaacctactgacaactaaggagctactgcgatgggatgggcagcctgcagcttcactcggtgggcagcctccacaggtatcgtatctgatttcagatacatatgatggtctcaagtgtgttttttaccaccaccactttgtaggcctgttgatgccactgctgttgaagtctatgtgaatggtgccccctggtggaaggaaaaagagaatgggacgccaggaatgtcagatgcttttcagcctctcccctgctctcacgcctagaaacaagagctccacaaaggtctctcattcctcaaggctgatgaaaagcccagcagctaaatggccagaagcctgtctttgtgagaaagcaagaagtctctcggtttgaactcttcggtctagagacagattcttctaccagtggtgtaaaaccctaaagaggctctgcataagacctaccactgctctgtgtctcatgacaccctgcccccaccactggaaggccacacttattctttgtgttcatgcttctctatgatctgcaagtttcccaagaacacctggattcgaagctcaagtccaccgctaaatagctatgtgacctaatgtgtcagatggttataaggattacagagaaagaggtatagatagagctggtagcagtgacagacacatctttacatcatat

SEQ ID NO: 933 - DNA, 589 bp, Homo sapiens
gctttctgactccactcttcctactctggcttgctaatcaactttacctggtttgaaatgcccacccttatatacaggcaattatgtggattagaaattaaggatgaaacatcttcccaaaaggtcactgttaagatttacccatcatcttggtgctcctagctctctacgaccaacacagagtggctgacacttcaaccaggcagcttggattgcaatgaggacaatgcaatgcatttgggctggaaacactgcacagaatttaactgtatgaatgcactctagttcatctatgcggtggttaagagcgtaggctctgaagactgctagggttcaaatcccaggtctttcaacatcaactggctgtgaaacatgggcaagtgagtaaacgtttctgtgctttggtttcctcaccggtaaaatgtggataaaagcaattccttcacagggttgtttggaggagcaaatgactttatgtatgtgaggcacttagaataatctctcagtgttattatttaaccaacatttttgttgaatatttagttcatttccaggttttcactcttacaaatatactgtaattaacaaa

SEQ ID NO: 934 - DNA, 356 bp, Homo sapiens
gggaggaaatgaatgctaagagagtgaggtgattcatacagctgtgaaactgcaggttcctgaggacaggagccgcatctttttcatcttttcattccttatggcaccaagtgcctaataaacaacaataaaaaaatgaagagacaagaagtcaagagacttgcccaaagagacccagctaatgcagatggcagaggcaggattcaagaacagatcttttcattctaagtccaggacactctccagtcaccacaggctactgcctgtgtgttgattttattttgtgagtgggttgcattcattttcaagggtgtgtaggaatttagaaagcagaataaaccaaagagagcaagcca

SEQ ID NO: 935 - DNA, 1045 bp, Homo sapiens
ctcggggagtggtggtctccctttcctggagtcatttgtgggagttagggtcttatcctgatctttcctcgtcccccgctcccccgtcctccgaggtggcagctgcgtagaagtctggaacgttttttcttagagttccagaattgagactgaagtgtacccagagacacaaagaaatacagaagtccagaatgatcaaatgagatcactacccaatgaaatgatgggccgaggagccagaagttgtcctactacctgctttccaggtccagattccacgagagccttctgggctcccaccagagaccctcagtgaagactctgttgaagactttaagaccatgctagaaagcctcccggcagaggttcaggaagttctgctatgaggatgcagctggccccagggatgtcctcaggcatctctaggaccttgctggacggtggtggctgagacctgatatccacacaaaggagcagactgtggaaatgctggtgcaggagcaattccaggctgtcctgcccgaggctcagagctcaagcacagagatgtcagcctggaatcagaatcactggctaagtcttgctgcttgcttcttgctcagcctgcatatgagaagtcaaccaagcattctcttggatgcaagatccaactgcacccatgggaaatctgaacttccactttctttgagcttgtctttggttgtaataagaatccatcaaaacccatgtctggatctctctttggctgaggcagctttatttcctacagaatttctctgtcctcttgttaggacaatcagcctgctgctttgggcttttccaagagcctatttttcatctgctggatgcctctttttttttttttttttttttttgcactgtgtgacatgctttaatatatatattttttatgtatccaaagaggtaatcaactttaactttcagaattcatgaatcttggtttggtggcatgaatgaaaggttatgtaaccccaccagtaactcatttggggtgcccttgaaatattaaagtttggtcctcaat

SEQ ID NO: 936 - DNA, 622 bp, Homo sapiens
cgcggagcggctgggaaggaggggctgggaatcttggagccccttggcccgcggggaaagcgggtgacccgccctgcaagtgggatgcccccttcggccttctggagcgcagagcaatgcactctgaagccggagggtagaaagtgctggaatgcgcgcccgggcccaggctgtcgcgagccttcagcaagccagtgcacacagagagggctgcccagagatcccggtcagcgctcgcagttcgaggtggaacatggaggctgtctccccggcaagggtgcccactgcaagcacaggcgtgagaaatggcccagaaaagagtggtcagggcaatgtgttcttggcacgcccagcaagacctgccagagggacctacagacgagtgtctcccagctatcttaccagcggggaccttgaggtccaagtatccagtccggttagaaatggccgcggatccaacaggtgctggtgagtgggagaatacccctgagggaggaagaacagaggccgggagggagctgagtggatgtagatgagaaatacctggacagctgcaagctgtagtcagtgatgggcaactggaaccagagattccagagagagggagggagaaagagggagg

SEQ ID NO: 937 - DNA, 910 bp, Homo sapiens
ccgagcaccgtggagcaccggctgccagctgagaccccagaggggtaactaacggcctgaggaaggcatttcttcggggaacatggcgtgcccgtcgtggctacgttctgccaagccctgtgacgttggaggggagccgcctgcatcccccgctcagccagtgtttctagactccgagacatctggaactcggaagtgaggccagggctccaggaagactccctgatgacgcactggcccgcagcccaggctcagcttgggagctattggaaaacaggcatctggaaccacagtctgcagacccctgtgtgtactcactgtcagtgcggtgggaacaaaaaggcagcaacggctgggtcagcccaggaaagaagacatttcccagtggagagaatgtctgagtggatattgaactttccaggccacaaagaggaacaagagcattcaacactgaggagcctgcctctgcaaaggcaggacccacatgctggatgtggagctggatggttccacgtggcaaggtttgggaggcttctgagaacctggcctaatgattcctgtttcctcccttttcagtcatcatccgtttgcagcctctctttggtagcccatgcccctggagggtccttgttttcaggcaagaagatatctcagctcatcatgtacatttctgccccagccctagaatcagacatttctccaaggagtcctggttcctttcagtgggaaatgttcttagagacattataatctggacactaacgatgtctgtggaatttttacaagatcgccttggcttctctgtgcatgatgaactggagggacaagaccaggccagagagacaggtcaagagactttcgcagtggcccaagtgagatataacagtggcttgaacttgatcttaggtaa

SEQ ID NO: 938 - DNA, 1384 bp, Homo sapiens
tttagaaggcagctatgatcaccactctatcaccaatgtcactaaaatcagtattcttgattgcctgctggaaataaaaatgtaattgctaaaatactcagtataagttaagtgatacgttacaagtaaagatctctcatgtgttaagtttcaagtttcacttaatgttcttaataaaataatggtaatttgaattctctacaaatacgttcagcctgtagtattctaatttacagatgcttgagaacacctaatatttttgattaacttaatgtcaaactattatcctaccttgtaaatagcatagaaattttaactatagtctttaaaaaatcaaatttcattggtagggaagtgtaaatgtatggtttttttaaaacacaacattaaaaggttgaggttataactttcataaagatgaaatcactatttaaaagctgcacatagactgattattattgtttgtttgtcttagaagatgtatctttaaattgctggaagacatcatgaatattttcattgctaattattggtaaagtctttagtatatgtcagttctgtttgtgtgggtatggttgctgtagtgcggcttaaaaaaaaacagtgcttcatatcagtgaaagctcttctttggtttaatctgggttgtggttatattgttttttcatatcgtgtgagctgattgcaaggggttaacccaaaatgagccacttcacttaaaattattctatatgttagtttgtgaattctgttgttggtatttaaacgtacatcatagtttaatcatatcacataaagttgtgatttcaggaatactttatatttcttttgctgtttttgcttgtgacaattgactggtccaccacatagaatttcttagtctttctaacactaggtgaacatttgaactgaccagatgattttatggaaacagcatgagacagtggaagtcaaatctctattctgtaccttgctttgcccctttctggctacaggagcctcagaagtcattcagagatgcagcaaagtgcaggggatcaaaccattgatcgctgaatttgagtcttacttttgtcatttattattagctgtgtgacagctagtaaattaacttaatctctctgtctctgtgttttcatttgtaaatggtattaatattagtgcctctcccccagcgttcttaagaagattaaagcggttgatatttgtaaagtacttagaatattgcctgtacagctaattatttaataacattttaatgtgatgtgacctcattagatctgatgtctacaaacagtactttgagtttgagaattgttatcattttaagtgtttcttgcctttgttttcaatacatcttgaaattattaaacttaaactggtg

SEQ ID NO: 939 - DNA, 610 bp, Homo sapiens
ctccgcctcccgggttcacgccattctcccgcctcagcctccctcagcgtccggagtagctaggactacaggcgcccgctaccacgcccggctaatttttttgtagttttagtagagacggggtttcaccgtgttagccaggatggtctccatctcctgacctcgtgatccgcccgcctcggcctcccaaagcgttgggattacaggagtgagccaccgcgcccggccgattcttgaagaaactgctctcataagctaaggttccttatgattctgcaaggaagagaagactaaagcaaatcactgtctgaaaacataacagctggctaaagctggagtgcagtggcatgatctcggctcactgcaacctccgcctcccgggttcaagtgattctcctgcctcagcctcccaaatagctgtgattacaggtcacagtgtccatgtaactaactcctggttaagaggatatggatagaaggcacatgttcaacttctggcttctgtccttgaaaagtgtgatgattccatcctttgctgtcttccttcccgctgactggaatgtggacttggtagtgagctaccttggactatgtggatgaagacaaagat

SEQ ID NO: 940 - DNA, 912 bp, Homo sapiens
tgctggatgctgagaggaacgcatcagtggaagaaaacaagcggctggacgtggagaggacgtcaagggagcatgccggcggaagagcacaccacagacgccggcaggccaccgagcggcaggaccaggcggagtttggccggggcagtcggaggagagctaggccactaagcagctcaactccaggagataaaccatctcccttgtggctcctccgtcggctgagagctgcttccactcaataacactttgcactcgttctccaagcccccgtgtgatccgattcttctggtacacccaggcaagaacccaggatacagaaaggcctcggtcctttccacaagtacctctacttgaggtactcattgacctggttaacacaagctgcctacagacgccaaaactaagggcaccctggaacacaggcttcagctgtaaacattcacccctgggcactgccgtggggtgggagcctgcctgagtgtatgctcccctagaggtttgagctgcggggcactgaagaagtgagccacactcccatcgcacactgcgagggggacaaaggaacttttcctcttttaactggggcctcatctggaatctcggaaggtgaatgtctgccttcgaaaaccctaccacctgtctttcttgtggaaccatcaaactccaagtggacaggcaactggagcctcagataatgactcccctttgctaggaacccttagacagacctctgggaggaatttgactgccgttttctcaaaaacaacgccccctgtcagcgggaagcagctaagacaggtcatcgtccatattctaatagcagttagatgtacgttttcagagaggggaaatgatacaggagtgcggggaagggaagagtgtcatctctttaaatgatacagaagggag

SEQ ID NO: 941 - DNA, 2308 bp, Homo sapiens
gggaagaggaaggaggccgcggcttcgcgtcccgcctctcgcctggctggccgtggggggcctggacgcagtggcctcccgaatctcccaggaccctaatatcgcccgaggatgctgggaggaacgctgagccgacctctccgttaggctgaagattgcacaaaccatgctaatggccagcatggatggagggagcgtgtgagatgtgtggggcagcgtgctgcatctcagccaactccaggagccagttgatgtgatggactaccttaattgatttttgaatgttgagccagccttatgcatgtgggataaacccctgttgatcatggctggctggagtgcagtggtgcaatcatggctcactgcaacctcaaattcctgggctcaagggatcctcctgcctcagcctcccaagtagctaggactacagttcctgctggaatcttgctgttgcccattcaagtctggtggttcctgtgtgttggggtggccttgcttctcctgctcttagctctggaggagccctcggctggtgctgcagtgaatctgtcagagtcgtcctaaccagagtgcccccatcctgaatagaggctggataaagccaaacctgctgggttatagtcccaggggattgggcagtcctggtcacaagatatttaaggttgagggaataagttaatgatgctaagtaaataaagaccctgaattctttcccgtgagagattcaagaactcactcttggcatctgggataagaccctttttccggtaacaaacccctgccctggccctttcttccttctggaaaacttaaaaaaaaaataggcctcaaaaagactgcattaatctgagaaactgctgaatatggctactaagagaagctgggattttctgatttttaatgtcggtttcaaagagagcaggtatactttgcaggagggaaccatgctagctgcagaatcatggacgagctggaccacaagtttttacacagtgtgcatgcttttgttctcctgtcaacttctgttgttttcctgtcaacttctgttgttttcatcaaaagccatcaacccgcctcagccagggcatcataatgtacatgcaacagagtgttccaagaaactttcagctgagaccctaagaccctggacatgcaatgccagagtgaagtgtgaggaccacagctgtgcaggacatgcagaaaggaggggcagagagccaatgagatgatgtcccacgactcacctgtgtcagtggagaccgaaggagacttggagggtgcttttggagagaactgctgatgttttgtgagcctcactctctctgtgtgtggaaatgctggaggatgaaaccgtctaaactctcctgaagtcccgggaatggagttttaatggtaatgtgtgatgggatgtgtgttctcttatggtatgggagacacagaggactcacagaggactggcctctgcctcttgaccagggatcaggagagatgggaactgagctggtcagctgctcttcagagctggtcgaggagagatttctgctgtgctgggagggcctaaaaacatgcatggatggagcccaaggaccaggtgcagatcttatgcaagaatgaaccagggggtgacttaggtccaccaaaagactgcccagagggacaaaaggctatcagtgaaaagaatccacagatgaactgccagttcctcagggctgaggcaagatcttaattttgagtaggagcagagtgtattacctacaacaaggataccacagatgagaaaaccctagttttaaacctgctacatccaaagagagcaatgcaactctggcagtagcaaaaatgttgtgcctctcctttcctcactcctaatttcccatcccagagaagggtcagaaaccatcttctgcaagatgggaggaagggtagcagccagactgcaaaaagggagaagaaaccagctacctcttgctgttctcagtggcagactccccacctgcaacaggtcaggtctgttactggagagaaaagacaggacatttttaaattctaggtatagagcaataaaagaagaattcaagcaaagggatcaggaagaggattgctactaagaggcagagaaaccaatgaagccttttgccatctcacactggaaagacaaaaagtcatagaggcttgatttttataaggaaagagaagtgagaaactgacctcgatactttgttggacttgcctaaagacatttgctgaattctcgggctgtgctgggatggagattagaggccaaataaaaacctctggtaagtagtgc

SEQ ID NO: 942 - DNA, 785 bp, Homo sapiens
atcagtcggacacgattggcagggagagcacgtgtttttttatgagaattatgccgagataggtaacagatgaggaagaaatttgggcttgattgaagtaatgggggctgtctgtgaagctttgcggcagtacagcctagaaattaccttacttaatgtattctccagattatccagagttctccaaagaaacagatccggtcggtgactaaacaagtactcgctgctatattatccaggccatttgcttgatcatttcctctggttaaaagcaagtatttgttctttcaagtatttgttttgttcgggctccaaaagttaaagaggaaactatcaccccctaagaggaagccaatatcatttgtcacaagtttaaagatggacaaaagcctggatgacagcacatctgttgaaagcatggtttactgaatattttaagcccattgctgagatctaatgcttggaaaaaaataattcctttcagaatattgctgctcattgacaatacacttggttgcccaagagttctgatagacatatacaaagaaattgatcttgttttcatgcctgctaacacaagatctgtctgcagtccatggatcaagcataatttcaacttcaagccttattatttaagaaatacattttgtaagaccatagctgacatagattgtaattcttctggtggatctgggaaaagtcagttaaaatcttctgaaaaggattcacaattctagatgccaaagggaacatttatgattcacaggaagaggtcaaaatataaa

SEQ ID NO: 943 - DNA, 2456 bp, Homo sapiens
gactcttaattccttctggaatactgagagtgccgggaaatgacagcttaatgttcagggtacgtcttagtttgtcttggatcttgtgacagggacagctgcattagtcttggagtgaaagtgtatctgagtatgttgggccacatttgcagtagtttgttctgaactccagagctattgaccaagcccgtcctgccttctgaggtatggaagacactgaggcctcctgacccacggcacagcattctctgcttccagcgcgtctgccttgggccatcaccccagagagtttgatcaaggtctgtcttaccacaccccctcccaaattcttgcagctcccaaagctgctggaggcagcacctgagcctgtctctccgctgagcttcttcaccccaaggactgcctgctggctgcccacttctcatcaggcaaggccacagtgccatctgctggctattgggagccatgctggtcaggttgggagggcacaggagcatgctaggctgacaaggagcactgagctctccccacctcagctcaggaataacagaagtggcctttcccttaagcccccactgaccagagcccctcattcaggcttcagtcaccagagccccctgctcaagtcctttagttaccatggcctctaggtcagtctcctcaggaatcagggccccttgtgcagcccccagtcccaccccccactgaccagagcctcagtgaccagggcccctaggtcatgcatccaatgaccagggcctctttctaaggctctctactgaccagaacccctcattctagctccatggtggtgagggcacctcatttaggcttggcttcacaatcaggtcattcaatgaccaggacctatagctcttgacccccaaagaccagggcctttctcagacccccacgaccaggtcctttcagtgacctatagtcctctcttttaggaccctctgtgcctaggttactaaagaccattactcagaggacataaggagtggtgtttgtgggggctctttgatccccaagagctggacaggtcccatctgtttcctctgtttatcgtccccttcccactggtctccagagaggcctctggccactggggctttccattttgttttgcctgtgctcccgggtccctcttcagacatggccacagctgtgcccaggtctcataacaaaggtggtctctgttgagttaactaatcccatcccgggaactgtggcccaagaagactagattctatagcatggcagcccacctgggcctcgcatctgctggccctctaacaccagaccacacacccctgtgccatctcaccacctcccataggcaggcctcccatcacatctatctcaggccgtattacccaaaggccaaatgcttccagtcccagcatcccaccagtccctggcacctgtcctagataccaagtgtgacttttcccattttccttttcttccagacccaagcctaatccaggtcctacccttctcagcccccatcccacttgggtttatttacttattcaaacaaacatcaaatgagcatctacatattaggattctagataggggtgtggggtcagtgtgcagggacggcagcatagaagagggactttggttgagacttgaaggatgaataggagtttgccaaagggtcaaaggataggaagctatttgaggaagaagaaactgcatatactacacaaatatacagaggaccctggtcagccatgtggttggagcacaaagtgaaaagtgaggagagagggagaagagagacttgaacagggaagcagagaacaacagatggaagatcttgtagctgagctaaggagtatgaatttttttcccctaggatggaaaaacacagaagttttttcaaatttccaagtaggaagttatgattccaaaaaaaagaaaaagaaaaagaaaagaaggctttttctaattagaaaggtcaggttagtggcattgtggaagacggattggacaggggcaaaagtagacccagggagactagtcagtctagccagtcagccaacaagtgttttgtaagttctgtagtaggttaaatagttgcttcccccactccaaaagttatgcccatgtcccagaacccgtgaatgtgaccttatttggaaaacagaactttaaagatgtaatcaagttaaggatctcaggatccttgattatctgatgggccttaaatccaatggcaaatgtccttaaaagaaacaaatgcaagagaaggccactgaagacagaggcagagattgcagtgatgcagccataagccaaggaatgcccggaaatgtcagaagcagaaagagcagattctcccttcaagccttcagagggagtgtggccctgctgacatcttgacatcaaacctctagcctccagaacaatgagaataaatttatgttgccttatgccaccaa

SEQ ID NO: 944 - DNA, 1643 bp, Homo sapiens
actgagtgggaatgattagaataaaattgaggactctagcagcggacttagaatggtatcagcgggttctcatcctacaacctgactttggaagttggagataaggggtgtctaggggttgggtcagactccagttttggagtctgactcacagttgggcggagccaaggccccctgaggctgagccagaacctctgagagtgaacctggagactcagagggcagctggcagggctcacagtgtggggtcccaccctgcagaggctgggtcaggccctcaagggctgggttgctggcttcaagaggctgggccaggatgtcaaggggcggagttccgggttccacagctgggacagtgttgcccagagctgattcctgggacttgcagaaacgtgcgaagctgctcctgccgcacgtccaccaggtacctgcagatgggaagcgccctgtcagggacccagattttgatccccagccaggatgttccccaccctccaccccactgactcaccgggctaattccacaatcaagttccctccgggtgccacacaggccccaagctcagggatgagaagatggaccatactgcagagaggacggaggacaggctgagattcagctccaaatccggagggaggatggggctctgggatcccagacaatgagggaggaggggtggcaaaactggagtctgggtcctggggaaagaagggagcaggaggtctggactcctgggtctgagggaggaggggctgggggcctggacccctgggtctaagcaaggaggggctgggggcctggactcctgggtctgagggaggaggggctgggggcctgatcctgggtctttgtgagcacagctgcctccccgcttacccacaggccacatagaggagctggaatcggccgttgtagcagctcttgtggtggagagtctgagcagaatcgagcggcaggaagtggacgtcccagcctcgccgcgcaccttgactggctggccgttgctcgtccgcaggaggctctcgtcgtccgcttcgatgccgaaggccacgaagggccccgtggcgatgtccccccagtacccgcgcgctgccacgcgctccccacgctggaaaaggagggagagaggaggcaggtaatctagagatgatttgcggtgtatgggaccatgtgtacaggctatttgctgctgctgcactggcctcgtccctggatccctcgccgcagatctgtcctacacagggttccagaggagtcatcctaacaccatctgaccctgtccctctcatgctcaaaacatatttgtagccttcatcaccttcatgacatggatactgctgagttctccagacacttcactccagagtgcagctattgtgagaaatgactctttgttccccaaataagcctcagaatctggatatggggcctgaatctggatatggggcctcaacacatgctccaacttggactagaatgtccttctctctggtctcagttaactctgtccctcaggtctcagtgcagaagtcacctccaccacgaagcctcctctgtctgaccctctgttttaaactttttcctactgtaaatatgtcccattttctgaaaaaaatcagcatattttaaagtattctggcac

SEQ ID NO: 945 - DNA, 747 bp, Homo sapiens
agatcctaggaaaggaaactgggagcccgggagaactaaaattcccaattaaaagtgaatttaaatctgagctgttcttagacccagaatttcttgcctgaaggaggaatcaggtccccacaaggaaagaccctgcaactgtataaaaaaagaatctaaaaagatcatgactccttcagtcctttcccaaagagacctatggaaatttcctcaggaagagggaccaagcaaaaccccagaagagttgatctcaaagcttattttatgaagaaaattgacctgagtgacacaaagggttggactgtagtagatgtcacgttttgctgcctagatctccatccagggatgaactcttatttcctcagcttctttgtctcctcagcttctgggagggttggcagctgatattctcacctgagtccctttctaggacttgcccttgcctgaagagagctgtgctgcccaacatgatgcctcctccaaggtacaatccacacccagtgactaataaacaggggttacaaaggcatgcctgcttgccccagtttgggacaactttaccaggccaacccagcctcaaggctctccacaggaacagggaccctgaaagctgtgtctatgaagttattacaagatattggctactgtggtgcatggagcttctaggccagggtgattctcacacctgcctgatgtggatcttgttgcttcacacctgaaacatcatttgagaagcccgggaagtgg

SEQ ID NO: 946 - DNA, 431 bp, Homo sapiens
agattctcctgtttgaggaacgttgctggctagtgacatggaggagcactcaccaagagagaaggggttgattttatcactgaaagcccagctctgtggtacattctagaagctctcaacatctaatctgatggtgcgcaccagaagcttctccgtcctattgaatctaatgagaacatcacgtgggcaagcgttcagttaacacccaaaaagagctgcagccacagactggcactgcatcaggaaaggcagacgggaacacattctagtgaaatgcaggaagttagagacacgaggcaaaaaagatgttaaagagttttgtgtcagagatagcagaaactccttaattactttttggagtttggatttctaaatcacagctttctggaaaattcagattcttatcagtaaaagatcctgctttaggttat

SEQ ID NO: 947 - DNA, 1580 bp, Homo sapiens
gtagagcccgggaccgccgggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccagagatattccaggcccactccagggcagtggacaagatatggtgagcatcctccagttagttcagaatctgatgcatggagatgaagatgaggagccccagagccccagaatccaaaatattggagaacaaggtcatgtggctgtgttgggacatagtctgggagcttatattttgactctggacgaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcaatatgaagacttcgtagtggatggcttcagtgggttatataacaagaagcctgtcatatatcttagtgctgctgctagacctggcctgggccaatacctttgtaatcagctcggcttgcccttcccctgcttgtgccgtgtaccctgtaacactatgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgaccctgccttgactttagttgctggtcttatatcaaataagcccacagacaaactccgtgccctgcctctgtggttatctttacaatacttgggacttgatgggtttgtggagaggatcaagcatgcctgtcaactgagtcaatggttgcaggaaagtttgaagaaagtgaattacatcaaaatcttggtggaagatgagctcagctccccagtggtggtgttcagatttttccaagaattaccaggctcagatccagtgtttaaagccgtcccagtgcccaacatgacaccttcagcagtcggccgggagaggcactcgtgtgatgcgctgaatctctggctgggagaacagctgaagcagctggtgcctgcgagcggcctcacagtcatggatctggaagctgagggcacgtgtttgcggttcagccctttgatgaccgcagcaggtatgatctcgtgaaaccttgagagaaactgaatgaggaatgaaactattgttcctgtttcacacagaagaaaactgaggttggcactcatgatgagcccctgttctcattctgcaaatggtgaagctctctatcgtcctga

SEQ ID NO: 948 - DNA, 578 bp, Homo sapiens
ccgccatggtgttccagggaaaccagcttccgagctgtacttcagagccctctgcaaacagtgctacctagacaaggtggggtcagaggctctcagataagcagaacttgcagggcttgtgacaggtatataacctagtccttaagccctgtgggattttacagcgctctgacggagtaactcgatggctaaacacggggagtaaagacagaaccatcccagcactcagggctccaccctccgagtaagcgagcttcccactccacatccttagcaacgctggcttcatcttccagaacggggcatgagaaaaccgacagaccagaattcttcacaaaagctgccttcacacagccaagagcataattccattaatatgccattttatagcccctcagtcatttcagatacaaactcagttactttcacatctattttaaacccacaaacaattcctcattggggatgaaatataaacaacaacaaaacccgctccagttatttagaaaatcagacactctattcttggcaaaggagatctacttaaaatacataaataaataaacatctaaaaataa

SEQ ID NO: 949 - DNA, 2770 bp, Homo sapiens
agggtgcgtcaccggagcagatgcccggggcggttggaggctcccgggctcccgctgactcatcagaaaggcctgccgcgcggcccggggggcgggggaacgtgggggaccgcggggagctgccgggcaggcggcagccgaggtcgtttgaggcgcgcagagccggaaaaccccacggagacggctgggcgggggcggggcgatcggcactgaccaggtcacctgcagcgcgggctgacggcgggcgactgaaggagggagcaagtctcccacccccagcagccggcggccgcttccgaagtctgcccccttccactgcggagcggcgccccgcgggcccccagccagcgcgcccgaggcgcccccgccccgtgtcgctcgcgctgcgttattgggagaaggcggttcctgagcaccagcacgggcctcggtgacaccggaggtcgctggggtcttccccttccccttaagactctgggtctgtctgtgggaagagctttcattccccaccccactctatgccgaccctctccgggggaggctccactggcactgtagacaccacgtgctgggtaaaaaggcctggtcccagcgcttccctgtcactgactgctaaccacaaggcgccgtggcactcaggaaatgcggcaggggggctggagaactatcaggaaggggtgtgggcagagaagaggcttccaccctgtcttggaacacggacacagtccatggcattcaaaagaggtgggaggctcctctgtgcacgtgccttccgcccccgggacaggtggaggaggggatttgactggtcctcaccctctgcatttatagtctgggcacaccttgggcagtgccgcaggagggcgctgtggagtacaggcacatgcagaaggtgtggcgagggcttcctggtggagctggcagtagggcagggaccttgaaaaggaatgatttgaacagatcggaaaagacattccagacagaaacaaatgcctgaaacccaaaccgagaagcaggaaagagcagactgcgttctcggaatggcagggagtccagtttgactggaagacctgaggctcagaggcgcatcacggcccagatgcagaccacagaggcaggcacagtggcccaggaggaccgaggacctggagtcacggggttccgcccgctgcccctggggaaccgagtcatgccagttcccagacagatgaattccttccaagaattccacagtcctgctcaatcctagccgccaagcctcctggccttggatggctgctgtctaatgcagatcctctttcatccagatttcaaatatttttcctattctgtcctttgatcactaacgtttatgtttatctacatcagcatccctcaatcctgacggcactctgaaattatctaggggtgctttaaaaaagaaaaatgttgatgcatggccctcctccaggaaatctgattttattggtctggggtggggcccaggcatcagcagacttttaatgagcagttagagaggagaaccactgatggagatggtcaccagggagtgtccaggtcagaccgccacagaagagtgcagcctcctggccttcagacccaactgggacaaaccctgagaacagccttggcagacctccaggggcagctggactccctgaggctggatgttgcagcctctcccaggcatccactctgcagctgaggccaaagtttccaacgggaagggagggagagtctccgagtctgggccttgccactcctcactcagcatctgaccatccccacctcctggatctacagggttcatagaggaggacccagaagagggaaagtcaggctgaggaacttggcctccctgctgcaagggaaatgacatcggttaccaaggaggtgaccagctatccttttccaagactgaaaagcagaaatacggccctgaggctagagggtctaagagaacaataggaagaatttcctgacaaaggacaatgttgcctaaaggactcaggaagctctgtgaaaacaggagactcccgagcagagcaccagacccttctccaccaggcagtgtttttcccatatgacaggtgagaaaactgaggctgagagacatgtaataacttgctgaagcagcaaccagcacaccatatagctgaaatctgtagatcagcagttaaaagtggtagggcaagtcctctctgactttcagcgctaagagcctaggattctgtgtttttctgcttaagcctgggaatcagagtcctacaaaagccgcgcctaatcctgggggtgtgggctttaaacccagagagaaagcatgttattggaatactcctgcacttttctccctttgaatcccaccacggaaagaaaattctgtgacgtgtacccagtatttattggagggtatttcctagcaagaaaatgagggcgattgaccaggcacggtggctcacgcctgtaatcccagcactttgggaggtcaaggtgagtggatcacatgaggtcaggagttcgagaccagcctgaccaacatggagaaaccccgtctctactaaaaatacaaaattagccgggcgtggggtggcgcatgcctgtaattccagctactcctgaggctgtggcagcagaatcgcttgaacccgggagacagaggttgcagtgagttgagatcaagccatcgcactccagcctgggcaacagagtgagactctgtcaaaaaagaaagtgtggtacatctatactaatggagtactatttagccgtc

SEQ ID NO: 950 - DNA, 431 bp, Homo sapiens
ggtggcctagctgtccgtactccccaaacgcaaccttccagtcccaaacccaggcgttctaagcgctcaggacgacgatttgcgctcacgccaggaccctagtcttcattggacccttcctcattctgtcctcattgaggccatctgagaataggggctatctgagaatgcaggggagtggacatcgtgtgcagacagggagtctgattgtgagtgccacggggctgaggcctgcgccgacctggtctgctggtgctaccaggcttgaacagtcttcaaatccactgctattaggcaaattacctggctcccgctgaactccagcacctagaactatgtcacactcgtagtaggccgctgcattggttgaacaaatgattttgaaagaatgaatgtcttcctctgtgcctgcatttcctcagaaggctgta

SEQ ID NO: 951 - DNA, 6341 bp, Homo sapiens
agacgcggagccatggccgaggtgttgcggacgctggccggaaaaccaaaatgccacgcacttcgacctatgatccttttcctaataatgcttgtcttggtcttgtttggttacgggttcctaagccccagaagtctaatgccaggaagcctggaacgggggttctgcatggctgttagggaacctgaccatctgcagcatgtctcgttgccaaggatggtctacccccagtcaaaggtgctgacaccgtgtaggaaggatgtcctcgtggtaccccttggctggctcccattgtctgggagggcacattcaacatcgacatcctcaacgagcagttcaggctccagaacaccaccattgggttaactgtgtttgccatcaagaaatacgtggctttcctgaagctgttcctggagacggcggagaagcacttcatggtgggccaccgtgtccactactatgtcttcaccgaccagccggccgcggtgccccgcgtgacgctggggaccggtcggcagctgtcagtgctggaggtgcgcgcctacaagcgctggcaggacgtgtccatgcgccgcatggagatgatcagtgacttctgcgagcggcgcttcctcagcgaggtggattacctggtgtgcgtggacgtggacatggagttccgcgaccacgtgggcgtggagatcctgactccgctgttcggcaccctgcaccccggcttctacggaagcagccgggaggccttcacctacgagcgccggccccagtcccaggcctacatccccaaggacgagggcgatttctactacctgggggggttcttcggggggtcggtgcaagaggtgcagcggctcaccagggcctgccaccaggccatgatggtcgaccaggccaacggcatcgaggccgtgtggcacgacgagagccacctgaacaagtacctgctgcgccacaaacccaccaaggtgctctcccccgagtacttgtgggaccagcagctgctgggctggcccgccgtcctgaggaagctgaggttcactgcggtgcccaagaaccaccaggcggtccggaacccgtgagcggctgccaggggctctgggagggctgccggcagccccgtccccctcccgcccttggttttagcagaacgggtaaactctgtttcctttgtccgtcctgttgtgagtaactgaagcctaggccccgtccccacctcaaatcacacacaccccctccccaccacagagacaccattacatacacagacacacacagaaagacacacacagacacaaaatcacacacacaccctccccgccacagagacaccattacatacacagacacacacagaaagacacagacacaaaatcacacacacaccctccccgccacagagacacaccattacatacacagacacgcaatcgcagatacgcccttccggccacagaaacacaccattacacacacatacacagaaagacacacacagacacacaatcacacgcagcccctccccgccacagagacacaccattacatacacagacacacacagaaagacacacacagacacaaaatcacacacacaccctccccgccacagagacacaccattacatacacagacacacacagacacacaatcacacacagcccctccccgccacagagacacaccattacatacacagacacacacagacacacaatcacagataccccctcccggccatagagacacaccgttacacacacatacacagaaagacacacacagcccctccccgccacagagacacaccattacatacacagacacacacacacacacaatcacacacacaccccccgccacagagacacaccgttacatacacagacatacacacacacacagacatacaccagacacgcaaagacacacagacacagatacacagatacaaagacacagacatatagacacacagacatgcacagagacacatggagacacatgcaaaaatgcacagagaaagacatacagaagtgtacacacagacacatagaccacacagacacacagacatgcatgcaaacacacagacatgcagacatgcacacaaacacagactcacgcacacagacttaggcagcccaaattcagcgcctggggcataagttcctggaggggtggccaccttcagcccccacggtaaggtcctgaggaaccttccccttagacaagggatcatggaggaggtctcttccggagcctggagggaggcctcaagtggtccttccacctcggcatcccaaagtgctaggattataagcatgagccactgcacctggccccaacatcatttattgaacagactgtcgtttccacattgtgtttcttggcatttctgtcaaaaatcagttgaccgtaaatgcatggattcacttccgggctctctattctgtttcattggtctgtttgtttttatgccaataccatgatgttttgattattatagctttatagtatatcttgaagttaggtagtgtattgtctccagctttgttctttttgcttaagattgctttggctatttaggggtctttgtggccattactgacagttaaaatggccctggctcatgtctcctgggcctctacagtactttaggtggggaagtactgtggcccacatgtcccaacaggctgtgtgtggcacctgacagtgctttgtgccactgtggagcaggtgttactccctcatacgaattttaggattattttatttatttcagtgaaaaatgtcaatgaaattttgatagggattgcattgaatctgtagattgtttggggttgtatggacattttaacaatattaattcttccaattcatgaacatgggatgtcttttttttggcacctgatctcagatatgggacagctttctaattatttgtatcttcaatttctttcacaaatgttttatagttttcagcatacagatctttcacttccttggttggatttatttgcaagtattttttgtagctattgtaaatgacattgttttcttgatttctttgttagggtatagaaatgctacagattgttgtatgttaattttatatcctgcaactttactgatttcatttattctaacatcttattggtggaatctttagggttttctataagatcatgtcatctgtaaacagggacaatttaagttcttcctttccaatttggataccttttatttcttcctcttgcctaattattttggctgagggccaacttgttgggtttgttgttgttggtttttgtctgtgtcttttggtgtttcgtgttgctggcttttccagcacacagtcacagatatatgaggcagaaagaaaacccagggaactcctgtcatgtcattcctcaggtcccaaggtccctacatggtctgccttcttctctccaccttttagtgtttgatatacatacgtttatgtatgtagttatatatgtatgtgtaatacccagggaaatatacagagattttaactgtccttagtgtagggcgtggggacaggtgcatctattctaccttgcttggaagtggaaaaatcttcaagaaatcaatttatcaccaactggcatgacagaactcctggtttagtgtctagctgtctccactaaaatcaatcaccatgccatcaggcactctcttccctctggtgtgtactggtacctgaaacagcgtccagcaccctgagagcacagaacgcagcttcttatgtgccccacccaataatcccaaatcgagcacagacctgggagctgaagagacaagctggaggtcaggcagttctattacttaagcctggttcttcctgactccaaaagccaggcgccaccccatgctccttcccagcagaagctggttttcaccgggtcaggaggacaggatggctattcctgaccgttgtacagcagtgccacatctcctagtttccagaacatttaatgtgttgctgtggaggcctggcagctctgaagtagccccttgcgcccaggacaaaccgggcctggaggggtggggtggggtaagctgaagcttccagtatcccacgtgggcattctgttgctgagggcaaccgcccctccctgcaagggaggggaaggagcaggcaggcacacccttcctccctccacatttcactggagttgacctgtgtcctactgtggttgcacctggaccagcccagagggactggagtgactcttcccgcaggtagggcacagccagcctgggcacagggcctcactgcaatccctgcgccccgcctccctgggggatttccaggggttgtcctgctgcttggtgagctgggggtgtgggggaccacagatgaggcaggcgcctaaattgcttgggcggagtccggctgctctctccctccaggccctttcctgtgtcctcgggcccctcgggtccctgcaccaggccagcagcaatcgggtgtcagaggttcaagtccaggctgactcctgggacgcaccgactttgcccaggagggctggggagagggcagccccaaagtgtcatctttgattattctttgtccccaaagccagccttgggcatgtgcccagcacagggagagctgctgcctctgtgggcttgagtcatttttgcttccttgcccctctctgctctgtttggtttaaaaaacaaaaaccaacacccatgggtgaggcgaggcgaggcgaggcttgccttgatccacccgcttcctcccctgcagcctcgggccccatcctcccgcgtggccgcactaggggtgctgggggcggagtggggaccagacctgagtgggttctgggttcagcttcgcagcaggagcagctggggcatcatcagttgggcaggtgacccaggatctgagcaggaatcttccaggtggaggtggggccgcccctctgcttgccacagctgccttctgctctgggggcagcactggctgagaatccagtgaagtaaggcctttgaaatggttttgattgtaaaagtaatgtttatgtttagccattcctttttttattttttattttttgagacgggtctccctctgtcacccaggctggagtgcagtcgtgaaatgtgggctcactgcaacctccacctcccaggttcaagtgattctcctgcctcagcctcctgagtagttgggattacaagtgcctgccaccacacctgactaagttttgtattttttagtagagatggagtttcaccatgttggccaggctggtctcaaactcatatcctcaagtgatccaccctcctcgtcctcccaaagtgctgggattttgccatgagccaccacgctcagccatgtttagccatttttaaaaggtgtgaacagataattaagtctattagcaacattagaaaatttaagttaaaatttaaatgactctagcaagaattagcctttaggtgccctgggtccccctcctcaccgccccccaccccgccgccttctgagaagcgttttgtaatttttcttatttataaaatgggtttgattcaaaactgacttttcctcttcacagtctcacaggtccttccccaggtccaagaggctcttctgtgtcctgatgacaagtagctgcctagccgtggtggcacctcctatcacatgttaagggacccctccccagggccacacctggcagaaggtggcttatgatgttcgcagcttgaaagtagtgtaaaccaaagataaaattctaagcccactcccccagccatcggaatggacccctcctcttggccagggcactccaaagttaacctgaaaaaccggttcaggctgtgaagagaaggtggagtggacatgcctcatttatgtcctcctcccttttggaattcagcaaagctgaccagcatgaacattaacacagaccttaagtctgattagtggcatttacaatctatactctctgaagcgtgctacctggagtcttcctttgcatgataaaactttggtctccacaaccccttatcataacctagacactcctttctagtgataataactctttcaaccaattgccaataaaaaaattttgaatctacctataacctggaacctccccgctccaccttcgagttgtcctacctttctggacagaagcaatgtggatcttgcatgtatttgattgatgtctcatgtctccctaaaatgtatacaattaggctgtgcccagatcaccctgggcacatgttctcaggccctcctgaggtctctgtctcgggccattggtcactcagattcggctcagaataaatctcttcaaatatt

SEQ ID NO: 952 - DNA, 642 bp, Homo sapiens
attacaactagttaccattctctgtatttaacccagcgaactacatatcggaaactaaaatttattggagagattctcagaaccatactagaaacattaccgaggtctcatctagttttctctactgccttccaaggtttctactgtacaatttctcattgaaaactgcctcagcattttttaagaagacatcacttcccccttggggaagaaagaactcaatgacttgaagaaactgatgcttcaggtaccttgaaaaattcagctggttttgatgagaaacagtcaatggggctgttaggggtcctggcggatgcttaggcagtggctgtcctggattccagggaatgccccaaacccagtgatgcaggacccaggactccatctgctcattcttcataaggttggctcacaggtcatctgctgagaaggtcatcttctccgtcttcactgggctcactgaatgaggacattccaagatcccagctcatctcatttgagctttccttttcctaatcccatgcatctgtgtttgagaaaatcttcccaagtgatagatcttctattttccgatttcttccatgttgtattactttttttattaataataataaatacacatatttttggtgtgtacatgca

SEQ ID NO: 953 - DNA, 674 bp, Homo sapiens
aacagcagcagcgcgagcagcggggcggtggggcgcgggcccctgggcccggaccagggagcaggcagccgttgccggcggggctgcatggacgcaggaaagttggctcggcacccgacagacacgggctcggagcgggcagtgccggcgctcgcggaaataaggccgtggtgggcccctcccctccgcccccagggcgaagataattgtgaaacacctgtgccaggccctgggggaatgagggtgaacaatcttaaacatctctgccttcctggagcacaccttctaggttgcacagtggctcagagagtagacttggagccaggctgcccggttttatagccctgcttgacctgtgtgatccgagaataatcttgtttaatctccacaagtttgaggactaaactgggtgccacagagaattaagtaactggtcgaggttgtatcagtaagaagggagcacggaacagattcaagctcaggctggagtgcaatggtgtgatctcacctcactgtaatctccattcccccgggttcaaaagattttcctgcctctacttgccaagaagctgggattccaggcatgcaccacgatgcctagctaatttttgtacttttagtagaaatgggttcttgccatgttgaccaggctggtcttgaactcctgacctcca

SEQ ID NO: 954 - DNA, 2233 bp, Homo sapiens
gttttttaattctaaattttgatctagggagccctcagacataaggagaaaccaatatgttgaatgatggggtattacatacagaaggaccaagaccttattttctcctacttaagatggaatcttgttaagatgaaaggacagctttttaaaaggagaaggtcataagacagtttgaggaaggcattggaagaggaagaggggcaatgtctcctttgttttattgttggtatataaacttaaaatctcagttctttttatggcacttgtggagccacttcctctcctcaccaaaaaatgcccagtaccctgaatccgatcaaattactctcctaaagtataaggcttagtttctgtgtgctgcttcgcgagacagttcccacaaatcgagagtgttaatcagacttttgtgttttcttttttggattgctgttgtttgttttcatttatcatttgtctttgcctaagccaggctcatcaagaattaacagccatcaggctgccgatgtgctgacagcagacccacttagagtcctgtgtttgtaattccatgcatttgttattttacctgttttgtccctgccccttctagtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatgcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagcttt

SEQ ID NO: 955 - DNA, 622 bp, Homo sapiens
ccagggctaaacttagagggaagctgtcatcaccctagggcctgaggaggaaggggagaaaatactgtttggggggcctggtgggagctgtagctgggaggaggaccatgagggagaaaccatagtcatggaaggatgttgtcactgccaggaccaagacaccaagactgtgtgctaggcactgagttagagttgaagaccctcaagaattccactgacaactgaatcatcaaagggaaccgagccctgcccaaggacatacagttgttttcctcttccttgtcctttggagaagcacagctgaagcttcctgcccacaccccagcccctcctccttgagcatgaatgtgcagaccacccaccgccccatgcttgtatctacaacagctatgaggaagaacatacagattaatcaccctgctgcgggatgccagctacccagtggctctggcagccccagtcaatggatcctgcagtgtagccttcatcagtagagctgccactgccagcacccaaaaggtagcactaatatgcatgtgtgacctgaaaattacaatgtaaatggtggggcaacacatgtataggaaggtaaattttaattaaaagtctgttctccaactca

SEQ ID NO: 956 - DNA, 740 bp, Homo sapiens
acgtggagagaacaggaacacatgttttctgtactacatggctaatgcaggatacagggctgcagttgttgggtgaagctttgcccgaaagttgagaaatgggtgcagcgcaaggatgcagaacaggagtcgcagaccaaagcagagatccaggatatgaagcaagagttatccgcggtcaatatgatggacaagtttgccagatctgccaggctggaaagaaagatcaacaagatgatgaataagctcaaaactcatgtgaaagtacagacagctcaatcaggaatgctaaaatgggttataagtgttgctttctacaaattgccaggtaccgtgatcaggctataaggcagtcttgtggggttatccattacttgacagggtctcgctctgttgcccaggctggagtgcagtgggccatctaggctcactgtagcctctgccacccgggttcaagtgaccttcccacttcagcctcacaagtagctggcactaaaagtgcttgccaccatacccggataattttcatattttttgtaaagacagggtctcaccatgttgcccagactggtcgcgttttcttcctctgtttaaaatggcatttgttggacaagcatttgtatagtactatgtacttacttgaagctgttaatttttcattacaatgttttgtaaatttcttcatgaggccataatgcattgttttgtgctcaaattttgcattgtatttaaagcattca

SEQ ID NO: 957 - DNA, 3647 bp, Homo sapiens
gcagagcggaggagcagcagctgccaccggccggaagcctgctggctcggccgagaacaatggccgcctgtcactgtggacagctgtctcccaggctaaggcaaggctgcgctcccagggaatgcgggcagggagccagggcggagggcagaggacgagagcgaggaggagagcgcgggcacccactgatgctggcggcctcgggtattcgctttctctctcttctcccaccttgttccttttccccggatgcacgcatgcactagtaatgccgaatttagaacaacagggaaaggaaaggaaatggcaaaggaagggaaaggaaatggccgacaggaaatggcaaggaagggaaaatccactgcaactctgctgcctgctggcctgtccagggacaactattcagctgggtgggacgttgctacccccttgtggcacccctgctgcagcctgcgattcttacgccctgtatttctggtctaacatcaaccaacactttggcgaaatataataaaatgaaattactaggagaatgaaagaaagtcacatgaaataaaagccctgctttttaatgattatatcctctgtgaaatggatctgcagccctctccatttctgggttcccctggccacaccatgcttatggctgtcccaggagcaggctgacagacaagcttccaccagcatctaaccatggggctcatggacaccgtagagcgtctccacccaacagaatcctgacttgggggcagctgaggcagggggcccgagcgttgaggggaccacgctgctgccccgagacctgctggcatgccacctggccaaccctgacttcgcctgcccgggcgcatgttaactgagttacaacactgagggcacttgaacctggctgcatgaccagagatcgatcacctgtgagatcctctgtgaaacgggataagcatctttaatttcctgggctgttctggaacttcagtcagacaggacacaggagggtgtctgcaccacccacccctgcctcgtgggctgactgggaactatatgacctgtggagggctgtgaccgccaccctccacctcactggggccgcaagccttctctgctccttgattctgctgccgttgtgagcgagggccccagcacccttagggaccccaatcaatgggcttcccacaatgtcgtcaccctttgttgcctgctaagcagccctggggccacctcagaagaaacagaactcacaggtcacaggggccttttcctcctcgtcatcgtcctcctcctcttcttcttcctccctgggcaacttcctgaattcggaaaggtggggttttgctatgttgtccaggctggtcttgaactcctgccctcaagtgatcctcccatctcagcctcccaaagccctgggataatggcgtgagccgccacacctggccgcctttggtctgtttgaagagggacatggcatgatcagatggggcttttaggcctctctgaccctggtgtggagggtgggctggcaagaaggggacgactgtctaaaggagagagtctaagacctgggctgggcagggccatggtgacaaacaggagcagacagagtcgggcagtataaatggaggggcagggacagtgttgaagtttctattctgagcaactagaaggctcgtggtacagttaattaccctgatggggatggaagagtcaggcaggggatgggcaatgggctctgtttccacagcgacttgtgttccacggaggtcaagaggcctgagggcctgcaagaacatggtctgggcaggagatggagctgcggaatgaatgaggatagggggctgagtcccacagggccagagcatggctagcaaagtggggatgactccaggagtggccttctgggtgccacgaaggaaatgttttaagaagtgagattgggtcactgctttcaatgtcatagaacagagctgagcagttgaggaggcgtagtgggtagaaagggaggtcgcagcaggctgaaagcaaaccgacaggagggttagcgtcttttagcaggtaggcagggcagaagagagccacggggcagatcagggaaagaaacactgaagccatctgtggctgagaaggagggcagtggggaggagtgtctaaaattctgagccatccctggcttttctgggcagaaggggtcgctccctcagtggccctatggcctctaacatgcattttgacccctggaatctgccttctcacccagtgggggccctggaagctggacaacacacattcacccctgtgtgcctgtccctgagagtgggggtcaggggagcatgcctggggtggcgaggtgattctgcactgggccgacactcccggctttaactggaaggcgaggaccttccaacagcacaggctgacaggtcttgttccatgggggctgggcacccaaggtatctactgatggtctgaggaatctaccgggatggattcctgatttttttttttttttttctgagacggagtttcgctctagttgcccaggctggagtgcaatggcgtgatctcagctcaccacaacctccacctctcgggttcaagtgattctcctgcctcagcctcctgagtagctgggattacaggcatgagccaccatgctcagcagattcgtgatttttaaaatgaaagggtgactcatgggagaagcctctggaactgcctttgaaaaacaaccagccaagacatgagaaattagttcctctgccatttgggggtttcctgccaactgctgggttttccttttgcacagcagggaggaaggacgcctgtttcccttggtcccggtgaggccaggcctcagcttcctgcccacccgccactgctgctggggcagggaggcagtttccggctgtggggacccagacaatgcctggccaagggccaccatcgtcctcttcctggacacagctcccgcctcatcccagggtctggcctgggacacgccctagaggccctcagccctgagtcactgcaccatgcagatccaccctgattctggtccctgcagagcaggctcctacacaaggcaagaagatgctccagggacaagccaaggtgtatgcaaggcccaggtgcctgagaaacacgtctcaccgaccttggggcaggggctgttacaagaggcttatagtctagtggcagagacaaaaaccacactcaaatcattagtgtacggtatgcactgctcagggactcaaatatgtgacaggaggctccaaacaagagcggagacaaggcgtaaatagccccctgtggactggatgttctgactcctggatggcctccagaaggatgccttttacggtctgtgaaagagctcagggaccaagatgctcaaagcccttcatgcccaagagcccctcctcaggctgggacacgggaagcagagctcggaggtggaactcgtgactgtgtatgggcacatgtgagtgcgtgtgtgtggacagccaggcttagtgtagacaacgtgtgaggctcagaccccaagtgctgactacacctatgcacatccacacctgcgtgtgaaagaagatgctagaaaagaacaaaaataacttaaaaaataaatccaataagatggctggaacatataacaa

SEQ ID NO: 958 - DNA, 1991 bp, Homo sapiens
accgttgctcagagtccaggccggttaggaccagagcctaccccgggtggcatggtgatgatccagattcaggagacatgtctgagaaaggatcgttcagactttttgacctattttacatgaggaataaaggatagagaatcttcttcccttctggtctgactaggaaagccagagggagatggtgaaggagacacagagagagtaaaagaacagaccatgcccagcctctccactgcaggagcttggaatcaggactgtgagcttcatggagacaagaaactgtgctttttttctccttcctgtgaatgaatcccattgcagctttgattgtggttgaatcacctatggaagccatgcatcttcagcatgtagcacataatggacactcagcaaatgacaactgaatgagcaaactaattactctgaccttgagcagtgacttgtgtgacctctggcaattggttcaccatctgaatccctcagctagatacctccctctaatgctgctcctccatcgacaggcattcctcagcggtcagttgtttcccagccagagcccgcactggcactgatgtctgctattatcactggagaggccccgggacttcacttgatgctatcccactgggatgactgagaagaagtaggagaaaatcaagcaaaagcgtgggctcgtctaagtgtttcctcatctgtttcttggtatcttccttgcttccctgcttctcccagccccagacttccttgtcttctctcttccatccagaaagacacacatgccccttctaagtatcactttagggctgaagtccaaagtcttctcttagctgaaattcactgtgcacttgccacttggcagagactgcaaacagctcagtgcgtgttttcatagtcagcattaaaataataattgccacaacactattaaagttttcctcattgttgtaactgttggcaaaggcaaatgtctggggagattgactccctggaaagcttcattatgctgcgagaatatttttgataaaatttcagcagttcctgactgtcaacttcactatgtggttttttttaaagttgtcccccacccctctctaacaggtcctccaattcacaaaaacattcaggtcagttgttgagtaactgaatctttccaagtaattaacaggtagaattaccaggtagcaggcagtgtttgcttgtaatccgtcaatagtagttgcagtggggctaattgtcatcttgagtggccctgcaaccacatctaattaaaagtgtcaacagagagttatttctgtcttttgttcccactgctaggttgtacgtgtttacttcagaaatccaggctcaaagtaagacagatatttggaacatgtgaatatacaggaaaaacattccccagcaactcaaagtacgtaaaagcatttaggcctcattcctctgtccacctgacttttttggtttgtattagtttatatattcaaggcagatatacagtatctgataaatgcaagagggacatgatgccttttcctaagcagcaaagttatactttgccaacttgactgggagctgggctgaagggacaaaggcaggagtcttttaagactcactaacacttacctagtaatggcagtggctgccactacagctaggtttcttgcctttgattcatattctttctttctttctttctttctttctttctttctttctttctttctttctttctttctttctttctttcatgcttcactgaactgttttccagttcaaggtaggtagatctgccaaaactaaaaagcctagattgcatatagaacatgcctggatttacagagcaaggatgcaggaacatatttttccatcagcagagtctgggtcttggctaacttaaagttttgtgactgttcttgggatcagccctgggtgaagcctctgtgaggtccagctgactacttcattctcataaatactttctttgaaatctc

SEQ ID NO: 959 - DNA, 413 bp, Homo sapiens
cgcgcacgcctgaccggagcaccccgcttcacgggggcgttctgcgcgtccttcctccccggctgcctagatcacacggccccgtttcattcatttttactgaataacggtcgttggacaatttagagaagcagcagaaaccacgagaaaaacagtggagtcaaacggcggtaaggaccgacaaggctggcggggacattgagcaaacggcggcttctgagttggcacctgtccttcaccacgttgtgtgggaagtgtggggagtcgggattcccactcctccccagccttccggaaaaatgctcggaaatttccttccacattgacacctgattacagtctaaatagtaaccttattctgattgttaatgtaaccctctcgtaatctctacaaaaatactttagtttttcta

SEQ ID NO: 960 - DNA, 493 bp, Homo sapiens
tgagcaagtgcatgtgtgggaaccctcctgcctgctgggcgctcagctaggagtcccagaataccagacaccattatattcaaataccacaaaagatgtgagaattcaaactgagccatagctccatctcctggaagtgtatatcagcagcaacaagagtaaagacccagaggcatgagaaacacttcctcactgaagcactcacgttccgactgtgtgcaaaagaccttttgtgtctcactcactgagggagattgttcttcactcaatcaatgagaagaacagacgtcttagaaaaccttcagtacctgggggaaatgaatgagctcaaacacaagggaaagtcagcccgtgttcaagataagcccatctcaggaaggcaggcaccatgctcctgagactactttacccccagataagaaagcccttattgataagccaaaatcacagattattttattaagctcatattttaaaagaatgcaaagcttcc

SEQ ID NO: 961 - DNA, 685 bp, Homo sapiens
aggaccaggtgccacctcctctgggaagctttccctgcccgtccacagggtatgcctccttgttcctctcctgccatcggtttacgtgcctgtctccatcaacagaccaggagctcctgaggacagggactgagtctgcctgattcatctctgcattcctagcacttaccttggtgcttagtgaaagctcgaacctgcctgggttcccaccttgtctctgctacccccagctctgtgaactcagagtcatttttctctccccgagtggcaccgggctcagcagacactctggccatgaaggcatcttctgactcaagcaggctggagtgcaatggcgtgatctcggctcactgcaacctctgcctcccaggttcaagcaattctcctgcctcagcctcccgagtagctgggattataggcatgcaccaccacgcccagagccaactactaagcctgtagcagcctcccaaactgcccagtcttgttcagatgcacctccagaaacacaggggtccaaaatgccccttcccagacaccctgaggagtagaacagtgccagcaggctccagggatgagggactagctaccacattccctttcccaagcctcagtttccccacctgtaagatgagggatatgggctctgactttctgagtttggaaaataaagtgctccccaaactgg

SEQ ID NO: 962 - DNA, 2607 bp, Homo sapiens
tctactagagtcatagatgacaagtcccagtccttaacttggtaggatgaatacagatcacagcataggaagactggggtaccctcaggccaagggcgagcacggatcactgagttggggatggccatcaggagcaaagggccattgccgcccttgaccaaagaagcactgtggcatttggtaggcattgaatccatcccagccagccagctgcaacggagcaggaacctcatgtcggggacgattatacttggaatcaagagtagagaaatcaatatccttatcctccaaaagaggaaatttggtcttttgaatcacaagggacatgcttctctcttcttctacaacatgaggcacagtattgtcaaaagcaatgaaccgtttgttgacaagggtctctagcccctgtaattcctgccgcccttttccaaggtagacaaatctgggtacaaatactgtttcaaacataaagaagaagctaggaaggaagggtttagggacttcttgtatttcatctgcattttttaggatacgcaggtgaaccagctgagctggagggagcagctttaagcaagatactatgtagatacgctggttgaaagtcaacaacaggtcacttcgattactggcaaagcagagtggtccaaaatgcagggctgagtcgaactcggttacaagtctaccgtggaagtcccagatccggactgagccatcaatgccacctgtgacaaaaagtttcaggggaaggcagacatcaaatgaagtgatgtcacactcatgcaggcattttgtctctctccacacaaagctctgttttgattctgaagatgtcagaaagccttcatagtgccagagacaccagcagtagctttcagtgatggcacccacagaacctggcaagagtatcacacgttttagggggcagccacagaggattttgctgacaggctgaaggactaccttgttcacctgaagcacggcctctgtcaagtgtatgatgttatccgtgccataggaacagagcaaggcgtttccctgagggccttccagggtagacaatgccaatactgccccagagtgaacagtcttctctattcgggcacaactatagtgggaaagggttctcacaatgccactctcatgcccacagaacatcaatcctcctaggcctttttgcagatgggacctcccataggccaagcatcttactgtatccttacggtctgctgaagtgcacacaagatacttggctgtacaaggagagcgtgttgcatcaaacaccagcacctctgaactgcctattgccacaaagagttcctctctctctgagtcataggcccaagccaaagccttatccataacaagtagaggccaagtgataaccaggagatcccctgttactggagacaagaagcgcaataaaccatcctcagtggcacatagaatccgagtccagttatggccgcagcagacccgctgcacttgctggggagcagaaccacagacattgaagaggctataaaagtagggcaggtgatgcaatgaaaaactgtaggtggtctggcagaaaaaagtggtattatcaataaactgcagtctctgaagatcctcgtcaatattcagctgccgcagcaagttcccataagtgagattccattccctcactatgccttcactgcctgctgttagtaaggtgtggatctctggccggctatggatacatatcactgatgaggaatgggcttgaaagctgtggaggaagttaccttggtctaaaccccaagcgtggatctctccagccctgtttccagcatagaaattgccctgagagacacaagtaaaggagcaagtgatggaagagccactggcgacaggagtgaacttcacttcttccagctggccctgaccccggtgaatgaagaccctcactgtatcctcacacagagccaacagggatccctgggggccattcagggaaaatccctgtacaagctcatgatcagccataggtactatttgagccatctcgatgcccatgccatttggtaagataaaccaggtaaccacagcccccagggtaccagagagcagcaactcagcttctggatcatagaagaggcagctggtggagaaatgacagggcactgtacccagaaatctgaacgttcgacggtgatctccaaaaagcctcaggcgcatgtcaccacagtaagcaattaacatgtggtaggaacctgtgtggaccattgcttgaatgggcggccactgatccatcatgcgaagcctcatcttctctaccattcctttcatttctgtaccctttttttgtatccaaagtactgcctagaagaggatgagagatgaaagcctgactgtggaggtggatcattttccaaagtgtggggtagggaaggctgaatattcagatccctgttccctctggtgtgactaaggaaagactagacagcttgactttaggaatctcctagtacagcagctcccacttacccatggtttccctttctgtggtttcaactacctgtgtggtcaactgcagtccaaaaatatcaaaagaaaaattccagaaataaacaattcataagtttt

SEQ ID NO: 963 - DNA, 560 bp, Homo sapiens
gaattacacttgacagaggcagaggaaaatgcctgcagtctgcagcataggaggaaaaaaagcgtttcttgtcttctattgtgcagtgcccatgaagtatagcatcaagaaactaatgcaaaactgcagagatctttccgtgagataattgaatataaaatcatgattgctttttacaaatttggattcatcccaaatccattgttcttcaaaggcaggaaaagtgatcagagaaaaggtggacggtaacaacacttcaccttgagctgttagaataccagcatttagcataactgatatttgttgcaattaagccatgctacgttgagtgcaaatgggcaactacaatgaggaccactggacttctgaagttcaagttctattctgtctgaagacaatttccctgccagaggtcaaactttagcacacacatgccaacacagaagtcatagtcctgcattatacagttaagctaatgatctcgagaggatatcgtcctggataagggtggagcctacgcccaaaaacaagattacctgaaagagaaaagaaagggggaa

SEQ ID NO: 964 - DNA, 578 bp, Homo sapiens
attagctcaagtggtagagcgcttgcttagcatgcaagaggtagtgggatcgatgcccacattctccaagctttattatttagacatcgtgtctccaaacactcaggtctccaaacccaagttagtgtctgagaacaggatgctgctttggttcaagacgtaggagcagcaataatagagggctggtgatggctccctcttggcattcagtatagtgtagatctaccatgtaattaattctctgtttctttgaggagctgtgaaaccaagggacatatacaactgctcttttctccctgtttctacctgcagctttgtcctaaatgtgagacaattatgaaaagtgcagggcagagccacttgggtaaatacagccccggctttctgctcaggggacagagtttgaggcactgcagaggaaccagccaaagtatgagacccatatgttgagagtgacagtgtaaagttcaaaaaaatcaaaatgtttaaagatttatcatgggtcttgatgacatgatggaatctctctactctctggactgattatgtgtggtaataaatttactttttaaaagcca

SEQ ID NO: 965 - DNA, 447 bp, Homo sapiens
tctccgcgcgcttctttatcgcgtctcgctccatcagggaagcgactgcagaaccaagcaaaggcggtcatccgaggggccggcgaggccaggaacgcgtcgccgcgtgtccgtgaccagggcaccgcgccacggatgccagatcccaggctggagagagcgggttgccccagatccgcgggcagaggcgcagagccgaagcccggaggagaggagtttgagagccgccatcttcgggcggtgaggcaggaggaggatctcccgccaagcttgttgcttttccaagttagtgcctggcgtgtgtgtgggctgcataggggcacccctcgaggcccccttctcttctcccgcctggactgcgttcacgtttctaacatttctcagccccttctccccacatctggccttggcttacatagagtaagtttgctgtgagcacttgcctcg

SEQ ID NO: 966 - DNA, 1785 bp, Homo sapiens
ctcctttcctagtgtccccatctttgctgccttctgtgagtttgatcatgtggactccatggaggttggccactgctgggcaatgcagccaaacaaagtgagcaaaagtaggctggagggctccgtgggtgactggggctaggctgcctctggtgccccaagaaccctgaagccaccttgcagctcttctgaaatgggttgggggatccagctatctgtaattgtgaagtgaagaggatgtgactgccaggtaatgctaaccccgaatccttggtgcctgtgttatgcaccatatgctgaatttcggttccagctgtgtgctagagatggagtttcgccatgttgtccaggctggtctgggactcctgggctcaagcagtcctcccacctaagcctcccaaagtgttggaattacaggcgtgagccaccgcgcccagcctgctgagacttttgaatgtgttctgtttccactacacaattgagaacactgaagtaccagtgacttccagggtggggaagaaatccagaggctgctcctgaaaggggtcacccttgagtgtgagtctgttccaagtaaatcaagtgagctggaagatcggtgagcttggatttattttgtatctttttttttttctttttaaaggggagctgtagaattaagggttgaggtttttcttattctctttagaggttttttggctacctaatacatcagctgaactaatctgcagaaaataaatttatctttaaagtagagctatttagatgcctgagtaacaaactctatctcaatagaagctattggcaaaatgaagctcacctcttaggctgacagcactgtggaaatgatgctcaaagtttcaggggtgaaaccagattggcttctggccaagggtaccttactaatgggcgtatttgcatttggggaggaaaagacctgtgacaacacagccacgtggttgttcctcataacccacagttgggtttcatctggactccctccccacccctaacgtctgccgatgtatctgtgtctaaagccatagtttactcttttttatcctcatccttcaaccagccctacatcttacgtgcctgctgtccagacttctcttaaatctatctgttcctttccaccccaactatcaactcaactgaatagccactaaatgaggcactgtgctaagctctgaattgcaaagatcattagggcatttggtcttattacttcagtcctgggttatgcacctgtgctaggaggtgcagctgattttcctgattatgcttccagacgtgccactccttctcatacacacaactcttgctcagacactgtcctgtacttcctgtaaggtacagtcaaaacctgcgtttttcagaggcctctgcagcctgcacccattgtgattgtgcagtcttagctccttttggccttgtggaaggagagtggattctagaaagatccctgcccagccacttcctgcccactgtgaccttgagcaaaatctctggctccaagtgttgcatgggtggtggtgaaggggtagcaaggaaacttgagtgggtttgtcagaactaggagcagtaagaaaacttgaaagagcctcctgtcttaagaaggcacttgactgcctctgatcaattcagggaggcttcaacagctcttaagaggattaggccaaaggacttcagtgaaacttttgtgcttttgttccctagagtggaaacccttgacacgtgttacacacaaacaacacttggggtggaacaagaggtttacaatga

SEQ ID NO: 967 - DNA, 1388 bp, Homo sapiens
gacaaggaaactaggagtaggagaagctacacattttgcccaaagcctcccattatataagcttcagagtcagaattggaacccaggcctgttggcccaaatcccacgttccttcgactgtactgcactgaggctaggggcgggcacttctctagcctcttcctctttctttctggagggaatgcggtagggagctgtagatcagctaatctcatccctttggggttctggtgagtataagctccagggagtttgggagggcttggcagtagtggattcctcttcccacacccaccctgcctcctgggaaaccggagctcagcccctaggacctggggtgtcacattcttccccatgctcctccttaggaaccttatccagctttcatcctcagaccctagtgtcccaccctaggctctgtctgccctggtgccctgtgctcccctgccctttccactctgattcagagtgactcagagtactggtctgggagtccaatagatgattctaatccgtgctctaccacttagctggctaagagatcttagctcctaaatatgttggtgttctcacctataaaatgggtataaatgcacctgcctcataaaggagcttattaaattacgtaacaaatgcaaaacatttagcagagttcctggctcctaatgggttcttagtagatggcagctcttgcggtgaggattactgcctagcctactttgttgttgttgttgattttgagacagagtctcgctgttgtcgcccaggctgggttgcaatggtgtgatctcacctcactgcaacctccacctcccaggttcaagcgattctcctgcctcagcctctcaagtagctgggattacaggtgcccccccaaccccacacctggctaatttttgtatttttggaagaggtgggatttcactctgttggccaggctggtctcaaactcctaacctcaggtgatccagcctcctcagcctcccaaagtgctaagattacaggcatgagccacagcgcccggccagcctactttggtcttttcttggactgaccccaaatttaggacatctcccttctttaactcttcctttcccatgatttgttcctaaagatggtggtttaaggccgccttcttcaggaagccctcctgggattaacccagcccatttttcccatctctcatccttcccccttacttactatcttttcatttccttttagcacatgattgttgagccagatatattcacaaataacaataataaaggcagatggtgatacagaagaatgtgagcacagaggaaggagcaaagaaatcggcaatcaaggaaggctttggagaggagatagcatttggtctagtcttagatgataagtaagctctt

SEQ ID NO: 968 - DNA, 3170 bp, Homo sapiens
aatgtgtagtcttctctctctcaccccctttcacccttccccccaagtcaccagagtccattgtattagtcttattttcatcaccgtgggcgtaccctgtgggatgatgttaaacgtactctagactctgttggctatttctctagagttagacctctggagacttctcagatagctcatgggtctctggccttgccctgaaattactgggttctcagggagatgctggagatggcggaggctcctcactctttgggtcctcctgtggctcattttgattgagttcctcattcagctggtcgcagtggccggatagtgtggcctgctcccttcctcaggttttcttgaggcagtggtcttttttgtagaggctttttttttttttttttttccctggaactcccttggaggtctcccttccctttcaaggttgtcttgggaaccttgatagtgcttctggacctaggttgagacagggcctttctcttcattacttcttgggtattggtgggtgggtggttgacagctaggctggaggctcatggtttcctggttattttcaccagcatctctcaacagtctcagctcgctcattcttaagatgtcagcttaaatgttatctcttcagaggcccccatgttctctcttgcaatggcctgttctattccattaggggactttgccatatatggcatatttgtgtaaaagttccatgagagcagaggttttgtttcctttatccctccatacacagcaactggaacaatacaatgcatagagtaaacatgcaacagataacctgaaggaatgctgtttcatgccttcattccttcctatacattattgctcccctaatgttctctgtgtttggactgccataacctcatctaccttttctccttactaccttctcattcttcaaaattcagctcatccccaaattcctctgagaagtccttcaggttgttcctctccatctaatctgaataagatgtcctttcttggagctctaatagcgtttagactagacactggtcctcagagtgaggtttctgcatggacagcatcaccgtcatctgggaattcattagaaatgcaaattatgaggccctaccctagacctcctgaaacagaaactctgggagtggggccaacaacctgcgttttaacaagccctgcaggtgactgtgacgaacacaaagtttgaggaccactagaatatagtcactgtagaatatatctccaggatctgacacaacgcctagagcaggattattgtgaagatcgacctgaaatctatcttcctgtagcctcatcaatcctggttgagaatatgaaaaactagttgagttgcatctctgttaggcagctttacaacatttgaggatagcgattatctctacttctccacctctcatccctagctcctctggtttaatgtcttttttttcttatgtgctataactttgaatcccttcactttcttccttggacttacctggacaattccaacttacttcatatccatcttaagtgtatattcaaaatatccttttagcttttaacctacaattctgaaaggtggaactatacatgtctgtaatcaccccagcaagacagagttcacaatgaacatagttagaattccatttgtacagttggaggtgttcctaggtgggcggattgcttgaggtcaggagttcaagaccagtctggccaacatgacgaaaccccgtctctactaaaaatacaaaattcagccaggtatggtggcatacgcctgtaatcctagctacttgggaggctgaggcatgagaatcaattgaacccggtagaggcggaggttgcagtgagccgagatcgcgccactgcactccagcctaggtgacagagggagactctgcctcaaaaacaaaccatccctgtcgctcccatcctagaccaatctaattgcaagtatctcacagggagcccaagtatcaatgtttttttgaacagctttatggaggtataatctatataccataaaatccacttattttaatatatgattttagtaaatttaaagacttgtgcagcccttaccacatcatacaaaccagaatgtttccatcacccaaaaagaaacttcatgtctatttagtcactccctgtttctactcccagctctaggtggccattaatctgagtatctctagatttgtcttttctagacctaaacatcaggtttttgtttttctgcagccagagttgagaaccataattctaaatgcattatgagaaataatggtttttaaagattatatataatattttacgtattttcatatttatgactcccatccttacagtgaatgcgtctatcaccagtaagacaaagatcattaatttgataatggaacttaacagaccattctttccttttatacattttagtatcatattcaaaatggcctcccattctgtccccaagttattttaaaacatctccagtcttgcttttttcccctttagctcataaatgaatagtgctggaagatatctcaggagcattctccctgagatgatgtcttcagtaatgatcgcacgtattggtgttgattccatccttgaagttactttcctttatctttcacagtggtgtttcttcactagaggttttgctgtctgattaacttctctgccaaataaatggacttttgcttcataggtacacaaacatttctaaaactttttttggaaaatatatttctttcttaaaaaaacaaatagtgcatgcacatttttaaaaaaataaataaaaaataatctaccccaaaatgaccagttaagatttactttcagacaactctgtgcatatttacatatgcttatatacaactatgtacacctttgcatagatgagatcacactctatgtactgctttgtaacttgcttctttcacttaatcctgagaacatttgtacatgaccatagatatagatttgtattgtttttaatggctgtatagttttgcattatactgaatcttgatgtttaagagctatgtatattgaggacattatttctttgtcttgtgttgcaaattttttaccatgttattattagtcttttaaccttatttatagtttttttgttataaaagttaagttttatgatgtaaacttaa

SEQ ID NO: 969 - DNA, 470 bp, Homo sapiens
ttgaaagggacgggcatttagtaatgagatatgcacagcagcatagtcagctgtgtggtgcattctcagctgtgcctcagcagccctgatgcagacatccagaaggagcacagccactttatccagagcaatcagccatgactgcctttgcactgtccatgctctcagcccaccacctcctccccctgccattgcagtggctaacactggagacgaagaccaagacaccaccgcctttctccagtaccactcaaatcagcacaggcaaggacaaaggcctcaatccacaactgctgaagatggaccctggccacatgggatggtcagacacgcctgcccagctatctgcaggcgaagaggctcagaagaggtttaggggcctgaaggacatcttgcttccatgtccatatgagcaggctatttctgctccatgagtcaattttgccatataaaatacttaatttcagcca

SEQ ID NO: 970 - DNA, 553 bp, Homo sapiens
aacaaaaaagctaaggataaggaagcgggatgtccctcctccaagtcttgctgaggctggaatgcagtggtgtgataatggctcactacagcctcaacctcctggactcaagtgatcctcccacctcagcctcctgtgcagctgggaccacaggcatacaccaccatgcccagctaatttagagccactctcctgatgctcattagcaagccagcctctggcccctcctaggcttggtgatatcacccctcacctgtcgcagctcctgcctctctcttcccaaaaacctctgcagctttcacttccccagcatgatcttagtttaggctttcacaaaagactggaagagcagtggcctggaagcaacatctgaaatatcaacttttttgtgaccagagacaccaagggggattggcaagaggaaaagatggagtcggaggctccaggctcagtccttggagctcttctctctgtatcctctttctaggtgaaattcacccatatgttgatgacattcaaatttacgtctccaacctggatctctcttttaaac

SEQ ID NO: 971 - DNA, 2002 bp, Homo sapiens
tggcttgaattaagatgacaaaggtagagatggggagaggtggatgaacttgagagctatttcaaggataaaatctaaacgcataccctggagttcagggacgtggattaggacaccctactggatcccatggagaaggatgattcaagggatatctccctgggggggtgtggttcttgtttgtggacccactggtttatttaccagaacatggctcttctatgctatcgtttttgcatcttgggtcaaaagacaacaaggttgctgaccaggtggcctctggtctggcatcctctggccaggcgggtcctgctgcacttgactgagaaagctggccgctcggactactgctacatttggttgaaatttctttttctttgtaacctagtaatgcaatatacctggaggtccatttatattattaagcttttaatacatttcataagtaatatcctacttactgaaaacatttactgtttaggattttcattagatcacttggataaatgcagaattcccttaaagttgacaacaatgaggaaacttacaaaacaagtgatttgtcaaaagctgaaatctgaaaaattatgttagttttggaggtctaggtaattaatacggtttggaaatagaggatcttagtgggttataagcacagtatatattcatgaatcgggctttctgggaagatgtgccacacactcaacagacctgatttcctttcttcctgcgactgcatttcccagcctcccctgcagctaggtaagatcatgtaatggaattctggccaatggaatatgagtggagttaatgtgggtaacctccatgatgggcaaagaaacacctcccaggaaaaagtcttgatttttcctcatgtctgctgactacatatcgactcttgaatagacttgagtatctgctgttgaaggatgcagaggctctgtcagcctgggcccctgagtgacttcatggagtataccatctctccaactggattttatctttcagtggttcagtttttctccactgtttccaccaaaataccatcaacagtaaggaagaacaatgtggaccaccagaaggctggagtgttttctgaagctgctcctgcttggactttggttggaagtcgtgattgtctgagggttcatgctggcgctcccccagtgaacctagctcacctaccctctgctctggctctagtctctcttcccttcttctaagggaggctactgctgtgctcagtgcggagctgggttcaaggagagctggggctctgaaggagtcgtggggagaaggctgacatgagtcctgagtgagtggacctgctctctctggccctgaaggggtcaagaggcaactgggtgtgtgggctgagtctttcctggccctgaagctggaagtagaggctttgtgcaggatcctcagcaggggactaaaagcctgtgctttcataacccgagccacactggcaagtgcgctgcctcctcccacctttgagacagttgccttcaggagcacatctaccagaagccaacaaagaaaagcaacagcctcttggaggggcctttctccagggagagaagggtgaggcagcacaggcagagctggtgtaggagacacaagacagtatgaatttcaaaatcagagcattgaaggagattcaaatatggcacaaaaagagtttctggagctaaaaatcataatttcctaactaaataccattcagtagattaactgaaaaagtggaagatcaccgtgaagatatggtcagctctcctggagggtcaaagggcagacagaccccttgatgaaaagggtggtatagagcaaatgtagaaagagatgggaagcaagtagaaatgggtaaggaacatgggatggatcctaaaaccttgacttgtgaatagagaaaccttgacttgcagaaagaggaaaaaatagaaccaacggaggagaggtgaccatgatactaacaataaaagaaaacttccctgaactg

SEQ ID NO: 972 - DNA, 132 bp, Homo sapiens
cagcatgtttccaagggctgtggctggtcatagccatgggatctccaactgcatgcaagagcaacctggaaagactttgacagcgcaggtcagtacaatacctgcaagctgccactcagctttcctataatg

SEQ ID NO: 973 - DNA, 173 bp, Homo sapiens
gattggaggcctttgtttgccgctcaactccaggaaaccacccgcgctcggcggccgccagcagtcctggaaggtgggaatgatctggagaccaggagtaagaagacctgagtttagatccccagcctggattcagttctgagtgcctcagttttcccttccacaaaatgagg

SEQ ID NO: 974 - DNA, 549 bp, Homo sapiens
tactttctcggagtctctttccagcctcccgactccagccacttggctggagaggcagcagggccgtcgccttggaaacgagtacacttccgacgtgctgaggtcatttcccgttcctcacggcccacgctacttccggtttcctttccctcagctattccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgaaactaccctgcttttcccccagttttggtctgtgaacacatttgggaaattcttctgatcctaccgctactctcttgagatgaagaaacagctcagatttgaccaagatcacacaagtaggagttgaggaattggaacccactatgactgactccaaattaatatagtgtttatagccacttacataataatggtaaaggttttatttttttcactata

SEQ ID NO: 975 - DNA, 498 bp, Homo sapiens
atgacagaaacttcatctgcattggcttcggcaaagcagaaatttattagcttacaaggccccatcttgtccatgcacctgtctgcttccttggcttcagagcattgcctccaagtcctctacagcacaactttcccttcagcatccaaccttatgatgtactgggatattgtgttgcccctctcccctctctacctgtgctgggctttaaggctgacacacctataaaccccaggagtggagggaagggagagtggattgtcattgagacatatgttctgcttacgtggagagtaacttgagcaacgttacccacctctatgtggaaacacaggtttatttagtatgttgaaattccagacataactatctgttcagtagcagtggttcctataagacaacaacttcactgttcattttgtgctagtagaatggaacttcacggaccttggagaagcatactccaaacactacaaatgatggttatactttggagag

SEQ ID NO: 976 - DNA, 307 bp, Homo sapiens
acagaatggcctggcacggtgaccacggagtgccctggcaccggtgcccgcggctgtgacggaaaaagggtgggaagaacagggaagaggaagcagaaacaggttatctgttcactctgatggtagagaagaccttaaatgacctgatggagctgaaaaccatggcgagaacttcctgccttcgatttctcacaagctcgggcataccacgaggcttggagactcaaaacctgaagagcctgcaatcagatttctcccttactattcctgctcattgtcttctgtggactaatactgaacatgaaac

SEQ ID NO: 977 - DNA, 673 bp, Homo sapiens
atccatgaagtcatgcttcacttatgcatcattcagaaaacacttcttggatactcactactcatgaatatgcatgcatatgacttgcagtcaaagccatgagttctcaatagcaaaactgttccagatatactcagagagttaaaatgtttaaaaaacttttttttaaagaaaattttccttttatttttgttgttttgttttgtttttttttagaagcaagatctcactatgttgcccaggctagagtgcactggccattcacaggcacgattatcactcacacactatggtcctgagatcctgggctgaagtgatcctcctgcctcagcttctcgagtagctgggactagaggcatgtgccactgcacctggcttagagtataaatttttgtgtcacacaagatatgaagaacatgcacaggcactggacccatctgtgggttcatctttctgtgggacccactaagggacccatctttctgtgaaaaagtcacaagtgaagtcctggccaggaattcaagaccaggctgggcatcatagtgagacctcatctctacaattttttttttaaaggaattggcttctagtcaatgctttgtcaaataccagtcttgggacattagatgaagctccttcatctaatgtttttctaatacataaaacagtaata

SEQ ID NO: 978 - DNA, 2097 bp, Homo sapiens
aaaatgtccctcagccaggtgcttagcccctggtaatctgaagctcaggcccttcctgatgccctggtctcctgcactgagctgtgtgagctcttcagcccaggtgggctccctgacactgatgcgcatagatggtgagcctggaggaagacttgcattgggcccaatggacccaggccagtggccatcagccaggtgcccaccctggtgtgctgaagcgcgggacctacctgttgtcctggtttcctacactgagctgagtgagctcttcaacccaggcggggcaccctggcattcaccagcatagactgtgaaatgggaggaagaattgtgttgggcccaatggccctgggccagtatccgtcagcctggtgtccagcccctggtgtgctgaagctcatgcccttcctggtgccctagtttcctgcactgagcttgtgagctcttttgcccagaagactccctggcattgatcggcatagatggcagcgctggaggaggacttgtactggggccgctggccccacatcagtgtccgtcatcccggcgtccagcccctggtgtgctgaagctcaggcccttccttgtgccctagtctcctgcactgagcttgtgagctcttctgctcaggcgggtcccctggcattgaccagcataggtaagtggatcctgctgggttcatgggccatgagccagaccacatggagtgactgagggtcagccttcaggacaggaagatttcctcggggagccaacctgaatccccaccgtggagggatgtgttagtcctccaggagggtggcttcctagggaatctgaccccaggaggacacctttgctgaagccctgcaggggtgatggtggtccaggctggaaagttttccttcagtctcatgtggggcagctccctgctgacattccgtgcctgcgtctgaccttgaggactgcccgggccacatgagtggggcaacaagggctccagggtgccacggggattatgagtggggctctccatccccggagagaggtgggcaatcaggcccatgtggtcaggcttgtagggttcggtggtggggagagccaaggtttccctgggtccattaccgtcactgtttcacctggatcccatcacatgggtccatggagggagagcatgtgtgaacaggcaccccttgctccctttcccacatgagcccctggttggacatatgtcctcctcctgtccccccagatggtggccctggaggaggacttgtattggggccactggccccacgtcagtgttcgtcagcctggcatccagcccctggtgtgctgaagctcaggcccttcctgttgccctagtctcctgcactgagcttgtgagctcttctgcccaggtggtccccctggtcttgatgggcatagggtgaggccctgtttggacccatcttccagctatctcaccagatggtgagcccagaggaagaccccgtggctctgggccagtgtgcgtcagccaggtccccagcccccagtgtgctgaagctcaggcccttcccaacgccctggtctcctgcactgagtgagctcttccgcccatttgggccctctgacattgaccggcatagatggtgagctcggaggaagacttgcattgggcccaatggagctgggccagtttctgtcagccaggtccccagctcctgatgcactgaagctcaggcccttcctggagccctggtctcctgccctgagctgtgatggtgagcctgaaggaagacttgcatcaggaccaatggaccctggcaagtgtccgtcagccaggtgctcagcccctggtgcactgaagctcaggcccttcctggccccttgatctcctgcactgagctgtgtgagctcttctgccaagggggggcctcctggcattgaccaacatagatggtgagcctggaggaagatttgcattgggcccaatggccctgggccagtgtctgtcagccagtttcccagcccctggtgcactgaagctcaggcctttcctggcatcctggcctcctgcactgagctgtgtgagtgcttctgcccaggcaggccacttggcattgaccggtatag

SEQ ID NO: 979 - DNA, 92 bp, Homo sapiens
ggatcgatgatgacttccatatgtacattccttggaaagctgaacaaaatgagtgaaaactctataccgtcatcctcgtcgaactgaggtcc

SEQ ID NO: 980 - DNA, 2323 bp, Homo sapiens
agaggcgcagcgggagggggtgctctcgggcgagctctccggccgcggcccccgcccctgcgctgtcgggcggggaggtcggaaaccccctggcgagaccacgggcggacgcttcccgaagagctgcctgggctgcagccgcggaagctgcgttctggggagcggggagcgtgctccggcgccttcgggccgctgctggaagccggaaccgagcccgggccgctgcccctcaccggacgccgcgcgccaccggccctccgcggggcaggggctgctgcgagctcgccgggcgccctttagacagtcgtccttgtctactccactaccaaatgttgaagttcttcaagaatcagtcctttggaggcatttaaggaaatctgtttctcttttggatcactagctgcaaattaagctaacagaacaggagctcagctggtcacacacagcaacgaatacagactttataaagttcagaaaagttaccaaacagtggtaaccataacaagtaccaacaatgaactatggggagggaggagaatctgatttccagagttaccacattataatactattcaaaatgtcacatttttagcaaagattacatgacaaggaaaaaccagaaaagtatggcccatacacaggtaaaaaaagaaattaatagaaactacccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaaggaaaaagaatgaagaaaaatgaacagagcataaaagacctctgggactctatcaagcataccagtatatgcatgaggggagtcccagaaggagaagaaagagagaaagggacataatatttgaagaaataatggtagaaaatgtcccagctttgatgaaatacatgaatctagatattcaagaggctcaaagaaccctaaatagggtaaactcaaaaagacccacaccggaatgcaaaagtgagctgggtgtggtggcacgtgcctgtggtcccagctactcgagaggctaaggcaggaaaatcgcttgaacccaggaggcagagattgcggtgagccgggattgcgccagtgcactccagctgggcgacagagcgagattccatctcgaaaaaaaaaaaaaaaaaaaaaaaaaactattgctgcagtcattcagatggaaatggggaaagaataatattaactgatttcaaaaaggacttgaagatgtgaatcatctattttgctgaagaaatcttaactctttgaaattactttttgttgctgttgtcatactcttaggtgccaaactgcggtaaattttttatcagtgaagtggaagcatgtgttttgttgttttgggaatttttatcaagtatcttcagagaagattatttcctgctttatcttcaaaaactggaaaggaagggtcaaagaaaagacagtagctggccggtcatggtggctcatgcctgtaatcccaacactttgggaggctgaggtgggcagatcacctgaggttgggagttcgaggccagcctgaccaacgtggagaaatgccatctctactaaagatgcaaggattggccgggcgtggtggtgcgtgcctgtgatcccagctgctcaggaggctgaggcaggagaatcgcttggacctgggaggtggaggttgcggtgagctgagatcacgccattgcactccagcctgggcaacaagcgaaactctgtctcaaaaaaaaagaaaagacagtagcttatgttcatgtcaagcacctctcatcacagtctagttccaaggaaaaaattcccagcgttttctacattcggtgctgcgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtga

SEQ ID NO: 981 - DNA, 3566 bp, Homo sapiens
actactttgttgttcttcacaattagttggagctttctttggtcaacagcagatgtgactaagaaaatcacgctgtttcacttagagcagtggtcaccaagtgtggtccttaggccacacaggtcagcatcacctaggaactaggaaatgcaagttcttaagcaatcccacccagacctactgaattggaagtgctgaggatggggtccagcaatctgtggttgaacaagctctgcaggcatccaggagcagagctgtggggcagcagaatctgtgatgacagagaatgatgatgtatttttgccagcagatgcttttgctcctgttttgataccccaatattcggatgcagaaaaggactctgagcattgctgacgggtgtgctctgcacacctatctcttcaggatctgaataatttggtggaaagacaatgccttttctggaaaagggtgtcaggtcagtcatattggaggatgcaaatttccttatgtgatgggagtgagggttggggtagggcacttcacggagcattcagcagtctgcaattaagcatcactccaaggctttctgcataggtgatggctgtttctgcatcatggggcaaaccaggtgctagaacttcaaatgccaattaccaaaggcgcttcctgcggaggaaacctctctacaactcacctgacccagaaggcacacatttttttctgggttaacataaatgctaaaattgaagaaatgaaacattctaaaggcaggatcatgtaggtgagatcctttgcctcctaagcttttgtcctgccagtcttttctgtgccttaccatgatacctgtgctagaagtcttctgggaagctcttgtatagaacctccaactctggcagggttagtcttcagggatgcttcaggcagagaccttctcaatatctatccttgcgtcacatgggcattgagtataagacagctgagttagggtcctgttcagagcctgggatcagggaacccgcatagtctaaggaatacaggagtccctcttcccactgccaaggacaagtttgcaaacctgactagcgaagcccttcttctgattaaggcaacgtggccccctggttatgagtacagatttccaaatccaattagtgtggcttttaatacctgctttgctatccaataggcacaacaatgaaaaagttgcctaacttttctctgccttgaattcctcatccatataacagagatgaaaaaacaaaacaaaacaaaaatttatagattagagttaaatgagaggatttgtgaaacttctgatagacaaagcatactcaaaaaatgggagtttataaaaagaaccatcaactagcaatgcaaccaatttagacaattccctctccgggtgtctcggcgttctgattctaatctctgagagctggctcagaacacaagggtggcccgcttggcctctaaagtttgatgattctcaggtcctgtaaaaggacactgaggaaaccatgaaatgccaggggagggaccaaggcactgtaacagggaaacctgagcccacagcgccatctagcccgcttggcccacgccccgctgtgcctgcaagtgtaacccgcccaagcatcctcctctttttatttttttaaagtataattaccggagcttatgtttcacagttaatgctgtcaagccttttaaactaattggtcttttatagaaaatttaactgaaaattaacacatcttttaataacattgccttaactttaatggctctctgcctttcgtttataattgctctaaaattgtcattttccatgtcatagctgccattttttatatttgctagttttcatggtgtagatttttatttttagtatttttctttcgtgagggatgaaaatgattggatttttttttccctaccccaggcctgcctggcctgatgtgacagcagtggtctgtcctgagtctagcaggacatacctccatgtacccgactgacaccactgctagctcctctgcctcgggacggccatgtgccctctgtctccgtgtgagcagttgaaatggaggctcttgagtggagtgtaagaaatagggttatggagcaataaattgtttatgtaactaaaatcacatggcattaggttagcttggactgatagagaactcaggcctctccataacaccaggttcaagggtttggcccttaatgaaagtacaggaaagacagtaaatcatgtgaacccacattccagacggtcacaccctccagtcttactgatataacttcgtttctggcaaacaggccagctctctgatattaaagatgagaacatggaatcatatcttctgggtaccccaactcatctacccactaagctcccaaatattatctaagatgtgtgttcatgaaagagagaaagagagaggataagtgcacacaaacacataaatatatatacatatatgtacatgcatatataccaaaaaaatctgcttctttgtaattacatgtgatcttaagaaatacgtatctgctctgtgaaagatttttatatgcctttgccattctccaattagcagaaagtcataaggagtaacatcattcccatttaacagtagaaaaaatgtgcaagggctgccggtgagccaggaccagaagctacaagtcctaattcatggcccagtttccctcctccaagtcactgcctttgttctgaaaatatgaatgcactggacatgcaaactcctgccctgggcattgtggtgcagtgggcagagcaaagacacacctgccttaactggctcacattgaaatttctctctagctcctgggggatcctgcgcatgggtctctccataggctggcattcacgcttctcagatgtatcgtacactagcaaaaggggcctctgcttttctctgctctttctcttaacactgttataatatgctttttctttatttttccagattaggtaggccctgcaaacctaaagcttcattaaatcttgttttctaaaaaaaaaacgacaacactcccaacttgtgtgcattggaactcattagctcttgtagtagggttcccctttttctcctcagaaggaggtggctcctcactgctccttcaataacgatggttcagtgtgattggtatctgtttaggaaaggtccaaggctcaaggaaaatggacatcatgtgcacaacctcctaactcagaggacaagcaagtgaccggaaggccaaggatgctgtctgaccacagacattgcaatgcagacacataagattagaagcaaaacgcaggaggctggtaaggccaggacagtgggatgaaccaagcagggaagggacatgaatgaagcaggcctggtgggatacaatagagagtagtgtggactgtggctaaagggagcagctgctcagctcaagccaatagctgctttacgggaatctgggactctgccttctgactctaatttaaagaaggcaggaaccccgattttatataaaatcttattttaaaatattggcaacaaattcaatttaaaaataaaaacttgataaat

SEQ ID NO: 982 - DNA, 2926 bp, Homo sapiens
acacacttgcttgcacgcacacacttgcttgcacgcacacacttgccttcacaacccgctcgcacacacgtgcacgcacacccttgcacacgcacgtgaacacacacttgcacacacatatgcatgtacacagccttgcacacacacacgcatgcacacagacacccacttgcacacacatacacacacacactcttgcacacacacactgccgcacacggtttcccccattctgtctcctgactctgcccctgccagcctggatgggggacacacccttcgcctcctccaagggtcaaaatcctacctggctttcaagggctggttctaagatcctctgctcctccaaggagcctgtccccatcccccaaccctatgtgcacttgtgctttgtacctctccatgtgccatcacagccaacctggctttgtatccctaaccattcatttattcattcactcgttcaacaaatatcagctgagcccctacacggtgtcaggcaccaggccagacgctcatgatgcatggggcagggttaccagggtgcctaccttcctggagccttaagtccagtgggggaggcactacagggaaacctccttgaaaacaagacctcggtggtctggactttggggggtctcttccccgccccaacctttcatggaggctgaaacatgacagatgccaaacagccccagccagagagacgggctggcttcctgctcctctgtctcccagttcttttcccccctgaacaggaaccccaggtggatccgcatccctggacccacaggtgagcgaccccggcggcccacccacacgcacctgagggcagggcgaggcaggccggggctgcagcgctccagccaccaggcgactcagcagcagctggtgcatctgcgcgttctgcagcatcatcagttccagcaggtctaggaagcggggttcagcaagcccacgccgggcctccgagtccccctccccctgacacccctgtcccgggggtgaagaatgggttggcgggttgtgctgcggggactcccagaggatgtgcgaggcagaagagggtgagtggtggtgatggtgggggtggggtggggggacccgggagtctcaccttccttcacgcggcctggctgcgggggcgcaggtgggacggcccacgagaggggctgcaggaaggtgacccagggctgggggtgtgcgcggagtcagccaggtggggtggggggaatggatggggacacgtcgcgagccccaacccccccggccagtggcctccctaaccccgcaggggccaggttctctcctccccgccccgcggcctccctgctccctgccacgcctcttcctctcggtttggggctgtctctcctcgtcccccacccctccaggatctggcccctccagggacagctccccactctgccgtctcccaagctaaggcaggatctgctcccgggctcagccctcaccgtcgggactgcgctctgcggtggggagcgaccccagcttccgcccgccccagaggccatggctggcgccggttgccttggcgacgccgaggacgccaagagagaggggcttcctgccaggaaagagtggtttctggagcagaccaaggaaggaaacaccgcccgaattcacggaagaggctgaggactctggctggaaacacgtggccggcttctcgcctctctccttgcggctatttgccctgtttcctggccaaggtagaaagagaacaagccattttgctcatcatcaacaaaccttgaccaaggaagtgtctgcgtgtgcaatgtgccatctgaaccctggaggcataagcagtatggtcacttgtcccagcattgttgggaagtgaaaatgtatccatggaaagagagcagaaagataagactacgccccggggataatgaaaaagagaggacttgaccgctgagggatggagttccaaggaagtcagtccttgatggggccaagcagcaggggaagacgggcgctatcaggctggggacagagcccaagccaagacccaggtgtatgaatggacaggacctgagatgacccggtgggtcaaactgtctgactgtagaagaggagctgggcagagagcagaggtccagggacaggccaaggtttggaatgccaaggtttggaatttaggcttggccctgtgggtaatggagagctatcagtgggtttcaagcaaaagggagataccaagtgctgtggccagccatgtttcaggaagattgttcttgtccacctttgtttatgtcaaccacatttagaagtaacaaatgtctgatagggggtcaggtgcggtggcttgtgcctatagtgccagctactcaggaggctgaggcaggaggatcgctcaagcccagggattcaaggatgctgtgagctacgatcacgtcactgcactccagcctgggaaacagggtgagacccagtttctaaaacaaacgaacaaacaaatgtctgatggggatgcatcctcccaatagaatactattcaaccatggataatgtgggaatagaatatctctgttgatgtgaaaagttgtccaagacagttgagtcaaaaatatcagtaagcatagtaagatcttatttttgttttaaaaatcatatgcataagtccaggcacggtggctcacgcctgtaatcccagcagtttgggaggccaaggcaggcagatcacttgaggtcaggagttcgggaccagcctggccaacatggtgaaaccctgtctctactaaaaatacaaaaattagccgggagtggtggcgggtgcctgcaatcccagacactcaggaggctgaggcaggagaatcgcttgaacctgggaggtggaggttgcagtgagccgagatcatgccactgcacttcagcctgggcaacagagactccatct

SEQ ID NO: 983 - DNA, 719 bp, Homo sapiens
cacatcctgcatctccctccagcttcagggaggattccaggagtggcgtggggctagagtggcctgagagacttcagggacaagtgcctagcagagttccacatacatgaaataagatgctttgggaaatcattcttctttttgcaacgtcagtgacttgaaccagaaactgatattgactcacttgggctctgactctttccaagttacacatctgggggcctaaggaactgccccatgagttcccggagctgcgatgggcatgggacgggaagctttgtaagcaattaatcacacagttagcctcatctgatcaccactggccacgatcaggccctctgaaagtgcctagttggatgcttgccaatctgctatgccttggaggaaaaaatcatttcaatttaagaaaatagacacagaagcaaaaaaccaaagtgagcctggaaggtttgcctgtctgtgacagtctacagagcagctgtttgtgcctgtcacctgctcaggctctcacggtgactgcatggggagggcagggtgtgtgcattgatacctgccgtgcccagtgtacgccgaggtttgcccatgctgcagctggaaggctgcagaacaaaggttcgttccaacctctacacttgaattgcattctgcgtcatcatcctgccttctagaacaacatccaactccgtgggctgccttttaaaatcttgatggagggggag

SEQ ID NO: 984 - DNA, 630 bp, Homo sapiens
gggggaagaagaaaagaggatgccagtccttgttcctaggccaagacctgagccctgtaatattaatatttggatctaaaatcagccttccaacagcaacatgaagttggcagccttcctcctcctgtgatcctcatcatcttcagcctagaggtacaagagcttcaggctgcaggagaccggcttttgggtgtctgacccttctcaacacagcatcagacagccacctctattgactgaagttgacaatggagaataaaactcattacccctgctgaatccaggggcccctttttacagatgagaaaagttccagaaagacccagagacataatcaggtacctgcgtcgagctctgcacaggtgactgggactgcaaccccggagaccactgtgtcagcaatgggtgtggccatgagtgtgttgcaggatgaagagttatcttaaggatcatctttccctaagatcgtcatcccttcctggagttcctatcttccaagatgtgactgtctggagttccttgactaggaagatggatgaaaacagcaagcctgtggatggagactacaggggatatgggaggcagggaagaggggttgtttcttttaataaatcatcattgttaaaagca

SEQ ID NO: 985 - DNA, 422 bp, Homo sapiens
actgacaaaactaccgaaccatgttcctggttgaggatacctgaaggtcgacatttatctgggatcttttgctgctgctttggtatgacttctatcaagatagctttcgacgagaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaac

SEQ ID NO: 986 - DNA, 435 bp, Homo sapiens
gtttcatggatgtatcctgtggcttctccatgagataatgaagttcttgaaagtgggagtgtcatttacactcctacctgcagacaggtatactggcacttattacataccaaatcctattccatgagctgtgcatgtagtagcaagcactgatgtaggttctcatgtctccattttagagatgacaagactaaggcacagataagcacctgatacagagtataaagcattggctgaatgcgtgaatcttagttcccgcttttcaccttagcatcctgactaccgatgccctgaacacacatggtgaatttggctgaaatgaagcattctgtgcctgccccacaaaccaccaagggactgtgggtttatttgtctcaagatggtcaacactgctgttttcacattttacttgctgtcaaatataaagagatatca

SEQ ID NO: 987 - DNA, 656 bp, Homo sapiens
aatagaacaagaattgagaggtcattgactgggggagtttcctagacccagagaagggacaatggcacagactgagtcaaattcagttcctaggacttggataaaatttatattgaagccactgctttgaatcagcgagcagtactgatgtcaagtttgcctattaggtagaaattcaagaatgaaatgatgatgacccttttgggaacaactctgtgcatcctttgtatcctgagagcacttatcaaaactaatagatgagtaataaatctttcaaaacaaagaaaaccgatggacaaagtggtgaaaatatagcatttgtctcttattgccaatgcgtggcacataccaactcaattcatatttgcatgaatttatgaaagcaaggatgaaaaaatatgtactaagatataaaattagcaatattatttttaaaaggttgttaaaagtcaaggccttttgggccaggctgttgggctgtttcttaaggatatgatattttatttattttaacatattcagaaacacctagtggtattaaaacctctgagattggcagcatttggccttttagagaatgttgactctactttctttctctagaatttattctatcattttttatgacagtcttaataaagatgattgaaagactc

SEQ ID NO: 988 - DNA, 591 bp, Homo sapiens
ccaggctttggtaacaggatgatgctggcctcataaaatgagttagggaggattccctctttttctactgattggaatagtttcagaaggaatggtaccagttcctccttgtacctctggtagaattcggctgtgaatccatctggtccttgactttttttgattgaaattagttgataacgtcttccaggagacctacggccatcctactgatatgaaccagatcatacctgccctgatgggatgccagagaaagactgctgcaagggatcctctggaaacagaacagagggaagaagataccttccctgaagcccagatgttccagaagcctgcgcctcattcacaaagtcaccccaaaaatgccctagagtttggagttttgaagaagcgggaagaaggcctgagtaagggcctgggaaccaagttagatcctacttcagcatcagcacatgccagcgatggtgcacacaggtggagagcggcctgcccgtcttttccatggtgcccacagacccatttaggatgaaagatcagaaaattctctccatgtcaccgcttctgaaacatgtgaatattaatatttggtgc

SEQ ID NO: 989 - DNA, 686 bp, Homo sapiens
taacaaggacagcctgacttggatcccactatgcaggaaggaaggcgactcttccccgcacctcttgctacgattaggacttgcgacttggtgaaaacaggaatcaaaacttgggcctatttctcctgaggtctgcttgcctagaacaattcgtaacgatgaatcttattaaaaagagaaagtcctccccgactttatctttttccgcccagaatccgataaggaagacttgttctggccccctcagctctctgacctcacctaccagaggagagagtgggatcctctaacactcgagccgtcatcccagcactaggggacagtgaccagtgtggctcccgtggccagaacccttctgaagtttgggttgccctgtggtcttcgccttcaaagcaggccgccacttgaatccttctggaacggacagtgttgctgtaaacgccgcggaatagtatcttctaagtattcgtagcttctttcttgagggatctcgggaacgttccgtgtattaaccactaacgtattccaaagttaacttcgtggtaaagtcgctggggaaaaaaataactgctccagttccacaggtgattgaaacaaaagtgatctgtttcccaaacttccttgatggtaaagaatgacttggggtactaattaaaaataaaaataattgcgtcatttccaaccta

SEQ ID NO: 990 - DNA, 566 bp, Homo sapiens
agtgccacagaactatctgggcctcttcctctacccctccttgtgtgatcgctcctttcaaaagcaacagccaaagcagatgcaagggagatgcattggtgctcataaattcaaggagctgaaatggcaacagctgtggcaatttcaggatttcagcaggtaatcaaatgggtcaaaatcaaagttgatgatcagtcatatgatcttcagcagccctggaagggtgtgagttctcggcatcccatgcaggagctctgaatgtacaagaggtgctgaggagggagcatgcgccgaataccactgccttctttctgtgtccaagcaagttatgactggaatggaaagtatagccacccggggctgtcagtacccctacctactcaattgcagacatgttgatacagaacatgatcatcgaattccagtgaagccacagtgatgggagtccagcaagagtaaaagcaagtagaaggaagaagcccagaaaaaccaaagcgcctaaggcccatgaaagctgtaatgactccttaccatgaagttctctctcctgataccatgtggagaag

SEQ ID NO: 991 - DNA, 2463 bp, Homo sapiens
gaacccctactaactgtgagctcctgaggagtcaggcctgagtctgtgggtcatctagcacatccttaatagaatgattgcctggatgtgaccaccctcacccccaaccctcacacaccctgccagcatgcctcagaccttaccccagctcaagataagtctcagattgcaggatacctgctgcagggaacaaaggtgaatgattgtcttgtgagcctcctgttgactgattctgttttacatggctgcacagagcccttgtggttatttggggttggggtggtggcttctgtattagtcacttctgcatgaaccatttcactcaggatctgaggccacagttcctttcttagtcactgatacatctggcagacttgaaattaatcagacaaacattgttcatagttaacatatccttggaagtttctcagctataaggaagaggtcttggtggctagggaggcctttctctgtatcctgttctatccagtgagagcctagagggtgctgcccagccatattctggctagcctcagcggttctcctgaaaaaaaattggcatctgacaacctggatggtgactataggtagtcaaatccagctggctggtctcctgggggttagcttccatggagctgcaagtcccctgaaatgatactggcagtgttgggacagcgtgtccgaaggcctggttttttcagaactggtctcagcaaaatgtctcgccaacttctacagttcccataagtacatgataactgaaacacttctagagccccccagcaatgggcttgtgcttttagtagaatatgtgcttgcttccatttaggggtaagaaggtgggcccctcaccatatgctgcacagagaagagagacaccatcactcatttattcatttaacaagtgctttccaagccactactaggtgccaagcacttcctaggtcctggggatacagtggagactaagatggagccagttctttctcatagggatctcacagcttagtgagtgagaaagccaaagagtcaaaatacagagagggtctgaggggcccattttgagagccatcatagtggtgaggagtgtgagtgctagagtcaggctgatcaaatcccagcctgccattggctagccttgtgactttgagcaagttatcttacttcgtggaacctcaggtttctcatccataaaatggggaagttggatagggtattatgatgattgaaatgcatttatacatgtaaagcataagtactggctcagggtgagcactcaataaacggcagtttattaggcacttttattaggaagtgatacaccttgagcaaaaccccttagagtataaggcatagcattcttacatatttttaaaatttaaaataaaatttaaaacatcttgccctttataatcagtccgccacaaacaagagatggagaaatcacccttccttgttttgtatctatggggtgcaaacatttaatcctcccaactgtcaaaaaagtgagagtttcacagcctgttttacagcagaggaaactgatattcagagaggttaagtaaatttgcccaatgccacacatctaataaatggctgagctggaatcaaggccagctcttacttggctgcaaaatccatgttttatgcagctcctccactatcttggcctccaaggcagctggctttgaacactacccttgcagcccagtcagccaatcccttgctctcctgaagcttttgctggtgggccagccccacctgctttccttgtgcactctgacttggaccctgaagtgagaagagttggcacaggacatcttacttccctgaaaacagtacctggacttttctgtatcttcacatccattgggcattgggcaaatgggtcatgcagatgaaaaccatccaagataagagacatgggagtgaaattcacacccactctggctttcataccatgggtctgaacattagcccatggtgtttcttggccatactgacctgtgccatttcagctgcattcatctcagttggtgttgtctgctggctgctctttctgatttcccacaggagcagtaagaacctgaggaagagtagggtcagaggagtctgggagaatgaggaaatatgagagccccaggaactgaaaaggcctgtgagagactctgagcttcctgggaacaggcgcagtggctcaagcctgtaatcccatcacttcgggaggccgaggtgggcagatcacgaggtcaggagatcaagaccatcctggctaacacagtgaaaccccatctctactaaaaatacaaaaaaattagccaggcatggtggcgggtgcctgtattcccagctacttgggaggctgaggcaggagaatggcgcgaacccagggggcggagcttgcagtgagctgtaattgtgccactgcactccagcctgggcgacagagcgagactccgtctc

SEQ ID NO: 992 - DNA, 542 bp, Homo sapiens
aatccagcttcttcaggatgatggggaacatgctcctgaaatcgtttgggtaagcaattgctgattttagtcaaattccctcacctcacaaaaaggctggagtgcagtgacgtgaactcggcttactgtaacctctgcccccaccaggttcaagcaattctcgtacctcagcctcccaagtagctgggattacagtgaagtttctgaaaagtaatacagcaggcaaataaaatctgcaggagacagcagaaggaaaagcaattattctgaataatctacacataaaaaatatgattttgtttgatatttaccacccccttcaattttgaggagcgattacttccaaatgaggcatgtatgctgagttgttctttgactcatctataaagcttttagcaaattgagggaatttgaatttctaacatcaaaatgcaatgtacaaaggaggaaaaaatatgactcacccagcccccaaatttcatatttatatctctgattgaatctggttttaaaggcgaaattttaaaggaataaaaggcaaa

SEQ ID NO: 993 - DNA, 583 bp, Homo sapiens
aagactatactttcagggatcatttctatagtgtgttactagagaagtttctctgaacgtgtagagcaccgaaaaccccgaggaagagaggtagcgttttctcctgagcgtgaagccggctttctggcgttgcttggctgcaactgccgtcagccattgatgatcgttcttctctccgtattggggagtgagagggagagaacgcggtctgagtggtttttccttcttgatggctcaatgacagagactagctcgtaaactccgggccgtttccgggctgttcgctcctgcttggcaatgtcgcgagaaaggttttcgcctcctgtttcagcggtgacggcttttgggttttcctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccggccccggctggagtgcagtggcgcgatctcggctcctagcaacatctgcctcccgggc

SEQ ID NO: 994 - DNA, 3243 bp, Homo sapiens
aggccagggaaagaagtctggaacaaagggaagacagatgaccatgattgacttcattcttttacctcctgagatggcgatgggatgggggacacacaggaagaagcagggtccatgagcctcagcccttggcttaggaggaggagcagtacatttccacctaccttctctaagacatcttccctttgcttaggcttacctgggggtggaggtacacagggaaggtcaagcaggtgtaccagggcacctcctggggaggggtccagatggggaggatgctggacatccccagaagccccatccaggagatctagcagatccaggagctgtgaggcctggcagaagggacagaaggggcagggctgggtatgaagctcagcccgtcttcctaccccagagtttctagccttctcacctggggctctgtgggcactggggctgcttctgaaagctgggctgcttctttgctttcctttgcttcctcatcagcctgagggccatctcgctccacaagaggcattttttccaggatggcagccctgagaggatggaatgcaagtgtgcctctgtgtggtctctgggcctttcacaagaggcatctaggatgaggactaggaatatggagccctgggcacatggtggctcagaagtacccttctgatttcctaaaatgacatgttgttgctgattttcagatgaacaaggagggttggaagccagcttagcttcaattaacagtgggtgggaagctctcaccgtggatatggaagaacacagggtctcactctgtcgcccaaagctcactgcagccttgacctcccaggctctgatgatcctcctgcctcagcctcctgagtggctgggactacaggcacatgccaacaagcccaggtcctgggatgacccgagcaatcctgtgcctgctactctgctgcccaggacactgagagaaccagtgttctctgggaggaaaccactggtcatggtcttactgctatgccctctctgatccagggatacagcagtgaaaggtcaccccacctgcaggaaggggtcgctgactccagatatgctgtgttctgtggagtatcccattgtcaccagagtccggaggatgtgtaccagctggggtaccacctggagggagggcacaactttgggcattcgttctaatcctctccagctaaagccccattccttccccactgaccctgtcttccaggcccagggcctgccccttcaccagcccacctttcggaagtgcctgagggctgcagggcttcgttcgcagagctccgtgatcagcgtgatggtgcccagcaggatgcctggggtcagcgtcggggaagtgaatggtgggggccaggggcaagagagtctattgcgtgtgtgcctgtgtgtgtgcactacccttctcctgtgagctggggttcccatccgattttcaattcttctgtccatagacctgaagcaaaggatggggggccccacagccttaccatggtgacgctcatgaagcagttgggcacagggtgggaggaagacactggagagttcagggaccttccggatcatgtgcactgcagtcagaatagcctgcagaggtcaggggcctcagacaggggtcagaggagatggacccctgcatctactactatatagcacgcagcaggcagtgtgcaggagcacgtgccaggagtcccgccatctcaccttcttgcgcacgtagggactgggctgcaggagcagtttctccacctctggggccaggtctcggcacatctcagcagagcccatggtgctcaaagtgcacaaggccaggccttgtactggctgaatcccctggctcaggtcactgcagggtttgggaggacggtcagtcaaacctctgagaaaatcagtccttttcaatacccacaacaggcagtcccctgggatttccaaggtccctactctcccatctccctgattccaagtgattgccagaaccctctcacttcttgatgctgttggtaatgagcaggtgggcatcgtgcctctcatccaatagaagcatggcccccaggtagcccaccctcttgtctgtgaatctggaggaggcgatcagtttcaggcactccatctatagtgaagggggcagaccaggaagaggcaggggtgaaaccatagacactcacatccctgttccatcttcctctttaaaaccagattaacctgtggggcatcatatctcatcactctcccttcaacaagaggagaagcttaggaaattcaggcgttagtgggtaggaggaactaggagttgaggaggatgggagcggagaggaggagatgcctgccctaaaggaggctggccagagaatgaagggttcaggccagctgatgaccagtaggggtagcaatggggaaagaggtttgcagtgcaggctgtgaagactctgaaattgtagaatttaaaaaaccagggcataaacaggtgagagagtctgggactctgccccactagccttcatcaagctcaggagggaggtattcctggccagtacctgtccaaagtgggcggggtagcccaacatgtggacgtagagcagtttggccagctgccggtgcctgtgcactgggtccccgtcgcggaaggaggcccggatgtgggcacactccttttggatcacctcccgctcctgggcctgagtcttggccccgcgaatctcttcgatgaggtcctgaagcttcagcgaaggcaccaccatcctgactggcagagtccgggagtggagaaacactctctggtcgggcgtgcctgggctttcggcccaggcccgtcctgtgtcaagaccctaagagcccgggtcccacaggcagcggcagcggcagcgacagcctgcctaccccaggactccagcctcacctggcttctgcctcaactccgctcctctgccccccagcgcttcctggtacggggccgagcaggggttggtgctccgtgcggtccttccctctccccgcctccaccacgggaccccgccctcctgggccgactgcagagccttcctgaatcctctgacctcgggcctcaggctttagcggagagacagcatgataggcctggagttcttcaagaggcctcctcgcacatccttaccacccggagagcctcagtttggatttgaagccatcgcaccccaaaggagatgacaatccccccccttttttgaacttttttattaatatattttttttgtt

SEQ ID NO: 995 - DNA, 1071 bp, Homo sapiens
cagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgaataaacacacctacgctccggcttcgtgtcctgtgtcacctgggtcgagcacagccttctggtccagcgctgcatgcggcctcaggaccacgtcttccggttgggggctcccagtaaagcgatcctcagcttcttcagcagccagtggccagtgagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacctgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattcgaggtcctcctggcctgagcgcagcgcctccaccctgccctgctgagcacagacggaggaagccgcttatcctgttttcatggacagctg

SEQ ID NO: 996 - DNA, 521 bp, Homo sapiens
gaaataagaatgtggcatatttccaaacagctggagtttggaaaatatttcctgttgatgcactcagtgccaactggacaaaggaattcttgagatagccttcaagtgcttcttaggactgcagtgcctagacaagctgactctgaccagtggtttcaggctcagctatacgtaggcctcagcagcttgtaacagtttccatctccaggccacaccccaggaagaaatggtgaaggcagacagctttgtagatttagaagggtgcttctttcttccctttctattggttttccccagagaagactacgtgtggatatctactataaaacatgtgtgcatggaaaattgtagggccagatgcttctggattaagagaacatgaccagttttatcatgatgaggatatggattttatccacagaacagggagggcaaaagcaagcctgtgggcacagtatgtgatgataagcactttggaaggatttgtgaatgatacaacggagttatacaaatctttggaa

SEQ ID NO: 997 - DNA, 998 bp, Homo sapiens
cttttacgtcggccttcgcgagcgtctgggcgggtggtaggaacaatggcgctgtcttcagtggcacagtggagcagctctgaagatgcaaagatacacgaaaaaacttccagaacatctgggagaatatttaatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaagtaggttgtatggcttaaaagttctgtagtatttgtactataatacttgccttttagcattaccttggtttgtagtcagtgtcacagaagtgcagtttaatgtattatgtgtacatatacaaggtctgattggtctaatcaatgatgaaacctatcccgaagctgataacctgaagaaaaataagtacggattcggcttctgagattaagaccagtaattcagaggtggagtaaattttgttgccgtgattttataacagttgtgttataaaatcctgggttttttttttttctgccaacagtgagggtcgctgtctgcccattgatagaggccagattgtcttggaagttccaaagttgcaacgatttctgtaagtggagtttttctgtttgcttagagatcagtgaatattgtgtccttggtcttatctgtgatgatcttatcccgaacctgaacttctgttgaaaaaaaaaaacttttacggatctggcttctgagatggaccgttataaggacaatatttttttttaatacttttaatgcttttacatatgttgtaatgtttgtagtcttgtaagaatctcgtgtttttccttttctagggctagtgccacgaggtttacttgactgttgtgtgaaaagctgataagaaaaccatccagaaaa

SEQ ID NO: 998 - DNA, 1799 bp, Homo sapiens
aattggatatgggtattgtagctgaaacgtcttgcgagctgagtcagggtcggggaagctgtgatggcaatgagaagtcaacacactgaggatggagagaaagaagatgagtctgggagagaaagagaatgattcttctggccgagggaaagcaagaatatctgttcctgcaactgcactgattctagaaacactctctattcgaactctcatgaggtgctgacctgcttggtgaatgctgggatctctggaagagggaggcagacatcacacaccagctggcaagtgggagctggcatgcaacatgccccaataccactcccctcctgccatccctatctcctaatggtgcctccttttggccaaacccacctttggctggagggcaacagagcccattgacgtggtccccttgcatctgctacctggggagaaaagcaggatggacactgaatctagagaaatgaagaaacccatccagaagaatactgcttctttatgtttttgtaggtgtacaaatcaggcctccccatgatattctaaactccttgaggaaagaagtggagtcctgggcttctgatgtagcctccacagtgctcaggggatagcgacactggcaccctatagatatttaattacatgtggactggaagagaccaaacagcttcctggtatttcaatcaaacccggtgctctagacctgtggctcactctgagcaaactataatgagttgaacttgaatctgattcctgctaagaaaggtttcattttaataggcagtaaggctatgagctaacaccagaattcattcgagttactagactcactgaaactcctcacaggatccatctttcatgttttctagattttggtattcttatctaaactgcagacccagaaaccctatggaccctacctttccaattatatttctgggaagagtcattctctgcagagctgaagcatgtaacagaaagttctcaacctgaaaaatataccttctgcgcccaagccccactttctgccactatttggtaatctcaagtgggtgaggtggtctctgaacttcagcgctctcatggtcagagccacaaggggttactgggaggctaaagggaagtggcaaacgtggctgagattcagaaagaaaagcagcaagtgtagagaggcaaggacttttccatcttttaaattccttaaaggaagccaaagttcattttccagtctccttcagatgcctctccaatccttcacagcagcgcacacataccgcagaaggaactcaccatcacaaaaagatgacagagcactgggggctggggtgccacttgtgttggctgagagcctggatgcatgtgaggtcaagcctgaccttgggaaagctgctctctggacattacttgctgtgccacatacacagcttgggtttctgaggaaacaacacaggctctaaggaggaactggaacggggcccagggtatatcttttacagcccgtacttttgaggaaaatagaagacaaaaggtttttaaaaaacacaaagtgtatacacgtatacacaaagtttacaagtttgtgtgttttaacatctactctccttaagaacaagtagacaggaaagatattacctgatatgggttaaattgtgtccccaaaaacatgttttgaagtgctaacctttggtacctgtggatatgaccttacttggaaataggtttttgcagacgtaaccaagttaagatgaggtcatatttgattaggctgaaccctgaatccagtatgactggggtccttatat

SEQ ID NO: 999 - DNA, 580 bp, Homo sapiens
agcagttgccctactgagttaatgtgataaggagaaaaaaaaaagggattgatggttaagagaatggttgaacacagcacatctcaggatggggcaatatttggtgagaaccatattggattctaccaaattacaaatatattccaggttggcctgatcactcactcaccactccctgcaactccatggagaagatataagctgtcaaaaatgtatttgtgagtctgatgagctctttcacccaggtgacaggggtttctgccatattaatattcttcttcttctccaccttttgtgtttcaatgctgggcctggagaaggcagggaccttggctcttccacggtggctgttcatcagcactcacacatccaccacaccggtttagtcgcacgctggaaggttttgcttggaatctgccatcagcaatgccgaggcctggccttggtggaaatggaggtgctgcttaacttttcttccaaaacatagtacaaccctagtcatcctgtcatgcacctgagacattcttattagcaagcttggagcagcagtggagtgttgaaaaaatttctctcaaacctg

SEQ ID NO: 1000 - DNA, 807 bp, Homo sapiens
tttggcaaacgtctaatgacacagagccaccattgccaatttcaccactgtctttcaccaagttgattcattttgaactggctccagcaatctactcagagttgacctcagagcaaaaaattgaacaacagctccatatgttgatgtgaactgtgactccaggagaacggtggaaaagtgtcttgatccaggaaggaaggggtatagagaaaatatgagtctcaccacactagaagcaacatatgcaaaatccatcaaacacaccataaaatcaatgtgggagtaacaacaccttggcctactgctccctgaaaagtttttctctcgtcaagtgatgacaggcgtacatttgtaaataaattaccaagttgcttttgatttgatggagaaggaagaaaaggattgtctcctggaagtatttttattgtcttaataggtaggataatatctctgttcagcaaactgagatcttttgagaatcttaacaaatgtatacccctccctctcaccttttcctctctggtgtatttcataggcagctttgctaactgactgcactactacaaatagattctgtcactttagaaataggatttttccttttataggcagattgatggactaagtgtcaaggttttagaacagtagcatgactggggcagacactataaaccataaatccagtattgacaaatgttctagccaatccagattttctatttgttaaattgcctttatgaagtcatacttgtgcagcacagaatatggaaaataattgacaagttctgagaagccagttactgagct

SEQ ID NO: 1001 - DNA, 684 bp, Homo sapiens
atgtaccgcgtgacgtgagagcggagcccgggtctgcccgggcgcgggcccgcggccacggcgtttggatcccagatcccagcccccgcgctcagtccgggcttcctgaccggcgctctccgcgtcccttctcgcgcgcccttacctggggctggggaggtggggacagagccgggcgcagtcgggggcacagccctgaggcggggctgagggccaggccgccacgtccctggaccctgaaaacgggctcggacccccgctgcagcgtggactccggtgtggccgcggggcgtgcaacccggaccctggccagctccgtgtcctccagacctttactcatgtccccgcatcgccaggccgagctgcaccttcggtccccgcccgcggcagccgaggagaggagagcaaggcccagaccggggaggaacccacacagcctctgtgctccagcctgcttgaaagacaaggtctacctacaacgcagagatgcacacattaaggacaatgaaacacccaagtgttaggaaccagaataatcagccctaatagaggggaggctgatcagggagggcctcctggaggaggaggcacaacatcagggtgcactgtgatttctggagacccaaggagttctggtaaatgacaggtgagaaaaagaaaatgtaataaaatataattgaaaac

SEQ ID NO: 1002 - DNA, 335 bp, Homo sapiens
gaacccacatctaccatgaatgaataaatggcgacctggaagcatacttctggtagcaatggggacacgggtcaaaggggacttgaggttatcagctttcagaatgaagacacataatccctattagagtggaagacttaaaatcgagtttgagacccaccttctgaaactgcaggctcttgggagcctgatttccggtgaagagtgttgctgctttgcatttttcacacttgaacacagtgaagaagatgaacattaattaggattatagtgccatggaggcttactgtgctgtgagaactcacaagaaataaaatgccatttctttttttgga

SEQ ID NO: 1003 - DNA, 304 bp, Homo sapiens
aaagacgatgcgaggcatctgggctgattacttggtgtctgcagcttcaagaaccaggttcaattcccctccaagtgcacctgggctgcctcctcttaatcttgctgcaccgcagcagcccctccccaacccggtaaaatgtgggcgataattcctttcttacaaggcccttcacagatacctgctggtctctcccacttggccaaggaaacacttgtggttaataagtctcagaaaagttatgtgaaagttaaaagtaaaactgacagcagctgaaggatgggggggtgggaggtggtgacgg

SEQ ID NO: 1004 - DNA, 1103 bp, Homo sapiens
ttcggcggtcaacgcgctttattccgaggggcttcagatacagatgaccccagccctgcatccgcccggaaggcgtccccttactcccatggggcacctcgataccagctgccctgccctgactcacttctcagcacccatcttacggcagtcggccctggcctcagacccttgggttcagatcccaggccctcctcctactcactgtgagaccctaggcgagtcccttagctcgggagcctaattccgcttcattaacatgggggtaatttaactacctagctagacggttgcaaagggatcagttcactaattctcaatgttggcagtgcatcacattgcaaactccctgcctctgctccagagctgatcagaatcaataagggtggggcctgaaaatactacatccaaatttccgagaagcacagtgtctagcatacccctatctctccatctggggttactgtcactctcaggaagaaataatcacccattattccttcaaccaggaaaagagatgtccagggcacagcttggggccccagaaagtaaccacggaggtcaagatcacaaacccgtcagtgtccagggcatggcctcgcacacatccgaggttttcaaggaccatgaagtgccatggcaagcatcctggcctgagggttaggagagctggatctcaggctcaactttagcctgaattcggtgcgtcatcttagacaaatctggtgagctctgagggctggggtaaggttgagaaactgtgggctcctcagggtggggggtgcttagagaagatggggcctctgagtcctcagactgggggtcttcatcgggttcagcatcctccccaggcccaagccctgccagcctcttgctggcctcccatagccgatgggctgcccggtcgtctcgggcagctggaggcacctcttccacatggcagttggcaaaatatctcccactgaggggctcgatgccctcttgtagagcacaatacaggggtgtctgggcaccccctcttggtgcccggagcaccagccaagccaatgggcgcaaaagtgggcgcagccatccaggaacatggcgcaggaacagctccgagt

SEQ ID NO: 1005 - DNA, 2110 bp, Homo sapiens
gctctcagagaagcttccagtggaaccaaaggaatacagatggagggcctggggagagatggcctgaggggacctgcagaagggatttacctgctgcccctcccccaggggagccaggagactgagctgggctgtaaacactccgtgcctggtgcagcctggtctgcacaggctgagaggatgctctacttctaaaccccataaggaaaaggcccaggagggacggggatgttgctgctgatagctaaaaatgatcaaattcttaccatatgccagaccttatgctggacaattcactgacattatcccacgtagtaggcagaattctaacgtgacccccaagattctccaccttctgtgtaatccccaggattgtgaatgtgatggatttcattctggtaaacaggttttgttatatggcacagatgactttaagacagggaggctttaaatctgtgactagcagaagacatatggaaggcagagattcaaaatataagagggatctgacgcaccactactggcttgaaaatggaggggaccacatggcagaggacgcacgcagcctctagttgctgagggtggtctccagttgacagcggcaaggtaacaggggcctcagtcctacaaccacaaggaactgaactctgccaacatactgaaagagcttgaaggaggagcataagcctcaggggtgagatcatagacccagacaaagccttgattttagttgcctaaaaccccgaactgagaacccaggcatcttgagtgggactcctaacccacagaaactgtgagattaataattagtggcgttttaaaagggttaacttatgatatttttaaaattagcaacacagaaaatcatacaccccatgtgatacccatcataaccctctcaagtaggcttcaccattttatagacaaggaaacaaagacccagggaaattaggaatttgcccaaagtcacatagcctgtgagtggcagagacaggtttaaacccagctatgtcttgactttatggtcagtgctcttcattgcctcatgcatttcctctctgtatgagaagagagcctcagacacatggtgaaaagagtatggaactgtttctgtctgcctgggtgtggatgtgcagaagggtcagaggacctatgcttttgttttggttttaaatggtgaaaagacatatacatagaatcaactagctggattcagtttagatgatcccaatatgccttcttctctccatcaggcctgatcagggtgttggctttggccacagcagtgtcactgagcttcttcacagcctgtttgatctggtgcttgttggctttgacatccacaatggacacaagttgtgttgttgtcttctatcttcttcatggctgactcagtggttgggggaacctgatgatgaattattggtcaagcttgtttctcctgggagtgctcttccaagcatatttctgctgcctgcagagccacactgtcttgggccactggcaggtgggtgatgtgtggattggatcttctttttgtggctgtggacacctttaagcactgccttcctggccttcaaagcattcgctttggcttcagctttgggaggggcaagaacttttttcacttttggtgccataatgtgaaaatgaggacctatgttgagccctcactcctctagaagccagctgtgtgccctcggcaaagtcaattaatcactctgagcctcagtttttataatctgtatgaggcctactaagaatttctgcattataacccttgaagggctgcagctgatgatcccataaaagtgtgtgaggggccactgtgaatgaagtccacagggcagacagaggcacctggatgtcatgtagatatcattttcttttcttgatgactgccaatttcaatgtcctctgcctataggctggatatggtcactctgatggcttatttggaggaagtaattttaaataggttttttttttagaggaaatgattatttattacatttattgaaaaactacagaataagatggaaggtaatttttctttttttcttgaattctttaaaagttagttgactattaaaagccaaagtaataacaa

SEQ ID NO: 1006 - DNA, 677 bp, Homo sapiens
accagatggtgagcccagaggaagaccccgtggctctgggccagtgtgcgtcagccaggtccccagcccccagtgtgctgaagctcaggcccttcccaacgccctggtctcctgcactgagtgagctcttccgcccatttgggccctctgacattgaccggcatagatggtgagctcggaggaagacttgcattgggcccaatggagctgggccagtttctgtcagccaggtccccagctcctgatgcactgaagctcaggcccttcctggagccctggtctcctgccctgagctgtgatggtgagcctggaggaagacttgcactgggccttctgtgcgccggccagaggccatcaaccaggtgcccaggtccttttgtactgaagcttgggcccttcctggcaccctggtctccttcatggagctgatggtgagcctgaaggaagacttgcatcaggaccaatggaccctggcaagtgtccgtcagccaggtgctcagcccctggtgcactgaagctcaggcccttcctggccccttgatctcctgcactgagctgtgtgagctcttctgccaagggggggcctcctggcattgaccaacatagatggtgagcctggaggaagatttgcattgggcccaatggccctgggccagtgtctgtcagccagtttccca

SEQ ID NO: 1007 - DNA, 3177 bp, Homo sapiens
aggagttggcggcggggcccagccgaggtataagttccacagcttcacccttgtcggtgtgatatgggcgtgaaagaagacataaaacaggcttcccgagtagaacctgccaccccgggctggtggggacgcggcaccaggccgggccgggggaagccgctcggacagtggtccttggtgaagcagagttgccagccatctatggatcctaactaaattggtccttgtaatactcggtattatttgccaagatattgaaaaacctctaaacagtgagaaggaagaagacaaagatgactgcaattactgcttccattccacattgtactagaagtctggccagcgatttaaggtaagaaagagaaacaaaaggcagctatattgaaagagaagaagtaacactgacttacttcaaaggcaacataattatttatctagaaaatcagatgaaatttgatctagtaaaaacactactataactaagaacctgttggccagtatacaagatactatctcagtatacaaaattaattttgcttctgtgtagtagaaacaatcagagactaaaataaaaggtatagtttataataggataaaaatatgaaacctttaggaataaatttgacaaaattatgcaaaacctgtacattgaaaactactaatggcgtccaggaaatgctacccccaaatatggcatcttgtcacttcagaaagtaataaaacctaggaggatcactctctgaccttctccagctcttctcccctgaagcaagtcataaggtcttcattcaagaggaaagaaaaatccttactctgaagacacggaaacacagagaagactgaacaaactggcctttctaagttcccccaagtttattactattagatcacaccctcattgtccaataatatttctcctctgctatccacttcttcatcaaacttagcataaaatcctctttctttgattcttcatttctgaaagctcctatgttatataaaacttatattaagtaaatttgtatgcttttaccttcttaatgtgtcttttgttttaagggccttagccatgaacctagtgatgggtgaggaaaagctgtttctttttgcccatcctacaaactattcctgagagaaatttaaaaggacttaactaagtagagatacatgccttattcatgtgttggaagactcaatatttctaacatgtcagttgtccaaataatggaattcaaataaaaatttcagtaggttattttgtaaaaattggcaaccagactttaaaattcatatggaaatgtaagggacctagattagccaaaacaaaaccaaagttgaaaacaagaatgaagatggtgaactaacactacttgatttcaaattattataaagctatagtaatcacggcagtattatattgcataaatatagagaaacagatcagaatagggagctcagaaatagactcacaaatatatgaacaagtgatttttgatgaaggcacaagagcaattcagtggagaaaagtcttttcaagaaataatgtgtagaaaaattggctagccatatgccaacaaaaaagaagaatgaaaaagaaaaaaaaatgactttgattcataccttgcatactttgcaccatatacagatattaactcaaaatagattctggacctaaatgtaaaacttcaaacttaggagaaaatctctgaagtctctgtgaccttgggttaggtagagttcttagatatagcaccaaaagcttgatttatgaaacaacaaattgataagttgaacttcattaacattaaaaagttctgctcttaaaaaacaatataaagaaaagaagaaagcaagccacgtactggaagaaagtatttctaactcacatatctgatgaaagacttgtatccctaatatatataaacagtctcaaaactcaataataaaaaactcaaacaacaaaattaaaatatgggccgggcgcagtggcttacacctgtaatcccagcacttttggaggctgaggcaggcagatcacttgaggtcaggagttcgagaccagcctggccaacaaggtgaaaccctgtgtctaccaaaactacaaaaattagccaggcgtggtggcgggcacctgtaatcccagctactcaggaggctgcggcaggagaattgcttgaacccgggaggcagaggtgcagatcacaccactgcactccagcctgggcaacaagagcgagactgtctcaaaaaaaaaaaaaaagtgcacaaaagatttgaacaaacatcccacaaaggatataaaaatgacaaataagcataggaaaagatgctcaacaccattgttaattagggaaatgcaaattaaatccacaatgaatacttagaaccagttcctgagatggagatttgcatacaagaactttattggggagcactctcaggaactgcaccagtagggaagtgaggaagcagaaatgggtggagagagtagttgaactctggtacggttgcaacacacttattagaatagccaaaatttttaaaaaattgacaacaccaagtgtttgggaggatgtggagaaactggagctctcagatactcttagtggtattatcaaaaggcacaatccatttgctaagcagtttggcagtctcttggaaatttaaacatactcctgtctactagcctcttagaaacttatagaagctattttatggcgaaaacgaggaaacaaatgtccattaatagtgaaggataggcaaatttgtgcatatccatacaatggaatattacccagctgtgaaaaattatgaactagtgataaatgcaaatacatgaacaaatctcaaattaatactgattgaaagaagccagagacgaaaaagtacatactgtatgattgtatttatataaaactcaagaaaatgcaaactaatctatagtgagaaaaagcagatcagtggttgcctcgtaagagaaatgggagaaagtgttgagggagaggaaggagagattacaacgggactcaaggacaagtttcatgtttgcagatgatggatatgtttactgtcttgacatgtatacatatatcaaaacttctcaaattgcatactttagatttgtgcagtttatcatctgtcttttatacttcagtaaagacgaaaagaaaaaaaaaa

SEQ ID NO: 1008 - DNA, 788 bp, Homo sapiens
gactcgccagcgagggatgccgccggccgccgggggccttctccaggaccaggagagaaatcctctctccgcttcacgacgcggccactcccacccctgagacgcccacctggcggactctgagggaggattcggctgcgtctaataccacctccacccctcatccctcacaatgcgcggaaaaccacaggcggctgtgcgcgcagcgtcggctcagccaccgcagctcctcccctgggatgaaaaagcactctgacgtcttgaaagctggcagctctctgtttggaaaatctctgcccagtgaaaaaatgtaccgacaagattactaagtaacacagtcttctgggaatgccttatcaatgccagctatttgaagagcacccaaagtcaaactagtgctccgcgctggcagtctggaaaaggcagatgtatatttcagtcagtaatggatattaccaccagcatttaatcaaggaagcaggaagtgatccatcactgctagctgctatctacaggaattctgtctacaggcagggcagaccagtcagccagtatcttcccgaagtaccttggtcttccaccatccatcccactgagagagccgttcctctaatgaggcatttctaagcagctgtccattgaactctaccccttgagatatcctgagaaataggaatctatggttcctattgtttggaaagtagtatatcttccttgaagattcacaatgcgtattaatatgcttagggctctgataagtcctgtattaaaaatgcttgttaaacttt

SEQ ID NO: 1009 - DNA, 851 bp, Homo sapiens
cccctgcctcccttgtctccacccgcctagatcactgtctcacagtcattctgtggaacttcctctgtgtctctcactggagccgcctaacttcctctcccacctcccttcatcaaggagcagtctcatgcccaggagctagaaatgtaggctttgccggcattggttgagctgtgctgggccctaggcagcgatgactcaaacttgacccttaacccccaggcaggcaagttttcactgggtcttacccgacgtgagcccccactcctccatatggacctgttttggaccaatgaggcatcctcttctgtagtcctcaacacgcggagctccaccactcctgagcagtgtgacctcaggtgcttgctgcagaggcatcgggggtctctggccagaggtgacatctgaagcaatcgggatcctgtttggttttgccacatccgacctgccgcccagctggggcaagacagccacgcgcggcggatgcaccggccctgaactctttctcgagtagtccccagagatttcaggaagagagagaagaggtaaagagaccagaaacaaagtcttctgcaagcaaagaactgcaacaggccccagctgttaggtttgaggggcgtatggggcaggcgactgaactgcagagttggagccagaggtaccattgctgacccctgagcccaggagccttgagaatactgacagtgttaataataactgcaatcatccaacatatgatgctagaataactggacatctgtgtgcaaaaatattaaacctataccttgcaccttatcacaaaattcactcaaaatagatcatagaccaaaatgtgaaacataaaactaaga

SEQ ID NO: 1010 - DNA, 1183 bp, Homo sapiens
gggcccggggggcccggagcagtttccagtggccaggggtacgcgcggccggaggggcgccggggccgtactcaccgcggccgttctggttgggccggtacacgctgcccacgctgaggcggccctgctgcgcgccgttccgctccccacccggcgggggcgtgtcggagctgcgcaccggcaggagctcctgcctgcctggatgaagaggaggtcaagactttgtcccccactccgcaagataccctctctgttccggagcggtgagtccctcccctgttaggaccttgtctccctcaggactggacctggatcctgggcctgcagtcagattgccagtttcacttagaggtggaaatgtcaacccactggttggaatgggaaggtagggtgtggggtcggggagtaccttcatttctatctgcccaggaggccagccgcttcctgcatagcatttccttcctgcagtatgggaaggaccaggctttctcagaccacagaatcttgagagccatttccacgtggagcaagtggtggctaccagccttgggtctacataactagggcctcatccctggcccaagaatcctgctccacagccttcttgtgtccctgtaggaggagaaacacctggcaacttaaattttttaaaataacttttttttttttttgagacggagtctcgctctgtctcccaggctggagtgcagtggtgcgatctcggctcactgcaagctccgcctcccaggttcatgccattctcctgcctcagcctcccaagtagctgggactacaggcacctgccatcacgcacggctaatttttttgtatttttttaggtgagacaggatttcaccatgttagccaggatggtcttgatctcctgacctcatgatctgcccacctcggcctcccaaagtgctgggcttacaggcgtgagccaccgtgcccggccaaaaataacttttaaaaacatgagtatagcatacacacacacaaaagtccacaaatcctaggtgtaccacttgatgaatgatcccaacgtgagcacacctctggattaccacctggatcaagaaataggacatcacagcagctggcagcttccaaggagaagctctggaaagttctgcctgtctcagcacctggctggatcggaaacgagttttctttaaccagattt

SEQ ID NO: 1011 - DNA, 579 bp, Homo sapiens
gcggtggggctccgcgggcagcctggttgcgctgcacccggacggggccgaggggacctgaaagctgcggcagagcctgaccgcgccgttctccagaagagccccggccgcggctgagtcgcgctccgggtgtggacggagccggagcctccccggggctcggtgaggacacagggcccaagccccggaccttcaagtcttgaccgagcgcatccccggcccttctgcgcccacacctgagtttttgtctgtaggagtttccgcagtttgctaagaatcgacatctagaggagtactcaccacttaattgatgatcaatacacgttccttgaaagaaccgatagcatgcgatcgatacagagcatctgcactgggattgtccgccccgcctgtcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattattataacccttta

SEQ ID NO: 1012 - DNA, 748 bp, Homo sapiens
ttgacgactaaagctgagccggcgccgccacgaccttgggcgggtggtcggcctctgccctgagcaggaagtagaaagtctcagcagacccttcctgagggccgagcaacagtgtagtggcgtattccacatagcaaacaggcagcatttcttcctgtgacaatatggtgtaagacaaaattgtggcctgccatgaagttgtgagagaaaagcatccctcatttcttcaggaaaggccactgccgttccctccggctcctcttctcaggagtttgtgcattcatgaggtgaattccttggaagatgagggccaagtcttattcttctcagtctcttctgcatctagcagaagaataatggttgcacagaaaatcttggttcagtggttgagtgaatgaatggatgaacaggctcttgcacacaaagaagagacatgatgtatttgcatccttccctgcttcagccagttttctgaagctcagagggacaccttgtattgctggatgataaaaacaggagcaaagtgatgaagtgctgacaaggcaacaatagaacatgagagattcactgctgtgtaggaagagatcttcggtgaccatgtagcctgaagctctcattttgtcatcgagggacaccaaaactcagaacagatagagtcttgctctgtgacccaggcttgtgtgcagcggtacgatattggctcactgcgacctccacctcccaggttcaagcaattctcctgcctcag

SEQ ID NO: 1013 - DNA, 1721 bp, Homo sapiens
attgcaaggtccgatccattcccatcagtgttgaggagaggaagagaggtcttgttggagaagagtagccatcgaggaggggacagtggtgctagggcttccttcagcctcccagcccccagcacaggagagggagacagcagagagggccggagggagggagctggtggcttaaaatggagccgtttacaaccccgcacagcaaatggagccattgggaggacacttgaccgagaggagagcattgcttgagccaggggtgccgtctgcaggacagagacaggaggcagtgttgtttccagggcatcgtggaccatggcacaggtgagcaatttaaaaaggtgattggaatcatatgttagaataatgaccttagcagtcaaaggctcctggaatttgtcatttaatttcatattttaggtggactgatctgtaatttagttaatttcacatctccatctaggaaaactggagctctgcacaatattttctgcagacgacaaagtattcacccaaactatttctcatagtaaaatgtgctctttgtccccagagaactgctgaatactacataagatctgtgtaggagccatgctttaacaacaacaaacacctcagacacacaacaaccctttcctccctcgataaagatactgaaaagaatctggtctctggggtgaggagtaggggaagcaggtgcaagcaagtgggtgcagaggagtgggaagatggcattttgtgtaggaaagaatttaacgttgcccaaagagaggtctggcttttgtcctcaccttctgggaggtgaactctaagcccttggaatatcatgcctgattggagtttgtttgcctgggatccttgtgtcacagaatggtctaaccatatgatttagggtagatgctggccacactggataggtttagggtaggggttggctgtgccagaaagaccaacaatgtgacttagggtggggtctttgggtcacgtggtatcagctgactctggaggagctggagagggagggcagtcacctgtgtgatggagccgcaataaaaactctgaacactggggctatggtgagctgccctggttggcagtactccatgggtactgtcacacatcaatgccaggaaagtcatgcttttcatgattccatggggaagaggacagtggaagctccatgtctggtaccttcctggactatgccctatgcccttcctcccttggctgattttaatctgtatccttttgatgtaataatgtgcaactgtgagtatgagagcttttgatgagttctgcgtccttccagtgaatgatcaaacctgagggtggtctagggtaccccttgcagttggtgcagcaataaaggtggtcttatgtggatggtgctccctttaacttgacaggtggctaactgatatggttggctgtgtccccacccaaatctcatcttgaatttccatgtgttgtgggagggacccagtcgaagataattgaatcatggaggcaagtctttcctgtgttgttctcacgatagtgaatacatctcacgagatctgatggttttaaaaacaggagttgccctgtaagagctctttctccctttgcctgctaccatccatgtaagatgtgacttgctcctccttgccttccaccatgattgtgaaacttccccagccacgtggaactgtaagtccaattaaacccctttcttttgtaaa

SEQ ID NO: 1014 - DNA, 1057 bp, Homo sapiens
ggaaggttctggattgcagggagaaaggcaattaatgagtgattactatttaaagacaaaacccctgtcaaaacagcttgaccaaaaaaaaatgtgagttttttttgttgtttttttttttaactcacaacttgcagtagtgctgccagcaaaaatagtgggtggtaattctgccagctaaaagggtgccgaaatgcagttgggtgagaagaacaactctgtcccctcctccattccctttcagcagtgactgagtgggctacctcccaggcctgttcctgcagtgccccttggttcttcatgagactattcagggtgtttttctgggcaagtaactccaaaggcaagcatgagagcagctcgaagacttaagaacatgtcacaggactgggaggaatggaaggtgtcacatcagaataacaatagctcttgacaaatggatgcacagccattcccataaacaggaatttccctgcaggaaaacttcctcccatgggatcttcaatttgatgaaagcaattacaggacaaagaggctgatttcccctgcatctgctgaggtgaagccagtgctaaggtttcacttatactgaagaaattcttggtttcctccagaacagaacaccctgaaatatgaagctaatctcatcagagggacaggcaccttaccaagatgaaaattccttaagatttatttgcccagccttaaagcttagacaacttattaagagttacaatagttttgtcaaaaatgacagccttcagtgcttcacagaagccataaaaaaaacaaagtccaataccgatgtgttttcgttaactgaaaatatcagtgaccaacaaatacaaagtttcattagaaatcatcaagaaaaaccaggcttgggaagataaattccttgatgcccatgttttaaaaatgatcctgtctgtggattaaactgcaagtcatttgggccattgctcagccgaaaagacaaatgtttcagagtagaaggccactctcctctggcctcaatgaaaacgcatgtcaccttccggctacagacccaggtggc

SEQ ID NO: 1015 - DNA, 564 bp, Homo sapiens
acaaaacccggaaggaccccgccgaaggttttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccaattcagttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaaca

SEQ ID NO: 1016 - DNA, 1151 bp, Homo sapiens
cagaagtgctgaacccttgacgtgccttatcttatttgctcctcacaacaaatcttatgagatgcatcactaccagaagttgtccagaaagaactgtgaccgtatgttttaattaaataatttttcatccagtttttttctttgcatataaagaaacagaatcctgacatctgattgaattattggctctcctgatggttgcacgatggctgcagcagttccagatgtcccatcgagacacaaaaagatcccagatggaagatgccatctcctcctatgtgcctctttttaagagtgccatgccactcaaacagccaatggaaaggcccacgtggcgagagctaaggcttcctgccaacaggcaagtgaggaagcccagtcagctgcctgcagtcctgacccatgaagagcctgactgaaagtgaatgagcaaccctgagctaggacaacccagcaaggcccatcctgaattcctgcccacaaaaactctgagacagtaaatgttcgttgttttaaaccacaaagttttgaagtaatagattaattaggtaaccaattgggactgcagtattccttcagggaacttgaatagtcattctgtatatggaaattgtacacatcttaaaattgctggactaaagtgagaagagactgtcttgagtcaactggataaagtggaaaaaaaattaatttggaaatcaatagaattctggccttggctttgtcactaagaaacacttataagtaatttcacttctcttgaaattatgatcattatctataacataaaggaactgagctaaatgttatctgatgcctctttaggctctcaaactccatagatttatgacatgcttgaaattcactttgtttcaccctaattcagagctttgtttcactagctctagaattagatgccttgggtttaaattgcaattcagtcacttatttaaataattgtacttggatgagtgatgttgccattttaagcctcagtttccccatagattcattgagaagatcaaataagatgatgcagataaagctcttagtttgtggggacacttagtaagtgcttaataaatacaggcagttgtgttatctatgttgtagcagcacattttgtaaaataaaacaaagttgaaatcaca

SEQ ID NO: 1017 - DNA, 413 bp, Homo sapiens
gcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatcca

SEQ ID NO: 1018 - DNA, 598 bp, Homo sapiens
tgttcaccgttcctttgagttcctcgtagattctggatattagtcctttgttggaggtatagattgtgaagattttctccaattcatcgccgttttttagagtttttctcactaaatattgactaacggaacctagccctgtaatgttgatagtcgggcgggtcggaagtggctgaggtggagtatctgcaggagaagaactgaggctcctaagtgcagcatcttgtccaagaggtttcgtcccaatgcgtggggaacatccggattgtgatgtttagctctcagtttctaacttgggcattctagcaactgtatttctcatttaatgttttatgggcacacatgcagaggagttttcgtcactgaaaagcccgacaacttcccctgccaacccattggaattaaaaaaacctcgataacctcttaaacacatggaaatggaaccctgagcagagattgtggtgggtatctgtacagcctaaggaccttgggtggacctggccagcaatgggactgttactgatgatgcatcacatggtgtcactaggaaaagcatagatcagctgaggatcaatcttcccaccaggtgtgtgtgaaa

SEQ ID NO: 1019 - DNA, 358 bp, Homo sapiens
tttccttttatttttagaaataatctattcagttgttaaaattccttattccgggatgggtacggtggctcacacctataaccccaacactttgggaggccagcgcaggtggaggttgcagtgaaccgagatcgcaccattgcactccagcctgggcaacaagagaaactccagctcaaaaaaaaaaaaaaaaaaaaaaaaagaaagaaagaaaaagaaaacaggaggattgggctatttccacatcagggtcccatttaatacccccttaaaacatcagctttccttccagagactgatcattgagaaagcagtactgctgacatagatcctgcctacttataaatcataatggttg

SEQ ID NO: 1020 - DNA, 602 bp, Homo sapiens
ttggccttcatatcctgggaagagataacaggacagtgagaggagtggagaaaacacctcccttctttcattgctgcctgttccattcagggagcccctgtgactccaaaagtggcctttctcctctgagcatcttaacagaggtttcagtagagggtactatactaaataatgcagccctccttctttcttccatgccagagaagtttacaaaacaaggaggaagacttctacacctcacagccaggattccctgctctggctctcggctgctgcctcagggtgaatctgttgctaggtcatcgtggcatctctgcaggatgacagtgttttggaaacagtgagaaacagatactgagagaagtccctagcctgggtacccagagagccttttaccttcctctggtaggactcaatcctggtgttggttaccctagaccaggccagtgaaacagagttgaggtctcactaagttgcccaggctggtctggaactcctggactcgagcaatccccccgccttggcctcccaaagtgctgggcttacagacatgagccaccgtgtccagctgacaggaggtcttaacatccttgtttttcgga

SEQ ID NO: 1021 - DNA, 599 bp, Homo sapiens
ccgtcgaggattaggatcgagtttcttcgatcgtgagggcaattattagtggcctctagccccccagatggcatcttgaggagagagaatccacgctacgagaactaacatagtggacatcgcagttgtccgtagccgatttgcgggttacggagttgttgcaagtaaagaaggggaaatccgagcgttctcgcgttggatttcctccacgtgtgaagtgggaatggtagtgatatctcgtgctatctctgtcaagggcaagaaggagaaggaatttatttgaggccctacgacgtggtgcggtggctcacgcctgtaatcccaacactttgggaggccgaggcaggcggatcatctgagatcgagagttcgagaccagcttgaccaacatggagaaaccccgtctctactaaaagtacaaaattagccaggcatggtggcacatgcccgtaatcccagctactcgggaggctgaggcaggagagtagcttgagcccaggaggcggaggttgtggtgagccgagatcgcgccattgcacagcctgggcaacgagcgaaactccatctcaaaaaaataaataaaaatttttttaaaaaag

SEQ ID NO: 1022 - DNA, 339 bp, Homo sapiens
gcaaaggggaagcaaggcaggccttacatgggagcagaagagagagagagagaggggaagagccacacttttaaaccatcacatctcatgataattcaatcacaatcacaaaaacagcatggggaaaacgcctctgttatccaatcacctcctatcagtcctgacactagagctgagttaaccacagccaccagaagttggggacagggactatgttggctaaataactcatttgtgctcttttgcgtttttttgatggtgttgtatataaaattatatttttttgttcatggtttttgggaggaattttgaagagattaaaaacttcactatcatgat

SEQ ID NO: 1023 - DNA, 1782 bp, Homo sapiens
gtaatacgtgctcattccatcttcaatggaacaaatgaatgttgctgcatcgagcatctgtttactcacatcttcattctctaaccactctattgattctttatcttgacccgcaagcatacttacgtctcatcttggtgacaaagagccctcccgtggcccaggcacctcgctgaactgctctcttatttttaaccgcactgactttgcccactcaacacttcaactctgggcttttggtcctccaggcatcttgctgaaactactctcttgaaggccgccagtgagttcctacaaagtgttactgtctgtctgaaatccctaaaatttccaacaatttaaaattgttctcccctttaacattttcttcttgattgcccgcatttctgagcgaggcataatgatgtatgcaggggctggatgccatggggcctggggtttgtggtaaaatgtcggtaaagtaaccacacagcaaaagggatagtatggccctcatcttaatctctgctgattatttatgaatgggcacgggtgggggttcattatatctgcacttttgagtgtgtatggtttattttaggtcgtctcactctgtcgcccaggctggagtgcagtggtgccatctcggctcactgcaaccttcgcctctgggttcaagtgattctcctgcctcagccttccaagtagctgggagtacaagcatatgccaccacgcccggctaatttttgtgtttttagtagggatggggtttcccatgttggccaggctggtctcgaacttatgacctcaggtgatcctcctgccttggcctcccaaagtgctgggattataggcatgagccactgcacctggcctgtgtattgtttgaaaatttttatgaaaccaaaaacaaacaagtttgctttcatccttgggcattgatggcgtccgacttgcccagtggcctcctgcctccttgctgctgctttgccggagttcaccttcctcctgcttctcccgggctctgcctttgccctcctttctctctctgcagtctctcttggctacttccgccctgccaggatttcagtgatcattcctgtgtctctaattcccacagccctcaattgtctccccgggtccctggtcctgagtttctaatgatctgccgacatcccctggatatgccctgtgtactctctgtctcacacctgacccttttgtatatatacagttcttacttgtccttcaagatcttgcttgagtgccacttcctccaggaagcccttgctgatttctcagtcagatgtcatttctcccacttcattattcttaaatgacttcagcatggtctgaccttattacttagattttgtattctagttttgtgggaactgttcctggaatactagggttgtgttttccagagatccaacatgttgtgggaccttgtacactggaggcaattcatactttgtagaccagttatgatggtaaatggaaaaatctgaaaaaaaaaaagctgagaaaaatggttccaccaaagtattcaaaattgcttttcatatttcagaattgacatataagagtaaaaagaaagtaacccaaactgcagtggtgctgtggggctagcataaaatgttaatcaggtaaataggaactcaaaggaaatttaccaaattgagctcatttacatgtgtaattacccatctgtgatcattctactgttctatttattctgtctttctcctcccacactgggttaaaaatactttgtattaaagattttcttcataaccaaa

SEQ ID NO: 1024 - DNA, 259 bp, Homo sapiens
atggtcaggccctctgggctgttatataattttccaggagacagtggagtgaagcagacctcagcgtcccagaggtgtgctgccacgacagtgtgctttccttgcttggaagtcttggaagcttcttacctcctctaagaagattttccaggcaaaacccagatctgctttagtgacttcagaagaaaaagatctgagggaggatgagaagccgatagccaatggttatgaggatgagggtcgctatccaaaggattga

SEQ ID NO: 1025 - DNA, 3512 bp, Homo sapiens
atttcttagggcactgccataagtgttttacacggtggctgcaccattttacattcccactgaaggttccagttttgccacatccttgccaacacctgtttttaataattgccatcctaatgagtgtgaagtggtatcctgctgagattttgatttgcatttccgtaatgactggtgatgctgagtatctgtttgttggccgtttatatgtcgtctttggagaaatgtctatttgggctctttgtccatttttcaatcaggtgtgtgtttttatatgttctgggtattcacccttttcagatatatcattttaaaatactttgtcccattccgtggattgcctttcactctgttttgttctttgatgtacagaagttgtttctttcttttagttacctgtgtgtgcctctggtgtcatatctaagaaatcactgcctcacccttttcagatatatcattttaaaatactttgtcccattccgtggattgcctttcactctgttttgttctttgatgtacagaagttgtttctttcttttagttacctgtgtgtgcctctggtgtcatatctaagaaatcactgccaaatccaatgttgttaaaagtttcccttatgtttctcctaaatgttttagttttagctcttagtttaggcctttgatctattttaatttttatatatggtgtgaggtagatctagcttcatgtggatgtccacttgtctagcaccatttgttgaaaagactgtcctttctcccttgaatggtcttggcaccatcaaaaatcatttgacccatatgtgcaagggtttatttggggatttgctattctgttccattggtctacatgactgtctttgtttcaatacaacaccattttgattattgtagctttgtcgtaagttatgaaataaggaagtgagagacctcctacttggttccctttcaagatgattttggctgtgtgaggtctcttgagattccatatgagtttcaggatggaaaaaaaaaagccactgggatattctgatagagattgcatgaaatctatagattgctttggactatggacatcttaaggtatccaatccataaacacgggattgctttctatttatttgtgttgaccttactttctttaagcagtgttttatggttttcaagtacaagtcttttgcttccttaagtttattcctaaatatttcagtttttttgttactattataatggaattttcttaaatttccttttgagattgcttgttattgtatagaaatatcatggatttgttgtgttgattttgtaaactgcagtgttactgaaatttttttttgtatatgtatggacactaggattttctacatataagatcatgtcatctgcaaacagataattttgcttcttcctttccagtctggatgccttttatttctttttcttgcctaactgctctaagactccagtactgtgttaaacagaagtggtgagacagggtatttctgtgttgttcttgatcttaaagtcctttcagtcttattgaatatgatgtttacagtgggatgttcatatggcctctattttaggttgtttccttctattcccaattgttgagtttttatcatgaaagggcatgacattgtctcaaatgctttttctccatcaatggagatcacatttttttccttcattctattaatgtaatagacattacatttattgacttgagcatgttgaaacatctttgcataccagctgtaaatcttacttggccatgatgtgtaatcctttcaatgtcccactgaatcctgttggccagtattttgttgaatattgatttaaaaaaatcttgatcaggaatactgatgtgtggtgtttttttcttatagtgtctttgtctggttttggtatcagaataatgatggcctcatagaatgcatttggaagtgtcctttcctcttcagttttttggaagagtttgaggagaattgatttaattcttcagatgtttgccagaattcccatatgaccctgggcttttctttcttgggaggcttttctttactacttcatgctcttgactagcataggtctgttcagattttccatttcttcatgattcaatcttgataggctgtgtgtttctaagaatttgtccagttcatctaggttatccaattctttgatatgtaattgctcatagtactcttaatcctttttatttctgtaaaatcagttgtaatgtctcctcctggtttttagttgtttttcttagtcactcttagctatcaacaaactcttggtttcatttatttttctctattgcttttctgttctctattttgtctctgctctaatctttattattattataatcatctccattctgctggctttgggttgattgctcttctttttctagttctttcagatgtaaatttagggttgacttgagatcttaatttgtttaataggtgtatttacagttacaaatttccctcctaccactgctttgactgtacctgtttttttgtatattacatttttcatttaccacaagatattttctaatttcccttgtgagttccccattaatctgctggttgagagcgttgtttaattttcacataattgtgtacttttcagttttttgtctgttactgatttctagtttcatcccactgtggccagaaaagatattttatttcctcagtcttttgaaatttgttgacttgtttagtcatctaacatactgtctatcctagagaaaggtccatttgcacttgagaaaaacgtgtgtactgctgttgtgtctgttaggtccagctggtatgatgctgttcaagttctgtcttgcgactgatcttctgtctggttgtcctatccgttactgaaagtgggctactgcagtctcctactcttactgtagaactatccatttcttcctttgattctgtcaatgtttgtttcatatattttgggctctgatgtttggtgcatatatattacatcttggtgaattttcaaactttttaaatttcaacatgaagatgaaattataggatgtctgggatttcctttgaatccgtggggctgggagtaactataaatgaaacaagattggccgggaatttgaggctgcaaggataggtacacacaggggagtgaagcagggcttggagcagatggtaaagattgttggcttttccagccatggggctctcttgccacttggcagtagtggcatgaagccgccaccagggggccacgcaccagtgcatgtggctgtgttccaaactttttggacaataaaatctgaatttcacatacttttcttatgtcattagatattacccttttacatcttttcactatttaaaaatgtaaaaatcattcttaacatttgggctgtgcaaaaacagctggtgggcccaattttggcctgtatttcacttgccaacctgatttatacttttgtatctatttgacattttccattaaaagttatataacact

SEQ ID NO: 1026 - DNA, 408 bp, Homo sapiens
gggactgtgacagcatcacggcaggacgggtgctctgtaatcgttacgcaccaggtgtcttgggagcagaggaggtggctccccacaaggtcacgttgtgctgatgtgatgggtgagaacggtgaacgccaggctcgtcaagctttccaatttgagtcttcagctatccagaagctgtgaaggggcagccccgtcaccagacacaatccttgcaaagggacagcctccatcagcctccatggaagactgacagacccacacaggggagaataaatcaacctgcaaatgaagcattcagccagcttgggagttctgctttccattttaaattaatacaccggccttctggtttgtacatcggttgtcctcccgtgggtctggctggtaggcattggtttctgaggggct

SEQ ID NO: 1027 - DNA, 358 bp, Homo sapiens
gcacccggggccaggagcggaagtccgaggggaccccacggcggaggagcggcagagcccgggccccgcgggagagagaggcgggagcctctcacactaacagttgatcggcggattccacttactgtgactatccagtctcctctaggcctttggacatctgaaaggcagtgttaagagcccaactctggagatggactttggctccaccaccaagtattaatagctctgtgacttggggcaagttacttaacctccctacaccacagtttccactgctgtaaattggggatgatgataataacagccacctcacaaggttgcctggagatttgattaaatgaaataattagcatgg

SEQ ID NO: 1028 - DNA, 547 bp, Homo sapiens
aagcgctgctggcacaccgggcactggtagggcttctcgtccgagtgcgacagcttgtgtcggttcaggtggtagacgtcgcggaaggccttgccacacatctcgcaggcatggttcttccggatgcgcttccccgaggcggtcgtggtcaccacgccaccggcggccactgcggcagcgccgccgccggcacccgcctctccccctcccccgccggctccgctcagctggggcacgctcaggaggctcaggggcaccatggtcggcatcttcatagcacccgaggggacccggccggccttggctcccgtgtggatggcttcgtgcctccggagattgtagccgttcttgaactccttggcgcacagagcgcagatgtagggccccttgctctttgtcttcttctccaaggcagacgcgaccggggccacggcgaccgtcgaggttggggctacgacggcggtggccgccgccgcggcgatagtggcggcggaggcgggggggaggaaaagagggcgccttgcgggccgcggagcgccgcggcgac

SEQ ID NO: 1029 - DNA, 1031 bp, Homo sapiens
ggaagtggcttaatgatcctgaagggatttcttctgatggtagcttttgtattatcaaacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaa

SEQ ID NO: 1030 - DNA, 2394 bp, Homo sapiens
tctatggtttccgcggctcgctagaaggagtgcggtccactggaggtctccctacattcttcctccattatctcactgcctccggtggctgctgggataccggaggactcgggtcccggctcgactcagtcctccagccgcccggggaatacctctagttcttcccggccgccgccgcctccgccccgccgcttcctcctccgcctgccggcctccttcgccccgccccgtccgcgcagctcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacaggctggtcttgaactcttgggctgaagagattctcccacctcagcctcccaaggtgttgagattacaagcatgagccacctcacctggccaagagctagttgttaaaagagcctagcactacccccctctttcttgtttcctctctcaccatgtgatctccacacacattggcttgccttccctttctgacatgagcggaagcagcctgaggccctcaccagatgtggatgccagtgccatgcttcttgtacaatctgcagaatcataagctaaatacacctcttttctttataaattacccagccttgggtattcctttatagcaacacaaacggagaaagacatatgcaatttgccattttaatcatttttaactgtacaatttggtggtattaattatatttacaatgttgtgcaaccgttaccaccatctattaccaaagccctttcatcaccccaaatagaaactgtgcttattcagcaaaaactcccattttcctctccttccagcccctggtaacctctggtaacctctaatctacctcctgtctctatgaatttgcctattgtaaatatttcacataatggtatcatacactatccttttgtgtctagcttatttaacttagcataatgttttcaaggttcatccatcttatagcatgtatcagtattccattcttcttttctatggctgaataataattgtatgtatatactgcatcttgtttatccatttatctttttgtttgtttgttttttaaagacagggttttaccatgttggccaagctagtctcgaactcctgaactcaggtgatccgcccaccttggcctcacaaagtactgggattacaggcgtgagccatcgtgcctggcctatccgtttatcttttgatagacattttggttgtttctaccttttgtctattgtgaataatgctgctatgaacattagtgtacaagtcactgtttaagttgttgttttcaattcttttgggtattgtattaggccattcttgcattgatataaagaaatacctgagactgggtaagtgccaaagaaaaaagggtttagttggctcacatttctgcagtctgtacaggaagcatagcagcatctgcttccagggaggcttcaggaagcttccaatcatgatggaaggcaaagtgggtgcaggtatgtcacgtggcaaaagccagagcaagagaggaagtggggaggtgctgcacacttttaaacaatcaaatcttgtgagaactcacaatcttgatgacagctagagatggtgaagccactcatgagaaaccactcccatgatccaatcacctcccaccaggccccaactctaacaccggagattaattacatttcaacatgagatttgcataggaacaaacagtcaaactatatccggtatatacttaagagtagaattactgggtgataattctgttttacgttttgaggaattgccaaactatcttcctcagcagttaaaccatttacattcccaccagcagtatactaggtttccaatttctccacatgttcaacaacactagttattttttcttctaattatagccattctagtaggtacaaagtggtatctcattgtggttttagcatcttttgagttgcttattgaccatttacatgtcttttttttagagaagtgtctaagtattttgtccattaaaaaattgagttatttatctttt

SEQ ID NO: 1031 - DNA, 2129 bp, Homo sapiens
ttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagagttaagctgaaatatgtaaaactaaagaattatctgaaggaaatatgtgaatctgaaaagaaggctcatactcgaaaccaagaatatttaaagcgatttgagcgtgtccaagctcatgttgtacacttcaccacaaatacagagaagcttcaaaaactgaagctcgaatatgagactcaaattaagaagatgctatgctcaaaagatagcctgggactaaaagaggaactgacagatgaagacagagaaaaggttgcagtgcacgaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgaggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 1032 - DNA, 661 bp, Homo sapiens
gccgcgcctgaagctcaacttccgaggctctcatcaatctacgcttcctttggagcgtgcagccaccaggtggcagccgaggccacgggcagacagaaaagctcccgaaactgaaggactgccaggcagcagagttccggagggctcccaggaccttcaaccagaaagagacagagcatatgcgcatatccctgcaaggaatgtactatagagccaattttaccggcaaaggaatggaagatctgaaaggctaggcgatcccacaagcatcgaggagcaggctggaatttgaaccaatcggcatgattcccaagctcaagcttttggccacccctgcactgccagggacaaaaaaaaaaaaaaaaaaaaaccctgggaggagagccaagctagggagtcaagaccctccagccaggtctggatgggaggcaggtgcctccaccctggtcccagagcaagttctgctggcttcagccacctgacttccctgtgaaggtgggtagaggccagagcagactgtgtgtgattctggccccagccccagcacctctacccccacctttactacccctaggctgcgggaagaggctttgcccagcaatagtcctgatctaatggatccttgaagcacaataaacagatagtatttctgcatgtgtca

SEQ ID NO: 1033 - DNA, 564 bp, Homo sapiens
agtgtgagatggaagatgatgtcgcaagggtggagcccagttgacaggaaatgtttctccagaagctgaaaagctgcctggtaaaggcctttcataaaatggtctgcgtttgggaccaggaagacagaagactcctcaagaagagaactggaaccttaacccacttcagacttcttcatgtctgaagcttatttccaccatcccattgagaaccaaagaagcgagctccttggagaatcggctcccacctggaccttctgtttatccttccaatagctgctgcattcatccttcccagctaatgacacttccagcctttcgtgtttcaaagtatcacggactttgcaaaagattccaggtttctatggagcagatagtacttttaacaatcaacatgtgcattattatttcctcctaaggcatacttagacatcaatgcatgctacagcaaggcaacttatctcaccctcaccaaggtggcttcttcttggatatctgaatggtggtgagatcaacctctgggccagccaagtatggaactcaatccaaaacaacggacttctt

SEQ ID NO: 1034 - DNA, 1099 bp, Homo sapiens
ggagagtccgcgcgcatcgcccggctccgcggcgccagccatggcgtccgtgcgtggccccgccagggatggggcgacgcggtcagagccgcacgcgaccgaaatccgcactctggagccgcagagcgcgcggtcttgctgtttagcggctccctggcaagtgacgtggggaagaaacgcagggcgcaggagagacagctggaaagcgggctagccaggccccgttttcttcagcttctcccttgacttgatccctgaagatggctctgcctctggcgcccttgaaatatgtcgactaggtcatgatcaccgtgcattctgctcagcgtagtctccccgcctgaagtgttattaatgcagtctaaaatgactacggttctgcggtctaccgaactgcccacggaggtaggggtttcagacttttggcatctcaagagacttgagattaccgagaccacgatacccccagagacgtgacgagatgggatcaaggccacgggggaccagaatgctgacccaggcaacctgtccctgcctcgctgccctttgtaatactccttatcatatcatgaggagctattttccgttctccacaaacttggtggtggatggaagaggatatcaagctcaccttgagtgggattgaggtaggaggcggggctcagacaccagaccagattgaggacaaactaaagcaaggtcagggccaaagcagctttccaacagataggaccaccagggtgccacgtcagtttaccgttgccatgtcaataccagggagttaccgcccctttccgtggcagtaacccaataattaccaccccttccctagaaatttctgcataaaccgccccttaatctgtatgcaattaaaagtgtgtgtgtgtgagtgtgtgtgtgtgtgtgtgtgtgtgtatgtgtgtgtgtgtgtgtatatatatatatatatatatatatatatatatatatatatatatatatatatataaaactgcaaaactgccctgagctgctcctctctgcctatgggggagccctgctctgcaggagcagtcacggagctgtaaccctgcctcttcaataaagctgttttcttcta

SEQ ID NO: 1035 - DNA, 4819 bp, Homo sapiens
caagtgccagcccccgcctgcccagcagtgttaggggagtttccggctgctctgcacacagttggtactgcaggaaagaaagctgccttgtaaacacaggccagggcaccgtggaaatggggaccagctgctctgggagggtgcagctagcagagctgtgcagcgccaggctgggtaggagagagccatgctacccacccgcacccctactgctacgaagcccccagaatgggtcattgttggtgctcagcagtcctctccctcggggatgatatccaaaatatcaactgcgaagactcgggcagaccaatcagaatagatgatggcctgagtgctggaccagaggcctcagagcagggacccgggtggcggggcagtaggagacacttaagggactcagggctatggctgtttactaaccagcagtgcctcttactcagatggcatcagctgaactttccccatcatttctagttggtccccaccctgccaccatctaggggcttctctgccaccaccttgtgagcagttgctagcctcacactcctctcccatcaggggctcatctccaaaaggctgggagctcccgccctgcccagttaatcctcctgcctcactgaagcacaggaaggacccaggccccagaccatcacccaccccagggctgggccctgggccactcctggctcactccagggcccctgttgtttgaagatggtaccaaaggctggaagactcttgctagggaagataacgtaaatgcattcaaaagacagggtaccacatgatgctagggaaagtgcgtcatgaccgcagggtagcagcctgctcctgtcactagggatgtgaatctggggagacacttcccctcactgagccatctgtaaaatgagagcattggactgggtgaggcaggctgtgcaaaacacttatacaccttagtcccatgaggaaggagtattccccctgcatattttggggggaaactgaggctcagggggatgaagtactttgctcagggtaacacagccaggaaggagcagagcaaggccatgagctttggatttttctgtttccaatgtctcctctaccgtgctcaattagatgatgagaaacagttggtgtctgatgctggccaataagagaaaagaaagctcaagtgggctggggctgtcagggagggcttcatggagaggctgtcttgaaaatgacagaggtcaaaagaaaggtcactccaagacgcagctgccagaatggtccaacacagtgaggagttgtgtctggatgggccagtggaacgggggaagtgaaggttgatataagtggaggttgaggcagtttaggcgtgatgtacagtccagccacagcaggttcttgagcaggagggtagcatagtgagcatcaggttctaggaagaagcaccagttcagccatcagatggggcaggatgcctcccagctactcctctccccgagaaggaattgcccccggagcggccctcatttattccaggagaagccaggccctgctgcttcagtttccatcctcactgacgcagataatccaaagagtcacttcagctgcttggaacagcagggttgggtcttgtgctacctgattcttaatttggctgatgtctaccccatttcctccaggcttctctagaggtggcaggggtggggtggggagaaagctgccagacaccaaaggagctgagcctggcgggggcgggcgtgcgggtgggcatgagaaattgctcaggaaacccatccctgccctggtcaccctagtcctggagagatcacccagacatgttggaatgagtctggggtcctgtcttttccaataatgtgttatcctggggaaacccagagggaagttgagggagccccactgtgctgtgtgatgctacatacgcatgcgaatacaccaccgggtggccttgacccagccttctgcaaaatggcttctgccatcaaacttaaggtggagaatggtcttgcagctgccagtttttccttcagagaaactaaggtcagagtgttggctgcagaaaaggacttggcctttgtcacataacaggaaagagagtcaactccgggcacaccccctcggaggctaatctcaggaggttggaaccacagggattgcaataatcgctgaatacttaccatatgccaggtgccaaagcattatcctctccactttatgagtgaggaaactgattcccagaggtgattcccagaagattccaaccaggccatctgtctgtagtccttccttcccacctcctgggatttctcaaaatgtttgccatcgcccacctgtatcagaatctcctgggctatttattgtttaacttgcagactcctgggcgccaccccaaccccctaaatcagaatccctggggttgggcccaagagtctccattttttgacaagctcctccaggagattcctccagacatggaaatcctcacttgactcttcccccataacaaactgccctgatgtctgcagagagagggtctgctgtagacagggattaagaaaaagcaggacattttcagataggatgcccaaacccagacgcagattaggacccatgaagtagggggtagagctgaccctcaggaatgtgcccagacagagctaagctttcaggaaaattagaaagaccctcagacccagagtctgtctgagtttagcttcgcagcatgaaggctgccttgagaaagctgatataacaagaagcagcagaaatttaatactttggaggggcccagcaacccactcagggccaccctgggagaccccacagaccccaaggctatggtccagacctgttcactcaacacctggccaggcggggcctccagctggacctagagctacagatgccccaccaccactaccaagcccggctacccagaccaagacacggcttttcctggaggagagagagagcaaaggccctgtctctacccaagacctaacggcccctgttgaaggagagggagcaggagagggaggagggaggaggtcacagccaggaccacatacactcttgggggccctgctgagactgcaagagtcatgaattctaacgttccacaggtgaaagattccaagattctaggattgcaaaaccccatcattctaagattccaatggaatgattccatgtttctaagattccatcacactatgattctatgctgctaattcttgaaatttcgagtctcattgttcgttgctgttccccagacctgtgggccctagcatttttttaaaagcacaaaaaaaaaagagcaagaaagagagaaagagatggggagggagacagctgaaaacagatactaagaaaagctccatcccttggatctgagttacagatgcaccttggcaagggccaaagaccctccttttgagtggggtgcagaacgtctttccctggtagagtggcagaattgcatgcatcaggccttcctgggggtaaaaggggctggctgttccaggctacagctgagtaaagccccacacaggccacagtgcccactggctggtggacctaggaaccaagcagggccccactggctcagtctggggagggactcatctggggtggaatttccctccctgcagcaaggaagctgcagggccaggaatttgccttgggagacccccactgaggaatatttccgaagcagaaccccttcctattcagagccagagtcttaacactggacaaccacagggtgttgctgcaaactccagagccaggtgccttccctctgacatttgggacatagcttccatggccacacagccttcgcccccttccaagaccccccttgacctttctaatcttagtcactgccttccagagctgggaggccacacggcagaggtgcctgtgaatcactccgtcatcagcctggccgctttcccctctgtggagagggactctgatgggcagggggcaccaagttgagcctctgaggctggcccagcataggccaggcagggacattcactcacaaccagcctttttggactctagagaagagtaattaccacttggtcatgcccagcccccaaatcataatcatagctgctatttcttgagtgccagcaatgtgccaggcaccgtgcccaactttttatacacaatgtcttgcctaatcctcacacctctgtgagacaggtacaattattactcccattccacagactagcaaactcagagacgtgacatggtggctctcccaggtcacacagccagtaagtggcctctgaccccagtaccccccacttaatcaccatgctatgctgctaccagtggtacacactcagcccctctccactgtcagatcctttgccagtcaaatcccagatccccgggggggcactgtggcaccctctttgagcgtggcctccctggagctgctgtcagagccatgggctgtgggagtgagtgtgcacactccttctcctgaagtgtctgccccagcctgagctatgcagaccggagctctcaaccagggtatggggctgtctggcagggtttcccagaaccctgtttcctgtggtcataaatatgggttttcctgacaatgttgggaggtcagggactgatacagctggggttccaaccgccgtgggtcagacctggctcctccggaccccactgctgtgaccaaggaaatctcaccagctgtgtccaagatcaaccctgaccctgttactccaatgcctttgtaggagtatttttagcagaaccgtttttttcccaaaataaatgtgaattgtaaaaatta

SEQ ID NO: 1036 - DNA, 4258 bp, Homo sapiens
gaatgctagttatttgtcagatacatgttttgcaaaccatttatctgtatttggtttctttttgttatcttagcagtgtatcctgaagaatagttttaaattttgatgtaatccaaaatatttcggttgtttgtgttctttgttatcctatttttgttgttgttgttttatagatatgggggtctcactacgttgcccaggctggtcttgatctcctgaactcaagtgatcctcccacctcagcctcccatccttgtctacctaattaggctttgtgtaactcagtgttgcaaagctttgacatctgtttgagttaatgtttatatatgttgttacttaagggtttcacattaaatttaaacatacttatattttataaccaaacaagtcatgttggggcatactcattaggattgagtgctttcttacaccaaaatacatgtatacaaagatttaaaacactttcggccgggcgcggtaatcccagcactttgggaggccgaggcgggtggatcacaaggctaggagatcaagaccatctggctaacacggtgaaaccctgtcgctactaaaaaaatacaaaaaattagccagacgtggtggcaggcgcctgtagtcccagctactcgggaggctgagacaggagaatggcatgaacccgggaggcagagcttgcagtgagccgagatcaccccactgcactccagcctgggcgacagagtgaaggctatgtctcaagaaaaaaaaaaaaaaacttttataataacaactgtaaatagttcaattgacagtcatttgtaagatgtttaagtaaactgtgaaacagtaagtaaatggatgaaaacacactgattaaaactgctgcttttatccaacaagatggatgaatttcccaggaaagaatacttgagttcaggcctgttcaagtcccaacctgtttgtggtttgaggttgctctctgcctcgtagagcaaagtggaaaatttatcttctgggaggacagagttttcttctctgaaaaagtttcctacatagttggctttggcatttgcaaggaatgaaaggtcagggattgaggcctcatgagtctggatttctagctgaggttgagagaaaaggtagtgattgtaaccagaaaatccagagtgggtgtatttacctccagaactcatcacttaaaaaaaaattttttttgaactgacatgcttgaggctttttcttttttttttttttgagatggggtcttgctctatcccccaggctggagtgcagttgtgcagtcatagctcactgtagccttatcctcctggcctaagcagtcctcctgcctcaacctccctagtagctgagaccacaggcgcatgccacctgtgagtttctagagatgaggtctccctatgttccccagcctggtcttgaactcctgggctcaagtgatcctcctgcctcagccttccaaagtgttggattacaggcgtgagccactgtgcctggccagagctcatcactgttaactcagcctgggtttttcacagcagtcatggaaatagattcattaataatagtaacaaatatatagtctccctctcaaagaaaccttgagtggcagtggcataccagatacacagtaggaaatactgtagaattatgttgttaagttcataaccaaacatcatacatgatgataaaagacaagataatggtcacatttatgcagtattaactgagagggcaaatttgtgcctgagaagctattgggaatgttctctctctttgcattactaggaattacatgggaaacacatgtagacagtcttcaggctattaagatttgtccacttaatctttacttatacatgaataaaaaatgggaaaacatgataaatataataaactaatacactcaaccctgccccttgattatataatagaacaaaatcagcatgcccggcatgagcctgccagattgccaattccatcctccaccttcagaggatgccgccatccagaattttgccttactcattttactttcttcatagttcgacaccttaaatgtatattactaatagtagctttgcatttttggctgatttaaaaattgatataaatgaaataatgctgtagagatgctttttggtattaagtggatatactgttattcttaaagatgtttgaaatgaatatacctttctaaatatctttttaaaataatacattaaatgatactgctttagaattcatgaactgcatctcatgagaatatgtagagatgacgtgggcaggtaaagtaaaacttcaggttgaatatcctatgataatttaaaaatgacaaaatagtgtggtgaataatagagcttgagcactttaaggcaccgtagggaccccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgttatacctgccttcttgaaatcattactgagatagctaatattaaaatatcctggtttgtctgtatatttaattctttactctcattatactaaatttttttaatgtaatttgaattgatggtaaaaattgtatacaggccgggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatatttcattcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaatgga

SEQ ID NO: 1037 - DNA, 1016 bp, Homo sapiens
aaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctgctacaaagacatgctggacatcttcacggcagcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgatctcctcgtgtacgtggtcatcgggatcttctgcctggcctccgccaccggcctctacagctgcctggcgccctgtgtgcggcggctgccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaag

SEQ ID NO: 1038 - DNA, 613 bp, Homo sapiens
agaaagagaaacttccattgctaacatgaagccaaattgtcctaaacaggagtcttgagacttctcttcttttggtgtggattccggaactcctttctgaagcaagaggcaaatatctctcagcagagaatgccaagaccaatcacttaaccatggcaatcttactcagcatggtaattcccaccctgatggtcccaagatggctgcagcagtttcagccatgttatcctaatccaccaacatctggaggtatctgtcttttcaatctccatctattacaaatgtaggatacttttaccagaaggtcctcctctagactactactcatgtttcattggacaaatttggtcccatggaatttcttaagtcatttactgatgaggaaagtggaattatcatgactggattagactacctaagattcaccactcctgagcctggagaaagataattttctcagagcaaacaactgcatatggctgaagataggaatgaactataaaacaaaattggagtcctccaggaaagaaagggggaattaaagggaaatgattgtgtaggcaaaacacaatagtctccaatgccaaataaactttgttttgttactctctca

SEQ ID NO: 1039 - DNA, 589 bp, Homo sapiens
atttccctgtgtcctttcctatggctgtggttggagagacgtagagagaggctgctgcgaagtcacaatccagccacacggcattgatcctgtcatggctggtgtggttgtgtccacacgtgacctgaacatccttcccactcagtaccaaatacagtcaattctgtggcttgatggtgcgtggacataacattcagatatcgcccatgatgaggaaacagaagctgggatatgtgagtaaacatttccaaggtcctgcagctaatcaatggttgacaacttctttcctctgcctatgttgccatccatgtcatggtttgtgtcaagactctaggagaagtctaccatcagcaccacagctactgtgcacaaatccagaatgccagactgaagtcagaaggaaagatcctttatatattgaaagaagaaagtagaaccatttctgggtcccagctgtgggaagagctcctgtggctgtgaattctgacttctgggtcttggcacaaggtgtggccagcaagctaagctgtcctgagggtgtgcagggccaggggctgaagacagtgttggagcatccacagactggttt

SEQ ID NO: 1040 - DNA, 445 bp, Homo sapiens
attaaactttctattttcttaaaactctcacatcaggtatttccagtgttttcaagcatgtataaatattttaatgtataaatgttgtttaaaatcccctcaatcggtatctcctgattgagaaaatacacagtgaccaatagctaataggaattcagtattgctttcaaagaaatgtgcatattaatcactgtagcatctgcatacatttgaaacacggagtaatacaggtctgtgcaagaattagcagcttgttccttgctaataatgacttgtgtcatctggaaggcccccaagagcccatggtctacaggtggaatgaccaccacttgggagtgagctgatggagagcacccagcaggtctcctccatcttcctggttcctgtgctcaccatagggctggtgtacattgggccattaataaacgtttgttgaacaaattaa

SEQ ID NO: 1041 - DNA, 395 bp, Homo sapiens
cccagggccacttagggtgcgtccacgctgggtgtgccaggcatgcacgtgggctgcagacgcccaggaggcagagccgagcctgccaaggttatgcgtgcacctctcagctccctgcttaacactgcgttcccgggagagagatttctccctggctgcttcacatccagaggagaacatcagctctcagcagaacataaggccctcttcacctgccagctgggcaacagcagttactctcattggagaccctttcccttcgccacttcccaggctactccagactgaatgcattcagggagtcacctcccaggtcaaaacctgctgtgataccatcaccctgcagcacagaccacagtcccaagcctcccattcttgactctaacaccagccca

SEQ ID NO: 1042 - DNA, 5842 bp, Homo sapiens
actcctgcccctgccacgagaacacaccctttccagtttgctggagaaatataagagaagtccagtgaaagagagctgagtttccccaatgatgccatcaagatgaactaactacagttaaccagccagctgatagcagatgcatgagtgagcccagctgagagcaggtgaaactgaaattggctgtatcatctgaaacttcatctgtgaagtccctggtggtttcctagatgactacacagttgagttgcctctgattggaaaagcagtgttttggtttttcagtttgtacaagaggaagaagacgcatgatatgtgtttggctcatgtgcctgaatatggctccacagggaagacttgatacagctgaagctattgctttttagagactttttattttgagcagctgccttaacagccttcgtcttgttacatcacatgagatatatctctggaataggaagagaaaaaagacatgactgagcaataatttttgactaaaacttaaaattacaaaaccaaaaccagagatagatgtccctgaagttgtatttttatagtatgtgagaacacaattttcttatcctagttttaaggcattcctctggacccaggatttttgtttagtttcattcacataatcaaactcttttttttttttttgccatagactaatgcattttggtgtaatgatctgagcccttatccagaaggcatctaagactcatgtacaaaaatagatttcagggctaaacattctaaaagacaattgagtgcttcttttttctccggcccctagatgtaaatgaataacctctgttcactaactcttaatgtaatataagggataaattatgcttgtttatttaattgtgcttaaccagagtactaggttggagtcaaaccacagatatatttgtgagatgtgacaaaatgtagcttttagcccgtaatacccaagtcatctgggaacataactgatgacagtgtcaacacctttcaggaattctggaggtgcctttgagtttagaaattcgtaggttctctagaagcaacagtagcatactaaattaacacataacatttcaagctacatttacataattgcagtggttatgattaatacaaattatattaactgcctgttttactccttatagctgattggctgaatttaccagtgggtttggtatgttcaacaaatgatccaaattaccttttcatttcagttaagaaactaatcaaagcaaatacactttgatttgttgagaggcagagattctccctaagtggcaatgtccttggccttctaagctaaaacctaaatggaactataatatatattttgatgctttatctcacttgagttttttattctttaactgaagggcagccatggaccataaatacatagaagataaaaatatattgagcttaggagtttggtctgttcaatggatgagaactttatattttcccttataaacacaattttcaaagaatagcctgtaatagtcgtgaaaatggaaaccaatactggggaaatgtggactgcaactctgaaaaggtatcaaaatgcccgatagttcaacacaagggctaagcaatatttcagggatgtggcctgtctttggtggctcggtcactctagtgagatgaatttggaaaaggataggcatacagaatcccccctctggcagggtttgcctttggggtctgcttaaagccatgtttgctagtagaaatcttgagtaaccagatatgttttataatgctgtgtcatatttaaattctgatgagattgacatctttaaataagcttggacacagattggatttgtacagggaactggactgaagaataatcgtaggtcagtaatagatttagatatactatttttatattgtaagcagttacttctcaggattagtattctaattcatttgatttaatatgtaataggtaatattaaaaataaagattttatgctttgaaactccttaactgaatattttcataggaataagcatagtttttgtgtttagtaattttagttagtgagtaatgattagcagacaacatggtaattatattgaaatattacgtgagtgccaataacaaagctttctgatcaaatgctaagaaatatgttgtgtaaagggatctcacattttttattgcggctttctttctacaatgtgacaaatttctgggatatttcattatcttctttttgaatttttttcaagcaagactgttcagtattatgttagcattgatataaaaagaagcagaccattgttaacattaaaatgttactgagatttcaaaggtagaggacattatcctttcttatttttctttatgatacagtatttgtaacatagtgcttctgaaatagaaagcactttttggaaaataagtttagtgaatagccaaataatttcttacatataacttacaaaagtaataccatctaggctaagctattaaaaatatcagtacatcagtaactactcattatattgaccaaccagagcttatccatttttggtcattctcatctagatatacactttcaggctaaagagagatttccttcctttttcaattggttatgaatagaagtcatcaatttttttcttacttccatcttaatggtttgaaataaagagtcagatgcacggcttttcaatttcttttactactttattttattacttgattattttaaggtcaaaagatttccatttccaaaatacgtaatagaaatgataaagcagtaaaatttggacttaaaataatatggacatttttcttacaagtgtcaacatgatttacacattattaaaaaggcagtaaaatttgaacttatacagcataaactttacttaaactgtcaaatacatggttttaaagttattttattaatctatcactaataattatttttcttatcaacagagaaagtgaagtttcctaagccatcactagaattggaaacactagattttataaattaatttcttttcattgacctaaactccacatttctgctgtgttcatctgaggtcatgtccatatagtcaaatagctgaaggaaaggtgatatttttagtcaaatcaaactccaaacatcatttttatctaaattatctggagaattgaataaatatttttttaaggctgtctgtagaagaaaattatgtcaatttttcatttagctagagaggtcctgaccacagtgtcttctgttgaatttctcctcaaggtaggattccaaaatacctggaaaatgtgaaacagtgttcctcgtatgggtaatgtagcatcttcacaaaaattctgtcatgattcatttgaaaaataataccttctcatgtctaaaatagtttttcatgagaaatacattctataagaaaaaaacaattggcctatcttagaggaaaatgctattaaaaattgtgttatggaaacaggtaacattttctttatctttgtgagttttttcaacataaattttggtcagagaaatcatttcaaaatagaagagagtcagaaataatcagtacagaaatggttttgttgagaactgttaattgaaaaggcaccaagtgaagccctcatctatgtttgcataaaaaactgttttcatccctaagaagcttgtagcgtttggtgtttctagaaagctaccgcagaagtggtgctgtaggggatagtgattttttttttttttttttttgccaactgatgttccttaatggcagcaggcttctcagaaaaaatggaaaattaataattctatatagcaagttctacatatcatcactctattctctaatacttagtgtttaatgtacataaagagtagccaattgtgatattaacaaacttattaacacctgttgacaaagatctttgaagacaaatctacacgcaagcttttgccttagcgaacaacaggaatagtttccttaaaaggatacagctattttgaaatttcctcaaccattgcatcccagtgggggggatacttacatggtaggactgtttggccaaagtgcttgaagcattaggacacaacaaagatagttttgaaatgttttcttgctcaaaatacatttgttcttaggacacggctagtgctcattttacattccatgcctgaagtgtttaaaacactgtggtacaggtttctgattctgtgttggtcaattttgaaatccatgtgttagtagtaagtgtgctgattcgtagagtgggtaacttctgggaactcccctttcttttattgacaatttctttgtaaagcaaatgctaattctacaggctattaataaagactggaactcccttgttcattagacacgcagtaggaaaatgggtaacatagctgtagaaatatatttgcaatatgttctcttcgcacaatttgcatataaatgccgctttccctatttactcaaattagcaatgtgtaatggagcactcatagcctttttgtaggttcctgtgacctttaattggcactcatttcagacaattgccattttagacattgctatcgccatcttttgcaattaagtttcaaagttatcatcatggcatttttaatatttagaaatttctttttttatctctggctttcagttgaagactattcaccccggtggactcatcatgttggggactttcaattgctactttaaaaagaacgcttcactgaaataggtctcatcccatcaggaacatagaaaaacaagcagcaggccgggcgcggcggcacaggcctataatcccagctacttgggaggctgaggcagaagaatcgcttgaacccaggaggcggaggttgcagtgagccgagatcgcgccactgcactccagcctgggcgacagagagagactctgtctcaaaaaaaagtaaaaaaaaagaaaaaaaggaaaacaaaagaaaaaagaaaagcagttgtttatcttttggcttaagccaaaagaacctcaaatgaaagaaaacaaacagatgccattagaaaatgcactaaagatatgatgaaagcttatcagaaataataataaaaaatcaaatgtagcacatcctatgtacctggcactgttataggagctgtgtctgtattaacacgtaagtgtttgaggtaggtactgttattatccctatttgccaatgagagaaagaaggcaagagagcttaaggaagttttcctaattgcccagctagaaggcaggacaggtacaatttggtgctaggtgattaggcttcagaatcatccctcagtcatcatatttaatcacaggcttcatgccattaatgtctttgctccaaagtcttcatttgattgtttttttctaacttgttatttttttgagcaaacattcttgtgaactttcatatttttaatccttctttattgaggcttaaaaatatttttaaaaaatagtaaaatgtatttgctacaaaactgagcactaacttttgagaagttgttctaagctttcatttgtttctggtctgaatcatcagccacgaattctgaataaggctgatcttatattattgccacgttcaggtctctagaaataaccattataggacatgacctatcattcttatggattttattgaatgatgagctcagctgcttgtacaaatcattttatttgccttctcctttaatatatttatcagcaaattaggaagcagtatttcgttttgtgttgttactcaaaataagaggattttacatttgtaaaatatgtttttatatcttagcccattatctattaaaaacaaaaccaataaaattttgtcatttataa

SEQ ID NO: 1043 - DNA, 4531 bp, Homo sapiens
tttagagagaaaaatgaggcagcatctccatttgcaggctgggagcatgccctgggcccaggttacagctctgtccacagggggctgcgcaagaaagagtgtgtgctttgctcctgggagccccgcccttcctcgaatattctggagatctcttttgtggtggggagacccagcaaaggctgcacacacagcttgctcaaggtcaccccatgaaaagttcagctggggatcaaggtcccttttttattttggggttttttgggggctaattctgggacatggggaccttctgtcaccttctgagaagggctcttgattgtacactggtgcctgatgcctgagtgttagaattcatatcccaaacgcactttaaaaatatttaaatatctccgctctagatcacccgaatacccaaaaatagcaggttagtaacaaatacctgaaatttcctccacaccatgaaataatacacagcctttaaaatgaggatgaggatataacaatggaaaggtttccatggaaaatttttaaaaagcagatagaaaactgtatatgtgatatgatttcatgtattaaacatttatatatgtttatttatatacattcacagaagaaacgcctagataatcatgtaccaaactcttaatagtggatactttggataataggattataagtgcttttaattttcttataaatgtagtatctttgctcatttaaaaatgttttatatttgccatatatcatttctattattaggggaaatgactgaagattcaaaaaccatccctgataaaaaatattccatatcttactgaactcccaatattctttctctttctctgaggttaggtaatgtggagggcctggtaatattgtcagctttatatctctcagagatatgagactatggtgagcatagctattattatgtatagaaaagcagaataattaatagccaataaccacaccccctatttgactgccagagtgaccatctagtggaaaagatgctatgaagcatttttcttctactttccctgcctaggggctggagagacttcttcatgaaggaatacagggacagtcacaggagacaggagcaccaagggattcggacatgtggctgacacagtcttctggagagccccggatggcatcagggggaaacctggcctgagacagtgccctgatggacaaggacaggaatacggtcatacctcctgcccacttgaccaacgaccaggatgagaagccaacagatgatgaatatgaattaaagttggacaactagcaagtttaaaacttggactgggacctagatcttccgattcctacagctagcctccctttccatcttctctgtggtcatcactaatgcagtttttgaccgtcttgtccagaagctgcaaaacagacaacagaagccaggactggccctgccttagatggctttcagtgcaggaaagtatcaagacagtcttgttcgtagcgtatatctctctccaccttttctgctaagcacctcatgtatgcagctgccaatgtaacacctccatttgcgtgtttaatcaccatctcaagctaatgtaaccaagcagacttcttggccttcatccctgcctcctctagtcttctcatctctctctctctctctctctttttgagacagaatttggctctgttgcccaggctggagtgcagtggcaccatcttggctcactgcaacctctgcctcctgggctcaagccatcctcccaactcagcctcctgagtagctgggtcttcccatctctttaaaaaacaattcaattgttcagaacaaaaccctggagtcatatttaattcctcccttcctcttgcacttctaaaccaatcattcatctctactttgaaaatgtttctttattcatccagtgcaccaagccaccatcacctcgaggcaggaatattcaacggcctcataagtggtctccctatttgtgttatattcaatgcatgtcttttcttactcaaaatcctataaaggcttctcttcaccatccacgactgtttcctgccttcctcactatgatcccatcactgacccctcaagactatgttccagcctactttctgctccttgaccaacacccttactctgattcccacttttgtgacttcacatgagtcccctgtctgcctggacactctgcccccaaccttgaagtgctcacccttccctgtcactcagttgaaagtcaaattccatttcctcatgagggcttccctgaatacccacttttaattaactctctgcctcctcccatcacttctgttttaccccctcttttagttccttcctatcttagtttcataagagccagggccgtttccgacttctttccccgtcaagcctccttagataggacaggtcctctgcctcaccgactttaatcagtatttgctaagtaaacagagcacaggaggatcctgttgtcatcaaagagcagctctgcctccaatggcgaaaggattgttggaacctcatccttccttcaagttctggttcaaaaaattccatgctatgcctcacatggccttgcccaggtgcctgtttgatttgcctgggttgtctgttctttcttccccactgtcctcatttgccatgtggctcggtggtggctggagacctccatgctggcccctgggagcagctgctaaggctcggcgcctcaggacaccttggcacctgtggatatcgaccaccaggcttctcttctgttcatgtctctgcaagaatgagaacctgcccccataccatttgtgctgtgtaggcctcaggaggcatggactcacgcatccagcttcctgcaagccctctggtacatcgcagtgttcacccccagctttctattacagccaccacccagggactctggtgcaggctccttagagagaggccaggaaactgccgaggtgataagtgacagcaggtctcaggggaagagaggacttctctccttagtaaagaacctgtcgaggtcggaaagacactccaggctcaaagccaaatttgaaagttaggctgacagcccaactagggcagattggaggagccaggtggagagaggatgtgggggagtcaggaaagaggtggaaggagaagcctggaagagtggctccgctcctggagtatggccagcggcacttcgtcaggacctcgaccttcacccactagtgggagggtgttcctcgcatgacttgtaggatcacctgggaaacacacaaatggaagaatttaaaaatatctgctaggacaccccgtgtcccccacaactcatcacagagcaaacccatcacagagcaaactccttggctacttcttgtcttgggccgtcttttcatctggcctgtttgcctgactggactttggggtctttgttcccagcatcaaaatttcctaccagcgactttccatcacagctcccttccagtcttctggaaattgtcagatgtgcctggatttgcagggcctgcacaagatatgctgtcgatctgggatttttggggatttttgcagttcacactccaatgtgcaacagcaaccaaacggagatggaggacgtgaacatgaactactggagatgctgatgaaacgtgtgtaaggaccgcaatggtatctgtgtcctgctcgtgaaattgaccagatacagcggcttccttttgcttccgaaggcccggattgacctgacaattgatatgctttgctctatactccaactcccattgaccatggggtgaaagcaccctttctcggtcagcctcactgcttccccgcagatggagggattttctgcaggagcatgggccctgggccttcctttcccactgtctcttgaaagcctcctccagatgtgctgcctggctcagctctttgggtgacttttgttctgtctcatgtgacccatcaagattcacacagggctgtgtcccgggcagggctggagtcgacattcagggaggagatcactgttctggaacagagcagtgattggtttaattgaaatctgatagatcatcatgtaaaaagctggcatgtaagcatgctcccggagcctgcagggccctgcgcggcctcttgcctggccatcacgtagaggcggtcctcttgcatggttgggggcctcacctgcaccacgggcccccaagccaaacagtgagattgtacggagaccatcctggtcaggtcttgcagtttgcaccaggtagccccaggctatcctgccgtgcaagagctgccttctcagcacagtggagttctacggctgcctcggctgcagaggtcagctctggagccttgctgagcacctccatggatgcattttgcaaagggccgagtaagaggcattaacgtggcctgtgcttagttcctgacagcaagcgggattaaacccggattaaaggatcagccctaaaccaaagcagaccagtaataggtctcatgataaaagcagccaaataataatagtaaaaatctattcttggactt

SEQ ID NO: 1044 - DNA, 1948 bp, Homo sapiens
atatccttcatctttatgctgctccactccagctcacagcccctccaactggatggagctcttcgaagggaggggcatttcagaggagggtctcagggatagcccctttgtggggctgggccaccaggttggggagagtggagctgctggaactctggagggactggctgagccagctttcccagtgcacccctctgggagggcaggctctcggtgtaggctgcccatctcctcgctctcctctggcactgctcctatgcccccttggttagcctgggagcccatactacccagacttggggtcaataagcagaggacctgtaaggagtccttgatgggatgtacagcactgcccaaccctgcacaaggtagggtattgctgtttgttgtgtggtgagctgcctgcttatggctgggtttgggcctccatccatttttattttctttgagttggtctctgggcaaagcttctcccagcaggcggaatctggcctgggggctccagcttctctcacctgcctggcctcccaagagctagagagctccacatctcaactcatctataactcattagcagaaccatcagctagcagaaactaggaataataaaaatgtgccgtattttcacaagctggatgccaggcttggtggtcaggacacagactgctttcagctcccacatgcccctcctgctagctgctttgtgcagagtagtggctacatggctgcaggtgagagccctgcctgtgaacaggccaccaggatgctgggacatacgagttgataacccatgggctcctgagagcagagattgtgacttactcatctttgatgtagccaagttctaacaaacctaaatgtgcagccatttgtaagagaggatcatggaatgaatacgggcattgagtcaagcagtctgtgttccactggcggtgtgacctggggcaggccatttcacctcactgagccttagtttcctcacctgtaaaatgtgaaaaatatcaccttccttaccaggcttttctgaggatttaatgacatcatgttcagtgcccagtatgggtggataatacccaggagtttcctcctcttctcctcctaagttgacttgatgccccccgctgaagatcatggctgaactggctcaattcggatccaggactcctggctttgtctcttccctagttgcccaccacacccatggacacccttaggtagtttatccttttgggacaactggatttattagaaaagggtattctggggtggaataaggcccttttcagtccccatggagcctttttggaagatgaagttctcaaacccacaagagaattcataagacgagcacaccacccacagttaggtttccctctcaagtgctttatctccacgtggggcaaatagctctttgtctgcatatgttattggagcttttggagtccagccttcagaagagctctaatttttggattcatatcagtttattagagaagcctagttctaaggattagcaaatgggtaggtgctcagccagcccagaacaagcagagccatgacagaagtttctggaatctcacagagtcggtgtcttcatggactcagggggcctaaatccaatagcctggatttgtcactttcccttattcccttatcaaactcttcccttttggacatcagagaaggaaagtacttcctgtaagggggcaatttgcaaagcttcatggaagtggcatttgagtgtggccttaaaggatgtgtaggattgggaaccatagatatttagaggaaggcattcctggcagaaggaacagcagcaaaacacagaagtggaaattagtagcagcattaatggagaataatttggggaataagatatacaaatggaataataaaaatagcattaattaaacattgtgggagtcattctgtaagatggcccctggtg

SEQ ID NO: 1045 - DNA, 589 bp, Homo sapiens
agttctgggggtcgtccgatcctgcagagaccgtccaggctggacttgaactccttcctcggctgaagtgatcctcctgcctcagcgtcctgaataggtaggactacaactgtgagtcactttactcaaccagaaatggtgaatgataaaaaatgtttatagatcattgcttctaaaaagactatattagacacactgtggtacccaaaaccaaatgctagctactttttaactcaaaaataattagtcagctaatgatctatattttgctttacagtttaacttgacgagtagaaaaatgtcaaggtataagacaatgcaaaatgtagggacaaagaagaaaacttcccctttcaccctctgaaggtttgctgaaaatgaactgaaaaaggcagagcaacaggagaaaaggcatgcgtttattttaacgtgcataccatggggaattgcagaagagtaatggcctaataacccagcagggtccagatgcctgtctaccctctcttcttagggaaggcggggatgaggtgtgtaggagtaaatgacaaaagttcctctgagctctgggggaggtgttgggaaggtgagg

SEQ ID NO: 1046 - DNA, 1418 bp, Homo sapiens
gcgagaacggcaaatggcggttgcagaggctcgtccgaattctcggctcgctgctccctggctggcgcgtgtttgttcattctgggctaggtgagcagggacaatacgtcgccctctcaggactttgctctctccttaaaacccgaggattcaccgtcaagcttctggtttctctgacatccttccccagccgccccttcatcgccaccgatgatccagtggagaagctgtgttggaggtcaagggatggaggcgaaactgcgcgttctcgtccctgcagaaaccggaatatccgagacacatgacgaacatgaaactttctccttgtctcttggctcccactccgctacacagatgaacggtgttaccttccctcatgttactttgctaagcctactcctcagagctggtcctttgcataacctcttcaaatgctctcaactctcccttgctcctacataatggagtaatcataagtgcaatgagaaaagcatgagatttgaagttccataagtattgagtctaggttctggtggttattaactccatgatcttaggaaagtatctgtcagtgttctgtgtaaaacggaaatgctaatgtgtatttaccaggactttttcttgcgagaggcagatgaaatgtatctccgtttcatgagtaagttcagagaatataagtgacttgtccaaggtcagcaagctaatgagtgggaaagctgaggcttgagcctagactgtcaacacccaggccaaagattcattgcctgcttttcatcttatggagttaaaccttgatacacactcagatctgcagtgacttgaccagcactgtgggttcatgctttactgtctgataacgaattttcatttaattttattttttttcttagacagggtctagctctgtcacctaaacctgatgagggctgagccttcatttcgccgttttttgtttgtttgtttttgtttttgaacgagatggactctggctatgttgccagactggagtgcagtggcaagtcacaggagccatcatagcgcattacagcctggaacttctcgtcttcagggatcctcccaagtagctgggatttcaggcatgtgccaccatacctggctctaattttgaatttgtttctttaaattattatttgtgtttgctgaaattgtgtgtgtattatttttgtgtatgtgtgtgagtagttatatgttacataaagtaggttgtggggttttttccagtaatgtttagctataattgaagtttgggccgaaatctgctagtatttgttactcctcaccaaatcctaccttatctcacaacaaactgtaagatcttgtgatatttcacttccaataaccttaccaggcatcagagtggggtctctactctgaaattaaatatctgccataaggta

SEQ ID NO: 1047 - DNA, 892 bp, Homo sapiens
attttcctgcccggaaggatgcatggcccggggtctcctgcacctgagggtgggcgggaggcggccccgcgggttgtgttgctggaaaaaggggtctcgatccagaccccaagagagggttcttgggtctacttcagggaagaattggaggcgagtcacagagcgcagtgaaggaagcaagtttattggaatctactccgttagagagtgcaagtcctcagactgcaggaggaggaactcccgtccttcggtagtgtcactacttagaggcagctgtgaggagctgtgattaatcgtggaatgtgctgatgtgcccactaaagatgcctggtaagcagtggctcctctaacaagtgggcagcttggaactgggaacgagagagccaccgaaacagaatgagggagacaaagaagtgggcatcacccttaactccacaagggcttcccaagggcgctgtaccgtacgcaggcccaggacgaactttatttctcgccccagcatcgctgtccttgtcggtgagaccctggctttagggcagacaggaccacgtttcataagttcatgctgtcccagcagaggaataacgccagaaagtgttccagtacaaccagagaaagagagtccatgagaaatctgcccttgtgaagttggaatcccctcaacctcaccccgctgacttgaatgaagcgactgagacgggctatgatggagcagatccggttgctcgaccttctcccttgcaccaacacatgtagttaatagttactggacatgcatattcagtgggttccaggtaccaaacttgtattgaatggtatgtgccagacaccgtcttgagatctggagaataaaaaaataaaaaaataaaaacgagacatccagagcacagta

SEQ ID NO: 1048 - DNA, 717 bp, Homo sapiens
agtgccgccatactctaatctgccagtaacgcgatcaatgctagaaacataatagaagggaaaaaacagagaatcctttaaaattacatatattggctggtctcgaacccctgagcttaagtgatcctcccacctcagcctccccaagtgctgctattactggcaagagccccagcacccagctgagagctttttgtatttatgtagctatttatcacagactagccaagtgcagtattgagaagaggggaaagagtaaaacaaggaggttgatctgtaactatgaacaagataactcactaccagccagagagagctttttaatataaccatttcaagctcagctcacagcatccactttacaaagttcatttgtttttatagggagatgcttattcagcaagacattggttacctgcttggtgattttgtaaatgatgatttagggggcagatgtaaattttcagctaaccaaccatattacgaattataggtggaaatgagctgtaatcattgacttaattatcttaaatcttggaggtatttattggcatttctgtaacaagtgctaaagacttgccgatgagtgcaaggtttgtaagtgtcaggcagtagcagtcagtgaagtgcagcagtcacaaggccctctggtctagacagaagcagcagcttcctcttaaggccttttcctacccttatgttttgtggtgtgcttac

SEQ ID NO: 1049 - DNA, 3814 bp, Homo sapiens
ccgccccgaggaaagaatcagcaggctttgtgtaaagggattaaggcattagcctgctcagcagggagaagggctcttgactctgtggcagtgtggccacgtttccatgtgtccatgtgtccatgtgggctgctgtaggccctggctcactggtcccaggacctgtggctaaaaggaggcattgctggaggcctctcttgagaggtgggtacgtgggccatgctgcctatgccctcctcaggtccccagaaggagcacttccaaggggtgctgagtcgggggaggtgggcaggaaaagatgccagggaaagttctgagcccaggtaggagtgacagtgatgtgtggtggagatcctacagccaaacgaggagcagttaacaatgccacttcaaaaacagcgcctgaggctcagaaagaaggtgtatcttgccaaccatcacacagcaagtcaccagcagagctgagaccagaacccaagctcctggtccagggctcagtcattgattgttccagccacacgtggctggtgccaggggcccgtccggtctactccctgcggtgactctttctcctgcctcccaactccagaaaaggatcctgctggggagcctggggtgagatcccaagagcctttccgtgtggacgtggacatagtggggtaggtcgagagaccaaagcaggattctaacaggcctggacatatgtcatgggccatcaagaccatctgcatgaaggtcttttgctacagaagtgaggtggctttttgcagctgctcaggagaacaatctggcgtagaagtgggaagggaccagagaatggggcgttggaagacctaggttggagcctcacctctgccctatcttcgctgtgtgaccttgagcaggtcactctaactcttgccgcctcagcttcctaacagcgcccctgcccggcctctcttgcaggcccacagaatgaaaagagaggagttccaggaaagggtttggcagatggcatccctgcaggactgcctcgcggcgctctgccccatccagcccctacgtactggccatgtgacctcaatgtttgatggactcacttggcctctctgaggctcgctttctccatctctaaaatggaggatgaagcaggttcagccccacgggcaggcagcactatgccagggacatggcgagccctctggaaaagttcacctgatccagacgttgctgggtcaacgggaaggaatgactttcactcctctgcttcaaaccaccagactgtccttggccctccctaatgaaggagcagagaacagcagagtgggcagggaccttggaggtcagcagggtggctgctcagcccagaggcaaccgggagctcgtcccagggtgtgacaattcagtcagccctttactgaacactcggctttaaaccgcctcatgcctggcatgaggaaggcaccgtgctggagggtttcaccacggttctctgtgtgtctccggggagctcactgtcctgtctgaggcccgtccggggtccggacagtggagctttcaggttcgtgcgcaccctctgcctgcctcttctccctgtcagtaaggacgtgggtgtggctgggaggcagatcctgggtggagaacggagctcctggttctgaacagtttgagggtctggaagtcctttaagaagatggtgaaaactatggaccttctccccaaagagaagcacacatccacatccagaggcaaaaaccccatcgctcagaaccccgtggatgaggcagtcattatccagtggtgctgtcactatggctggggctggccttgatctctgttgctggattccacatgttcattctctctggccacattatcagatctctagctccaacatcctgtgtgataccaggatggccattgccatgatcttgtccacgggtccactttcagcagctgggccctggagggcagcacacagctcatgattgggttggagatgggggagtcaggggcagatggtgggagctgtccccagccctgcctctcttaggaccctcctgggactcaggtacatagggtccctgagaaagacccagtttgatgagacaggcaggaggaataaggaagagtgtagtttaagaaagttttctccagctctggttcatgcatccgtcctgaaagaaggcagggaaaggattattcacccatttcacagatgaagaaattgaggcttggagaggtcacggagcacacagagcaaagaagtcaaaaccaggatttgaatctactctgattacctccagagcccatgtcttgtcccaatggatggaaaattcttaactatttaactcaatattgagcagctactgtctacagaattctgtgccagacagcttgggagacacagacctacagggagatatagttcccactggaagcacccagggcagtaataattatcatcataacaaaggaataataatagctaacattttggagcacttactagggaccagcattatgctacacagttttcatggattatctcatttaagctctcaaatattttggggtgtaaataacagtatgcccacaatttttgtttgttgttggtgttcagaagtgtatatccgtttttgagaatggaggctcagcgagattaggagccttgctctcaacgagggaggaattctggctgcgactctgtcccttactacctgggcatcacctctgtcaaacctggacaggtgccacttagacctggctgaggttggctgaggcggggaggatggggaggttgtgggtaggcagcacctattcatacccacagtccagggactgttccagaagaatagtattccctgtgcccttgccgcctctgagccttggtgtcccagcctttcgatcctctcacttctgatgtccttgagccataatctgagccattctctaggataaggagatgcttgaggttgagtgaaaggttgacatttctgcaggagcaaagaatgacttgatgcaggagagaaaggctgtggggggaaagtgagtgaggcaaatccccaaggcagagcagagccttccaaagggtgcaggggagagtcttggtggagggggccagccttgctcagcagccccaacctcaacaaggacccctacccaagaaggcctgcaaaatagcaaatcaatgaagacagcaatgaaagcaatgaggagggaagagggaccagaatcccagtcacatcatcacccctcacccctttttctggcctcagttttccttctgtgaacagagggagctggcccttctgtcatttgcaggattttcatctcaggctggcagcaggagctggaaaagtgagggaggtccctcccttccccggcccggggtctgtgattggcagcacctcctcctctcttcctctcctgtcccttccttccccttccctcccctgctttcctttcccttcccctcctccccttcccttccccagtcttcccctcccactctttcaagcccccagcgtgctgtgcagttattagtttaggttcatttagaatcggcttagcaaccccacacccctggaacctggaagcttaaagcacaagatgtctggcaaatggaaattcaattgctttaatatagagactattttgctgcagtcgaactggagcctcttattaagaatctgatggaatttctaaacagggagagaggccccaaggagggggcatcgcccatcacacaccaacattgctcttgacatatttatggctccaataaaatctcacatctggtatattttaaaataaaattgaaaatttatcactt

SEQ ID NO: 1050 - DNA, 606 bp, Homo sapiens
tcctcccagtttgctgaatcagaatttacagttcaccaagatgccccggtgattcagccgcacacagttccagaagccctgagctagttcgtacagtgttctttacccacgctcatctccctggcctgaatcacagcgtgtttgacttgctcaagttgtagccatggctctccgtgttttgactgtgacctacagaaagaaacggactttacaacgaggaagcaagtacaccacagaaacaatgccttcactacctggggtgcactctgcactcccattcattcagcaggtagttttggcacctgctttgcgccaggcctcattctagctgcctgtgtctagaagccccggttgttgggaggtttctattctaggaggagggcaaggggatcagaaagttaaaagtaaaccatgtatataaagggcacgctaaaagatatttattaaaatctttttttttaaattacatttttagggtagggttctggggtgctggttatgttccatttcttgatctgggtgctgggtgtattacctgtaagaatgcaagctttcagcacttctctggaggtatgctgtacgtcaataaaaagttcaaaaattaca

SEQ ID NO: 1051 - DNA, 592 bp, Homo sapiens
tcaggcctgtgattaggctgtgcaacttcctcgctgtgtggccttgggcaagtggcctacacccttgtgactcagtttcccccttgggttgctttgagaactaaatgagcggccaggcacagtggcttacacctgtaatcccaacactttgggaggccaaggctggtctcgaactcctgatctcaactgatccgccctcctcagcctctcatagtgctgggattacaggcatgaaccaccgcgcccagccaaagatgtaatcttgatcatgccgtccccagcccctcttagctccagagcctcctataataacagccctcgtgggcatctggctgggtgccagccccattcacaggctcccacggagaccttgtctctcaatttcctcctgcatcatttttcttttagtcacttgtccttctctgagcccttctttgctcactttttctttagagccaggatctcgctttgtcacccaggctggagcatagtgacgtgatcatagctcactgcagcctcgaactcctaggctcaagtgatcctcttgccttgccctcccaagtagctgggactacaggcacgtatcaccacg

SEQ ID NO: 1052 - DNA, 4037 bp, Homo sapiens
gcccatccctggattgatgtagtagccagcagcaaggacatatgaagggtctggaagtggaaggctgccacccctgccctgctcccacttctgggcccccagggatcccctgacataaacagtcctgcaggaggaaataataggtggacttgtccctgtgacacagtggagataataaggcccacccaggttcaagaaaagtggggcagcaggggaaggggatggactttacctcctagtgagaagatgataaggtctggaagaggaggtatggcaaaaaatattgctgtggccgttactagaatatataatctgacgcagttacctaaagtgaaaagcgtgaaataaaggctgaagagatagggaaaaaaagtacatttaaaaaaaaagttgtttcatgaatttgaaaacaaaatgaaataaaaagcctattctaaaattcaaaagtcagagaaacaattgaacctaagtgtgtactcaagatgctggcataaccacttgataggaactacccctagttattttaaaacgcagttatttgactctgtccattaaagacaattgaaaaccaaaaaccaaaacaactgcaaagggaaatcttaaagtattttcaataatactgcttttggaggtagtgttggtatatttattgttatataaaatatagtataatattgtgtgtattgaaagataaatgtatatgttaatttggagaactagaatattgaagtatgggaggaagaagatgcagatataagaccagcgagattaatttaaaatgctagagaattggaagtgggattatacatatgaatttattaggtgttttatcttagaaattcatgtattctctttctactaaaaagccctagaaacagtgaccaacccaatagcaataaacttccttagcaaatagattatggtcactagtgatcattttctagcaaaagaaaccaagctgtcttgagaaaatgattgagtttatatttgaggcaggaaataaacaagaagaatctgtaaaatcttgtcataccaagaagcagagaggctatgagatgtcattagggtcatgtcatttaaagaagccagtatgagtagctcaaagatgagataatttgagcctcaaaacaaaataagtgatttcaatggatttaaatacactaaatctgtttaaatacataagttcataatgataggggaaaacaaaattatttataggttaccttacaaagatgatagaaaccatctcattattttagaaacggaaaggaaaaaaaaacataaacaactatcctgcctttgttttcagaattccttgtagaaataattaactagtggatgaagagagtttctctttctaggtaataagcaacgaaaaaatggcagaattagaatataatgaatttgcagttcttactaaattaatatatctaggcagtaaccatcaataaaaagaaagaccatatgacatttgtatgtcctgaagtaagttcacaacgccatctagtcttgagccaaaaatactgcacctgaatctgatccagcctccaggatgtatctatttataggaaacacagtggacaggcgaacatgttaaatgacaccacagagatgcaatctgcgaacttccactgtggaaacaatccaaatgattcaacacgatgttgcaaagacaaaagaattatacatgaacaggaggctggatgaattaaaaaacataagagatgtatcaatcataatctttggttctaatttggattctgatttaaaaatagactgcaaaaaaatttgttagaataatatgaacaaagactagatgtttgctgccatttagaaattctcattagtatttgttcagttatgataatgcatgctgcttctgttaaaaaaatacttttaatcttttacagataccttctaaatatttatagatgaaatcatatgatatctagaattttctttaagacaatctgtggaaggggtgagtggatgtgtgctcaggtgagctaatggtagccatgagtttaatattgaggttgagcgatggatacagagaagttcatcatacgaatctctccactttgatgttttcttgaactctccaatactaaaaatttagccaaaaaaattaacaggggcaacgaactttcttctttttccaagggctttttatcgatgattttaagaaaatggtcagacagcgcaggcgtgttttaccttagtccttccaaagcagtaaggtgcacccacttctcagccaccctccctgactttgttttcacaacccgaattcaccaggaaaataccaggagtctgctttgtattgtgccatcttttaaataatgcctcactttctagtagcaaagtacctcattctttttcttgatacttcaaaaaaacaaaatgaaacaagaacttctcattagctgaaagtgtttttatctagtgagaactgaaatcttcttggcttatttcctcttagatctaaacaatattaacttttttttttttttttttcccaaacagagtctccctctgttgccccggctggagtgactgcagtggcacgatcttggctcactgcaacctccacctcctgggttcagggaattctcctgcctcagcctcccaaatagctgggattacaagcatgcaccaccatgcccggctaattttttgtgttattagtagagatggggtttcaccatgttggccaggatggtctcaatttcctgagctcaggtgatccacctgcctcagcctcccacagtgcgaggattacaggcgcaagccactgtgcccagccttaacaatttttttttgtttgtttttgaggcaaactctgactctgacaccaggctggagtgcagtggtgcgatcttggctcactgcaacctctgcctcctgggttcaagtgattcccctgcctcaccctcccaagtagctgggactacacacgcaccccaccacaccgagctaattttttgtatttttttagtagagtcggggtttcaccatgttggccaggatggtcttgatctcctgacctcatgatctgcccacctcagcctcccaaagtgctggaattacaggcttgagccaccgcgtctggcccaacaaatatttttaagatgcattgtctactaacaggagatgcctctgattctgaagtactttgcgataaacagccacacaatagccaaatgaaatcttgaaatcagagggttgctttctcatgaagttagactgcttgagaattgcagtggcttctatatggcaggtgcttaaattgtccaagttgaaattctaatttttataatgagtagggatgagtgcatgaaatggttgtgtgtttttttatttcctacatacaatatcgaattcaatcccaaacttgaagcattgatgtaattgaaacatgttggtaattttaaatcgtgcagttctgtacatgatcagaatcctaatcattattaaaataggtgtttctattatatgcatatgtataaaaagtcctccaaaatgttaaattacctttctcatctcaggaatagagtcccaatcacttccagattgaagcacttacggggggaaaaggcgaagggctccagtaattttaaattgcttcgtacaatgaagagtgcctgtaaattactgaatgtgggttcttctccgtgtggatcacattaagggagcgtataacctttcataccgcctgactaggatgatggatgtggaaatacacagtttgggagccctgtctgcttgcctgttaagccattgactgttatatactcttgggcttgaaacaccttccaggctggaggggccagtattgcatttacttttatcccatttctgttttcacggctacccaagaggaaataatttgatttggggctgcagggggtagggtggaaaagtgcagtcggaagacagagaaaatcagcaagaagattactgaaagggaaagagggggaaaccaaccagctatatatttcctgcaacatgagttaatgaaattccgttccttctta

SEQ ID NO: 1053 - DNA, 629 bp, Homo sapiens
tccagaaattaccagccgccgccgctgcgccctttctagacaaatcccacagcagttcacccggctcccccaaaaccgcagagcttttctttactgagaggaccccttggttccaccaattcccccaaatccccgtggctcccgatctctcatccagggggactagaagaaaagattttctcagcactagaagaatacttggagcagcaaaggtgcccgtggtgtctttctaccattcaaggggtgtcctcctgaaggcgtctgagagggcctctggcggttccaaggctgtgcagccggggaggaaggtgaggaatatcgtgggtaagaagaggcaccaaaatcacagaatagagaggaaaattattgaggaaatgtacttgcctgtgagggtgaagctggcatttcgaggtagaaggggactagccttttttgatatctaatagtttagcattatacgtaatggactcactttagcactttcatgggaggaaaaaccaatctgagctctataaatgtggctcttggcttctcactgtgcatgcttttatgtagaaccagagtccatccttagatatttattcagcttgctggcactgaagcaacaataaaaagatgcctctaacaaa

SEQ ID NO: 1054 - DNA, 870 bp, Homo sapiens
gatatggaatttcactactgttgcccaggctagagtataatggtgcgatctgggctcaccgcaacctccaccacctgggttcaagcaattctgcctcagccgctcgagtagctgggattacaggcatgtaccaccacacccggctaattttgtatttttattagagacggggtttctccatgctggtcaggctggcctcaggtgacccacctgcctcggcctcccaaagtgctgggattacaggcgtgagccacacctggcctaaaaatcatttaattttttatgcttgcctagttataaggtcaaagagaatcaaatgactgatgcagtcagcacctaacaacctctgtatatgggaagggggtaatgagaacatactatttggaaataataacagcctaagagccaagtgctgaagttacatttctgcctaccacagctaaagctctcctcactgtctcctacccagtcctcctttccatcaattaccagtctcttgtataaatgtatccattaccaggctcacagactgggagtgatttttctcctttggagctcgtccagaatccatcagcctcacacacatatttacctgcaaatcattggaaaagcaaaaatgtttaactgcatgtataagatggttgtcatttgcttgaatacccccttgaaaaatgttgattcttgagcatcagtgggacatagaggtgtctgaagaaccattttacatgatttcataaataggaggtctctgcattaccatgtttgcttgcaaagtggaaaccttttagatgtgtaacttgaatatgtatcaagatctcaagtgcttaatgataaggtgttgacttgttaaattaaaccatttggaataca

SEQ ID NO: 1055 - DNA, 1699 bp, Homo sapiens
agcacttaatacacattcagccttcccatcatgtcattgtaccttggaacaaggagcaaataattggctgtgggatccccactaagtttttgttacacgacttcccttctctgtagaatgggcacacgatgagcgaccaccctctcggagacaaaccactgatgaaagcgaggtgtaaagctccttgtgggcaatctgggaaggacagaactcctgagaccttgagccccaccacaagagcgcccggaaatcggttcatttccgagcccagcacgtacgtgcccgcgggttcctctgccacggcgtggttggccagactctgccaggcccgctcgcaggtctccagcgccgcccggaagtccaggtgcaccaccaggaggtcggccgcctcctccagaaggtccacggccggcgcccgggccgggaccgcgcgcaccggctcgctgctgcgcaggggtcccccgagccccctgaggggggctgcagaggtcgaagaatcgctcttcataacgagtccgggtccaaggcccaggtcctcagacgtcggagtgaccgcctccccagaggctccgggatatcccgagttggcctgggcgaagagggagagtcctcatctctttgcccacaccccttcccgaggtcgattccccgagaaggaaaaggaaggggcctatctgaggcaaaagctgggctcgcctggaggctggggaagcagtttacacgtcagatttgcaggattcttgcatccctggaatacctggccctagcttctccggccccgcgacacgtgcaggaactgcctcagctccgggctcctggttacgatcaaagactcacctcgcctcccggcagcgggcgcggacatctttgcgctcgcccagccccgcagccgcgcggcgtcccggcggcgcggagtactctaggagttgtagttcctcagctctcggcccatcgccttctgtaatggaagtaggaggcagagcgcggactacaacccccagcacgccgcgccccggaagccgcccctgtgccgtgagaaaacaaactggtgctacagcttcggggtgcggaagtcaaaacgaagcaaaaccgaagctgtcttgtgaaatggaggggtcctcactaaccagttccagcggaggctaacggaagaagtgccagcaatggatgtgcagctacatgcacgcttttaattcagagcttctgcgacggtggcgatcaggggatctgtaatgtaatgtaatgtcaaggctgacgcagagctgatcaaacattttggcaaccttagtcttgaattgattcacactttctccgcgttgcctccggagtttgctgtagggtaatgaatattgcctggtgaggatgagggacttagggtggaaaccttcacaaggaccactgagaatatgttggtcccaagggcaatgttccaaaatgaatagtgaccccaccgaggcggggttgggggcgctgagcataagggcctcatttttctcactgctctctgccccatcctgaatttgctgttaaaaaacaacgttaaatgcagataccaattccacttccccactgttgtcacttccgatctgtctttatatttctccttatcatttatcaccatctacataccaatgtctatattttacttatttttattgtctatttccttccactatgatataaactcacaaaggcagac

SEQ ID NO: 1056 - DNA, 525 bp, Homo sapiens
gagccatgctattgctttagagaagcttctccttgtcatctgctccctagcctggataacacatggaacacttgaaacagaatatctagctgagccccagacctgaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatcccaa

SEQ ID NO: 1057 - DNA, 2034 bp, Homo sapiens
gtgagcgcacgcaaccgtgcagtcagattcctccgccgaccgcggccctctctcctcgggctttgccttcgctctctagcttttcttctttcactcccgctcgccgactccagcccgctgggctcacgctctgccggacaccaatcccggcggccctgcccgacggagctcaaggctaggcctggccttgtccgcggagtccgcccctcgccgccaccgggatccgcccccgcgccgacacgcacttccggcagcgccgcggccgggagggaccgagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccgggttagtgtgcctgacaacactgaagaaaaattgtgacattttccttccccagaattacttcgttttatacatttcacttctcttctgaaatcacagcaatgccagtttgcgccttttggtctgaggaacgcaggccctggccactaccaggaaaaagtatttacttttaaaacttgaatgtatatctttaccgtatgcctagtacagtagtgcttggaagaaacagattagtaagacaaaatatatgtcttcaagaacacttacgttctgagaaagaattctgaatgcagattctaatgtctggtaaaatgctttacagtgtaaagaatgcatatatgattcttattttatggcattttaaactttccaccccacggttttaaagtgttaatatatgttaaaaatatatgcaatttataaaggagaaggaaagcccagcttgatttttgctgccaaagatggtatatttaaaattaaacgtaactaatggcaaaaaataatgggaatggtgcagtctttgagctgtatccagttggcattattctcttggactaaaaggaatagtattaacttcctcactttgggtaagccactttagatttttgggctgcagttttctcaggtaattagagactttatattatgaaagtttggttcacaattctttgagtctcttttgggaacaaagaaggtaagaggaggatatgtgccctcctctcaatcaaggggtttcttgaaaccctctaaggagaaaaatctgaaactgcctttcctaaaacgttcatgggtttgtcattctgatgatcaatatcgtcccactgaagtatctttttgaattcctagttaggaatctttatgttaagataaactgatcactctctccttcgtggacagtttatctacctaaagatgataggggaaaacactgtttttgaaagacgaaataaagacatgttgtagcagtta

SEQ ID NO: 1058 - DNA, 367 bp, Homo sapiens
acagaactgtctcggaaagccctggtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtcctta

SEQ ID NO: 1059 - DNA, 4275 bp, Homo sapiens
gcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaaggccactactgattaggacacttatggagaacgtgggtagcactgaagcagcattctagtttccagtgccatcaacctcatacgtatctacctggtctctgatcgaagctaccgtaatgtgttcttgaggtcaacatgttttgtggaagtcactgtatttgcccctttatgtcaattacctattataaaccgagagaaatgggaaaattaaaaacctgttttgaattatttttaatgcagaactattttttcaagtgaaatcttatacagaagtctggtatatgaaacagataaaaatgaaccaatgagattgaagggaatgagtagcatgtaatcctgcccactcttcggagaatttgaggcaactttgtagagccttaggagttcagtttgtatgttactgggtaatttaaagcagaaattttaatctgactgcacttaagaatcatctgaagtgtttgtattggttagtcttatttttaatactgatgtcctggtctctctcccctcaaaaaaactctgctgctgggaccaagcacatagatgctttttaaaaagctcccgaaaatgactctaatatgcagccaggattgaaaataactaccctacacagcatttttcctgattctgagcactcagcttttcattgattttccctagggcaagtccttcatcttattctgggtccttgtgttttctttctgaacctacaatttctccataggtcccatggttttcaaaatttctcattttccattttctgtccttttatattacctacttgaaaaccacagtcatctttcaaaacaaaacactgcctgtttcttaggtctttattgtgggcttgttattcctcaatacaaatttacataaaataataacaattaagacatgggccttggtgtcagaattattttatatctttcttattaactctgcagcttaccagctctggataagttaaaggacagctatagtcttactacatagaatcattataaggaattggtggagtgatccttataaagtgtttgcatggtacctagcacagagaaagtgcttgaagttgttaactgttatggttacaaaatatgtaaataatttttattgtccaattttctctcttcatatacactaaattgttctaattcttgaaccacagtaacaacgtgtgaatgacttatgcattcagtgtgtccactcaactactatttattaagtacctgttatggtctatgaaaggaactggcaagacagtcattattccccttaaatattcccaagtgttagtggtcaaagtttctctctgctgaaaatgaaaagtaccccgtaggatggaggaaacagccatcttgagggctaaatctggtctaacataatatttgttgacctgttactacagtgttgccacatatgctttgttggttttttaatttagcccccaaacattttaaaaatcagatcatttcatgttaaaagaaatctagacttctagttctcttgcaaatgtgagctctgacaaacattgaaattatagagtagcaggggtagtgtgccctttatttggtgcatgtcttctgcaggttcccaagttctgctgttctctgttgttgcctcatcactgaggccaaatgtcagttgctgcttacatgcatttgaacagttgttattttttatagtgaaattaaaggtaaactgttttgatatccatgtttctaccaaaggtaagaaaacacaagccaaaaagacacagatttcaaaaaaaataagagaaagcataattctttatggaagtgaagaatagtctttttatctaagtatgccaaaaaaagcatgtataaaaaaatacaatttaagatgccattatgaaaaaactccaagtcagtgtttactaacatcttttcagttttaggaaggaggcaggttgtcttgcatctcattggatctccggtactacctatttcttgaaataccataagtgctaatatatacttgcaatagataaacatgaggagtattacaaatacaagagatagcaggaactattttaatattaagagatatcaaatatgcacgctaggattaataaatgaaataattattttccttcttctacaatatttacttaatctggaggcagaaatacatgttgtctctcttcctgcttctccatcaaaatcccgaccaagtaatcaggatctttgagaatcacaataagaattacagcctcatgtttggattttttaaatttaaattttaaattactcctttccactgatatttattgagaaactgctatgctccaggtactgcgataaacactgggcaaatgttggagagctaaaaaggcatattcctcttataaagacattatttacttgtaacaaacaagtaaataaatgtattagtcaatatgtaagtaaacaaaaaaatggacaagcacaaattatattaagtactatgtaggaaaccaatagagtactgtaacagaataataaggtatatgggatgggggtgggaatctgttcagagatgatctacctgagaaggtaacatgtaggcagagatctgaatcgtgaggagtcagcctttcagagtaagtggagtaggcacttccaagagaaaagcatattcctggctatttgcctatcaatgtcatcttgaacaagggttagcaatctcctacctgtaccacagatgctatgtgccacctccatgctacctttgccaccaagagattcaatgtgatgcatgatttgaaggttcctcatcctgataccctgtggaaagtaaaatcagtgacaaataaaagcagatcattatctcaggtagagtctgctaaagatgatacttgcttgtcagtacatgagtatccaccctagtaaaaaaccacagaagaagtgggatttatcttcaatgttctctcacttccccttccaagtgcctctcctgccttctgatgctctttcccacaagttgcaggcaaataaagcatgtatattactctctttttatccagagttgctccttgtccttatatgaagtagattccagacctcacaattgtatatgcctacccttctactccaacccctcaaaaaaagaggaagaatgaaagaatgaacaagagaaaaggaaggaagagagggagagaggaaaggagggaaggatggtcctgaagatcacagttcggtgctgaaaaaagcatttctattaaacttcaagacagaatgaatgaccatagctaataatgtaccttaagcttttctagaatctttgtattaaaaaagttgattgttactaaatgtattttaatctcataaaattttaggaatttaaatgaagaatttcacaaagggtaagaaaaattatatattatatttataaatttgtcattatgattctcccattgtggaaaaaaaaacaaaatctcggtaccccaattcacaaagccaaaaggaagaaagtaagctgaacgctgagtcatgcaagaaactgctcgcttttgttcctaagctaatagctacagataaaaggtcagatatctccataggtaggtactctatgttcaccttatgtaaagtgccaatttattgagcgtaagaggattacctaattgactattccccagcctgctccttttctcttgcaacacatggagtcagcaatgggaccatatcctctctctttcccctccagcctgctttccccctttaaatactgaagccctcaaaatcatctttctaaaaaggtatgaaccatagattgttcctgtggatttgtgtttctttcttccgggcatatccttaagcttggcaaaataaaattctaaattgat

SEQ ID NO: 1060 - DNA, 268 bp, Homo sapiens
caattctgtattcactttttgagtgcataagggtaatagaaaatgacatgggaagcgttaattagaaaaaaaggcattttgtttatgtgcatttgaggatacagtgtttgaagtttctaaataattgttttatgacattttcttggtacatagatattgctaacaattagtttgctgaagtatgtagaaacattttaagaaatgattttagaaatataattgttaaagtacctctgatgtatattaaaaatccttttattttggttta

SEQ ID NO: 1061 - DNA, 3217 bp, Homo sapiens
attctctaggcgaaggagaacaataagaggcaggtaaagctggagcccgtaacaggaggaaacgtgagcattgaaaacccgccctttggatgaactgaccacagctggacaacaccagtgccaggccagggttccaagcactgcagagatgaagcaccttcttccaggagttcctggagttctcagaagccagagtggacttgttcctccgttttatttgatgaggttctaaatatagctgggcaaggcttcggattttagtgggagatggccagaggcgaagcaactgataaaagtagctgaatagctctccctctctgagctaggtgcaagctcctgacgtaggaagcgatccctccttgccacagataacccacgtagccaggtgctgccaagcagcttccacctggaggagggcagctgctctgcgcatgaccagtagctgtggatggcatcgtcgaggcatctggaggaagctgcagccccacaaggcccctgacccctctgcctttccctctgctggctcctcttcctccctctttccctgctgtcccctgtagagaactttctaccagtccacacaccaacctaggtgcagcccccctgcgtgactccctccctgactatcataaccatggccagcagtatctccacatctctgcccagatccccctgggaaggcttatcccaggccccaggtttggggcaatgcccagtggcatcggatggggtcccccttgaaaggaagcacagaaagactgagccatcaacgtagtcccctccatcacctgccactgtccccaaaatctcccacaccggaagtgtttagattgtctaaggacaatattgtctagggtttgaggaccaccccacagcaaaaacactagaaagctagttccaaaatgcaaatcccaggccaagcccctcacctcctgaggcagcatccctgggtatagatctcagaaatctgcagttttaatacaaaggccccctaaacttaaagaaacagcctgaattcacatgggcacaccttacctgagcaggcaatacagtgacaagggtggaaacagaggggacgagacctgacactgggaaggcctgacagagggaaggaaggaaagctctcaggctaagggcgctgggaaccccactcttccctctagggagttgccgttccctgaggggcctgaggagcctcctcctgaagccccagctattcaaattacaccttttcttattaggacatcaggaggtgttgccccttagctttccattctaacctcctcaatgtaggggccttgctggtgtcgaggacagagcggaggcctcaagggtatgtgcagtctaggtggccttggtggaggggcaggattctacatttgggaggggacttcttgctgaactccttccagatgggtcaaatggggtagactgagggagtggtgtgggaggtggtaaagaaccaagtagggactggatggatcctgggagtttacagggctgcctcggagagggagggtgctgagagagaggagaccagggtgggcaccaacgcgatccctgcaggctatgagtgtaggatcagagagggttaagggccagaagcccctgtgtgtttaggactgtggcaccatgggtgcatcccctgagaagcgaagctcaggcaggagcagcagtgggcaaagagcctggtggtgcaggtgcaggccctgtagaggaggcagtgacaacacccagcccaggccgactctctctgcctgtcccctgagtcccctggcacctctccacatctgctcagccctcccagttaacctagcactggtagatggttgatatgatttggatctgtgtccccaaatctcatgttgaattctaatccccagtgttggaggtggggcctggtgggaggtgattggatcatgggggtgaatccttcatgaatggcttagctttatccccttaatgctgttcttgtggtagtgagggaattcttgcaatatctggttgtttaaaagtgtgtagcacttcccccccaacactcttttgttcctgttccaactgtgtgaagtgctcactccccctttgccttctgctatgactgttaagtttcctgaggccttcccagaagctgagcaggtgtcagcatcatgctttctgtatagcctgaggaaccataagccaattaaacctcttttctttaaaaattacccagtctgagatatttcttttcttttctttgagacagggtctggctctgtcacccaggctggagcgtagctgcacctctgcctccagggctcaagtgatcctcccacctcagcctcacaagtcactgggaccacagcacgtgccaccacacccagctaatgtttgctttctttgtagagacagggtttcaccatgttgcacaggctggtctcaaactcctgagctcatgcgattctcctgtcttggcctcccaaagtgatgggattacaggtttgagccactgcactcatcctaggtatttctctatagcaatgcaagaaaaactaatacgaaggtgaatccatctgcagatccagactccacaggaagccagcaagtgtgattgcgggctctgctgcatttcaggggcggttctatacttggcacgtgcatgctttccccagcctagcatattagcctgctggggctactataacaaaataccacaaactgagtggcttaatacaactgaaatgcattctctcacacttctagtggccaaagtccaagatcaaagttttggcagggttggctccttctggacactcagagggagagtctgtcctgtgtctctcccctggcttctcctggttgctggcaacccttggcattttttgcttataaatgcatccctcttatctcagcctgtactgtcacgtgaccttcttccctgtgcatctgtctcttgtcctcttcttctaaggacagcagtcatattggattaagggcccagccactccagcatgacctcctcttaacttgatggcattcaaagccatcaggtttggaaacaaggtcacattaccagggaccggaggctaggacttgaagataccctttgggaggagacacctgcaacgtttggattggagaagactcagtgaccttctgggatgtcgtttaccctccctgggctgcagcttccttgtttgtagaggaagaggttaaattaaacaatctcttccaggtc

SEQ ID NO: 1062 - DNA, 6103 bp, Homo sapiens
ggccatgtgaggacacagagaaagcaccatctgtgagaaacagggcctccactatatactgaacttgccaccaccttgacctgggacttcccagtttccagaactgtgagaaataaattttttatgatttacccagtctaagatattttgtgacagcagcaggaatggactaacatactgggtctagcaaagagttctcaagagatggggcctggatgtgttgcttaggctgtgtgaaacacctggtcttaagcgatcctctcaccctggcctcccaaagcattgggattacagggagaaaagaatgggaactgtgaggaaaagaatgacatgaacaatgggaagaccaaggtcccagcacaagtagtagatgctgaggaaagaagaagtatgttgtggagtaagtgagtgggcctgagttgagaagatcctggccttggattttaaaactgtcaggaattgcataaattcgctagaatcagaagtcagttgtcctgatctcagaacaatttggtgtgtacaaagtccaaggtttgaaaactcatcaagaagtcagcatcctgcaagaatcagccacccatgccacactttctatagtaacttctgttctgcatcagactacatcactctggctttctgagggcactattccaggccagtgctctgggaggaattacccagaatccctgtagaagccactactgatgtcagctacaagaggaagggaacccaagtggacttcagccagaacaaagctctgtcacatgttggaattttactgaacttgaacaaattattcttcagaaaaagtattttaaagtcaaaagactcctagatgatttctaggtcttttgcagcattaacttcctttgaatcaatgccttcaatgattatttaaaagaaaagaaagaaaaaatcagaaagtaaagaaatggatttagctagtaacctttaaagaaagccctctttcattcatttttcttcaaagatttatgtgatttttttcttatcttgatgtataataataagaattagctgcaaaaagctacaagaaaggttgcataagtgcatacattcttttcgagttctgcttcctgtggtagttcttcacttttaatgatgagttgctgaagcaggcactcattcttttattgcatcatttattcttgttatctggggaagtaacaatgacaagctttcctaagtaacagcccaactcttatttgtggccccttttcctatgtcaatattaggatcattctatcaacgaagaggtcctattacctaggaaaccatgaaaggtaagacctatgatcacaggtgcttacatgcatgcaaatgtaaaaggaatacttaaaccctcacctaacttctttggaagtttcagtacacagtttttgttgataggcaattaaggtgcgtgtgtgagtgtagtatgtgtttttgtaagaaaaaaagtagaggaaatgggagataatttagtgtgctggaaagttatagaatttgatatcttgttttgcatagatgatgcattgtaggagtgacattattgtgaaactttgttcagtcggttttccttcaagcgattttggtgcagtttttccaatccagtgttaagggcatgacgatgtatttttcacaagcttgtctaagaggaaactctgacagattatgatgaggaaaactaaatccactcatgtcatgtaaacacatagaagacttctcagtggggtctctgccttgtacctcagatgccaagggggagtttgagatttgtcaagttgttgacaactgccttagtccattttgtgctgccataacagaatgacacggatgtggtaatttataatgaacagaaatttacttcttgaggctgggaaatccaaggttgaggtgccagcatctggcaagggctttcttattgtgtcatcatatggtggaaggcagaatgtcaagagagaaggaggaaaccaattttacccttttataaaggcacccattccacatgtaagggtgaagccctcatggcctgccaccttttaaagactccacctcttgatactgtcacaatagcaactgcatttcagcatgagttctggaagggacagtttccaaaccagaggagcaattgcctatcagaggttgcaagaaagaggtattttactattatttgagctaccatttttagctttatccatacttttagaaataggtgttttattgaactccaattatccagtttgagaatgtcataattttttattaggagtctggctgatctagtcattaaaaaagacacataataaatgtataagcatgtttttaaatggacagtttataagttagttaataatattagtgttaattactgttaccactaaataaataaaccactacattttatgttctttcaacaatctgaaaaaaatattttgtaaaaaattactgtaatgcaaaatttggcttagttagcaacagagagggtaaatatctgctttaaagatcacaatgtctgatggctatgaaacagatgagaagttttgagaagatgacatcaatatggtgttgattggtttcatgtggctttgagcttttctgccactgggaagatcactactgtacatagtttacatatgattcatgtgtgatgccagattgcagcttccttcttgctgtatcttaagtgtacttggtattctgattcaagagtgagatcttgaagctttggcaaatagaattgcctaattttcatttgtccactaagcaatgcatgcagttaaaaaaatgaaaacaataccaaacctccttcttttgcagtgaaggagcccaaaacaagttactctctttccgtctctctctttaacttagaatattggttattttgtattctcacacatgtaaaattcctttcctttaatgcatatgttctcaataaaaaagaattttccactgaatttccaggaagactcaacataatttaaagatggcaccttacaaaaagaactctcaatagacaagaagaggaggcagtaataaacaattattttcaagacagagttacctaaaatctttccttggtttcttaccggctacaggacacttttcaaactctttggtttcactttgacaaacttgcttcttgcaattctcctaaggttgtgtgtatacaaccacgtgggatgtggtgaatttagtcggccacaatgtaatagtctcttctctatacataaaattagattactaaaatccctatgtaagaaacttacaatcccgccagggaaaattaggattggggaaatgagataattagttaatctctcaaaaatctgatgaacatagtttatgttttctaaaatagagccatgaaaacagcccaccaaataatgagaatgtcaatatctcacacgttccttcatttggtaattaatagcatggaatggatatatattaatttatcattctttgatctccagtgacttttcagtatctctgttctcctttttccatatattaaatacagaacttatacatttgttttgtttgatggtgttaatctacagtgcagaagagtccctgtgtttgtccactgtctaattttcaaagcctctctgattttatgattttaatttaccttttatcagtgtggtttcaccgcatttctgcagacattcatgtggatgcctgagctgaaaaactaacctcacgtagtctttatttctcaacttgcattccccagtgcagggcccagtggtgccaattctgaacatagtaaatttacaagaaagcccttcctcacctataacttcagggatgttttcacccataaaccaaaacactcaattgcaaggtttggggataatcttctcccagctctctttctctctcctacagtttcattgcattgcctcatctctcttttatcttttcccttatgagttatttcagcttccttttcttaacttctagtttcctatttctctaataatctaagtcagggagaagtgtaaattcatgtgcatggaaactaaaatttccccgaggatataatgtacagagtaaatccatcttcactagaattttagaacttgagatcgggcatgtgtgattattctacacatttttaatgggtctctgtgctttcacatgtgattttgcctcttccaaaaacagtctttgtgttcttcaccatctgggaaatgtgttttcatccatgtaaacccaaatcaaatgccatttcctttatggaaaattatccagcttcatcaggcagaataattagctcctctgtaggcaaatagctccttggtctatttttgccaaagcaagaaaatcttattttccatacctactatgtgcttggcattgtatcagtacacatttctattagtgcattctagcactacatattttcaggcctatcttatgtgattggctttgagcatttccagagcaagtatatttttgcttcttatacctacctcaggatttaacatagtggtgtctggcataactagacatggtaagaataaatgtttgttgaatgaatgatgtgtgaatatttgaatgagcatattatatgagttggtaagactattcagttgctggatgtcaaaactaattaactgaatgtatttttatctttggctttttattagcttggttgcaaattctgtgacaacagaatctgtgtctttcattctcatctttacacccccagttccaggtacctggtgcccaacaggcattactggatatctgtagaacttatgattaaagaataaaaggataacagtgtgggatgaaaataattcaatctttgacctttttttttgagtagagacaagcacattaaatttgatttttgtttagccctaagcagcatcgtagttctgtatcacttttataagcagctagacatggaaaaggtaaaagtaaggacagaggatggaggcataacctattcagagtcaatcatatgacttttgtctgaaaaattcgtacataaaaaaatgaatggtttgaaacaaaagcgaactattggatggaagtaatttgcacatttaaaacctgtctcgcaaccaagtgcatcagttgattctctggcaaactattgctttgccttttcttatccaatatttgtttgtttttgaaggaaaaaaggtatgtgactgagaggtaaaatatatgtattttttcaccatgaatacttgtctttatgcattttgttaaaattgtagtaattgataatatgtaagcctgtttcgtaatggtgatttttttggtatgatatctacagatacaaatagtgcatgtgttaaggaaactcatgcacaaacaaaacagcacatgctgtactcacagccagttacacagaatgctcatgcatgcatctgttgcttattaattttcttcctgctgtttgtatcattcttttgaagaatctccagcaagctttgtgctttgcccaattgtttataatgtctataaatcaggggcttggaccaaatgaaatgtcttagtagtgtttgcaaaatatttggatattctgattgcgttttattttcccagctttagaaaacatatagattagcctctgttgggaacttatattctcgttactccttgtctcttttcttttttcaggaattggtcactctttcagccaactcgtaggttcaaacaatgtttacatgtagtgctcagtttgttttaacttcctgctgtagacattgacagttttttcttcctaagagtcttatgaataggcaacaaaacaaaaacaaaaacaggcaaagtcccaatctattaactacgtacttacaaatcaggtgaaagtgcttggtgaacagtctatgttttagcaactgttttttaacgtttggttgtgacattttttaacaacagccattgttcaattgttaaactatgtttggatttgaggtctgaatgagctgaattcaaaatatgggactttttattagaaaccctggtaaagtggacactggggaaaaagcccaagatttcatgtgtttgatttattgactatgtgcgtcaacagcctgcttttaattctcagagtaaaataaaaatactcagaatctaa

SEQ ID NO: 1063 - DNA, 1060 bp, Homo sapiens
tttcgaggtaggagtcgactcctgtgaggtatggtgctgggtgcagatgcagtgtggctctggatagcaccttatggacagttgtgtccccaaggaaggatgagaatagctactgaagtaagttgaaaattccctctcaaaaaggtttaaagccattggatgtgccacaatgatgacagtttatttgctactcttgagtgctagaatgatgaggatcttaaccaccattatcttaactgaggcacccaaaatggtgagttggggaacatagagagtacacctaagttcacatgaagttgtttcttcccaggtcctaaagagcaagcctaactcaagccattggcacacaggtgagacacctctattttgtacttctcacttttaagggattagaaaatagccaaagcaatgatgattatctatgttagtgcttctctcccctcttttcaaatgagaattttgctctcatattgatactaagtttaatactgaagaaaatgtgaaaacagatactatgatggttgcatagttcagcagatttaatcatgaagagatgtactatctgtctgatgtatctggggtagttgtggtttgctgttaatggttaagcagtgtaccaccaatctaccattaaaatattttttgctgacaattttgtattaaaattacaggcattagacagaaagctggaagttgaaatggtaagtgaaactgtatccaagtaagcaggtaactgggcaaacttcctacggcacaaatggctttttagttacctcctagtgctgaatgcattaaataaatggcggattcttgtcttgttatgattaataagaaagtttgtaaatgcagcctggatgatgataagcaaatgctgactgaacatgaaggtcttaattagctctaactgactaaaggcatttgttagttttggcagggggtgaacactcatctgtggctattctaagaccactcttatttcttaggtggagtccaacttgcctggaccagcttaatggttctggtaagtattaatgaaaacagtagatagacttaatgaaaa

SEQ ID NO: 1064 - DNA, 235 bp, Homo sapiens
catccgggtcctggcgcggtgctctcccggcagcgacgggcgcgagggccggggcattcccacggccgcgacggccctctccgcgagcgcgaggatgtacatgaagcatggcaccaacagctgctcctgtgaggcctcaagaagcttacaatcgtggcagaagctgaagggggagccagcgtgtggcatggcaagggaaggagcaagagagagagggaggagctgccaggctctt

SEQ ID NO: 1065 - DNA, 3897 bp, Homo sapiens
gttcctaagtactccactggcttaccaagtataggattaccctttgattactttatctggctaccaggacagagagattcttgggagccaaccagccatcaggtcaactattttgctacagatactgctttctgggtttagtcccctgtactttcaggtcttcagcctcagtttgacttcctggcttcttcagtgaggattttagagttatgtcagaacagtggttggtaggatggcggagacatggacttcagagagttcttggtagaagactcaaagagccacctgtcatgagacatcccacttccttccccaggttacttccaagactgagcagccaggtttttggtagatgagaacaaatgtttcttcctgaagccctggggcttcaggtaggaagaaggactgctatacttgttctcacccttggcttctggctgctccagttaaacatggttcccattgatacagacattagagtgggaaaggacttcgttcatagaccgaagaccctcaaaggaaagtccttccattttgggaagggtgacattgatttcgtttagctgcttaagatatgtacttgctgttgtcttgtgagacatgacatctgaagctgaagaggagtccctctcattgttgtcattgtcccaccgggactgaaagtctcccagttgaggcagcattttagctttgatgtctacagggcaatcatggatcaggaaatttctgcaaattagacttggaaaacaaggtcttgatccttcttgtctttggacgaagactaatcatcacttttgactgaaggtgtagtgctggagactatgttggaggcagcacctgatgcactatccatattcttccccttgatcttgtcttaaagttttccaaatggattccgaggcttgtctttgatgaaaaggtcaaacatactggcagtcatgttgtttctcataagctggatgtcaacctcaatttctcctctttatccttctctcctggtttggatttcaaggtataccaccgcatcttcctgctcccctagtctgggtgcaggtcctgcaggtacacctcggcgaagcccaagtacagtagcagcagcacctcaaaggtggcctcctcctctgacactgaggtggcatacttctccttacccacctgaatcaccgagtacatgttgcttgtaccgtcaggctcttggttcttggcccctggccctatgcctgcaacactgtcacctgcacgtggattgggaaccacatagcccccggacctgctaaggccattaaggacaggatggtgatgcctcggctgactgacgtgagaagattgtcatgacccatggcctctactgctgtcctaccaacagaaacttcataatgttgtgcaggcgttaccactacctagttccagaacattgccatcacccccaaaataaatcttgcattcattaagcagtcacccctattttcccccatccctgtcaaccactgatttatgttctgtctctatggattcccctgttccggataattcacgtaaatggaataacacaatagatgccttttatcatgggtttctttcacttaggatgttttgtagggtaatccatatagcatgtatcaggacttcattttttttttttttttttttgagatggagtttcattcttcttgcccaggctggagtgcagtggtgcagtctcagctcacttcaacctctgccttctaggttcaagcgattctcctgtcttggcttcccaagtagccaggattacaggcgcctggcaccatgcccagctactttttttgtatttttagtagagacagggtttcaccatgttggccaggctggtctcaaactcctgacctcaggtgatccgcctgcctcagcctcccaacgtgctgggattacaggcgtgagccaccatggtcagccttcattcattttcatggagaaaaatatttcattgtatgagtataccacattttgtttatccatttatccattgattggttgtttctacttttttttagctattatgaataatattgctgtgaacatttgtgtacaaggttttagtggacacaagtttttatttttcttgggtatatatctaggagtggaattgctgggtcatattgtaattctgttcaactttttgaagaacttcccaactgttctccatggtggctgtgccattgtatattcctaccagcagtgtatgaagttacaaatttctccacatcctgagaacccctttattattttctgtttttctttttgattatagccatcctagtaggtgtaaagtggtatctcattgtgattttattttgcatttccctaaatgattaatgatattgagcatcttttcatgtgcttcttggccactagtatatcttctttgaagaaatgtctattcaagtctttggcagtttctaaatgagttattgtctttttgttgttaggttgtaagagttataatctggataacagatccttattagatatgtaatttgcacatattttctcccattttgtgggttgtcttttgtcttttttattttttattgcttgtgttttggtatcattattgataattcattgttaaattaaaggtcatgaagagttactcttactttttcttctataatttttagttttagctcttgtattcatgtctgtaatcaattgaagttaatttttaatatagtatgtgttaggagtccagcttcattgttttgcatgtatctatgcaattgacccaaagtgatttgttgaaaaatattattttctgatggtatggtcctgacacccttgtagaaattcaattgaagatatatgtatgagtttacttctgcagtctcaattctattctattggtctaaatgtttatctttatgccagtaccagcctgttttggttattttagttttgtaataaaatagacaaacatttggccgattaatcaagacaaaaagaaaagtatatagaaataatattatgaaagaaaagggggagcatattgaaaaacaccataaagattaaaaagattaagggacagtgttaacaatttatgccaatagggtttgaaagtttagagaaaatagacaaattcctagcaaaatataaattatcaaaacctactcaagaaaaaatagaaatcttatatagtcacaaggtattaaatattcaattcttcctagagacccaaatatatgctttctacccgtaactcactgtaaataaaaagaaagggataatatattgtgcaaactctagtcaaaaaaaagttggaatgacaatattaatataaacaaaagtggacttcaaaagaagcaatattatcagagagaaagagggcactgcttggtgaattgccccctgataaagacataacaataccggaagtaaaaattgacataactgcaaggggaaattgacaaatccacaattatatttgggatttaaatgctttactcttaataattaataaaagttagctaaaaaattaattttagctaaataaattagctaaaaagttaacaaggatagatctgaacaacactaggataaacttgtcctaatggacatttatagaccactataaccaaaagtggtagaattcacaatttttgcaagtacacatggaatattcaccaaaataaaccatatcctgatttataaaataaactaacaaactggcttctctcacttagcaatatgaatttaaatttcccccatatctcttcatggctttatacctcatttccttttattgctgaataatgtttcattttatggatgggccataaaatgtttatctatgcacctatagagggacatcttggttgcttccaagttttggccaatattaataaagctgttataaacatt

SEQ ID NO: 1066 - DNA, 2082 bp, Homo sapiens
atgggttgggcattaggaacggcctggccccacaaatcacacaactggggtgtagaacaaaatggttccacagatgacaccaggctggtccagggccgatgcaggccagaaccccgctgggaggactccccagaacaggcactgagctgaggaaaggcaggacacgtggtctgctaccgaccccaccagatcttgctgggactctgggcagctccggagtaagagcagcatgctctgcaacgaagagctaggtccaaggaccgcaggcggaggcaggaagtgtcaagatcccaggttacggaatggcaccaagtcggtaaccaaaggaagcaacaacccgggtgttcaaggcagtcgtgcaaggcggcgcgggggcgaggccgaggccactccctcccacttccttgacgctatttcctgggaggagccggagctcgcggcccggagccaagagattcccagcccagtgctccaaaatactcggcctgggggaggctggtccgtgagcgtgcgcccggaccgttccgccatgcatagtggacccagcactacagcaagcctggcacgacctctaaggcggttcgcggcaacgtccgcacgtcggctcgttggtctaggggtatgattctcgcttcgggtgcgagaggtcccgggttcaaatcccggacgagccctcctttaccttttactgagacaagagtgtcttcaaggaataggttacctgaccagcgctgcaggaggcttgactgtaagtcatcaatgtacagtaagctcttttgtggcaccgcggtagcagaaagcatctcaatccccagacccgcctggcatgtcaggaagagacgaggcacgcccagacttgggcaggtccctccctttctgcttcctgacttccttcctggtgtctcaactcggccaccacagcctggtttcgctttgattgacacgcgtcaatctatagttgtggatgacagtgttcgggagagcccaggaactgtcaaaacttggttctctgcagtcctgaaggcactctgtctctttcggtcactccatctgacgattggtgcctgaaatacacctacggtttctggtcagcgtttatcagtggttggaagaacagaacccctaggaaccctgctgtcagcacgcagagtgtaaagtctcagatcaaggattcggagaaaggtctctacaggtccctcctcgttagtatagtggttggttgggatgagtcgggttggacccgtgcggatccaggaaaacagcgatcgaggtaaaagtaatggctgccgtcgtctgcccagcgcgcaattgtgagtgaccttcaccgctagcgcgcgccacccaccccacatgaacctgtagggttatgcccagtctacagacgaggaaaccaagatccagggaagctgagtcaccggcagagctgggattacgtctaagatttgtccagggggcgagaactgcagcgacaccatgatttatcatctccagaaaacaaaaaaaaaggcctagacacataaaaatggcttctctgtagagtgagctcaacgagctcaatgtgattccagttaaggaattgggccttaagccaaatgcgcctaaacgcaacttgcctctctattatttatccagaggatgaatttaattcctacgtacatgcgcccacatctcgtcagctggtgcctcagagaaatgcgctgacaaatcttaaaggtggggcttcatgacaaaagtccgcccgttattgctgctcaacagacccatcaagtcacgctgttggacaggcctcgtggcgcaacggtagcgcgtctgactccagatcagaaggttgcgtgttcaaatcacgtcggggtcaaacaaaacattgttttccctaatcaaatagacctacggtgacatttttcaggataggaaaaaaaaaaagcctcctcagtagaaggataggaggggaatgagacaaatatgaacgttattcagaagttgggtgcagactttcaacattatgtgatatatccctgtggcaaaactgcgcatgtatccctaaggtctataaaagtaaaaataaatttaaaaataaaaaaa

SEQ ID NO: 1067 - DNA, 674 bp, Homo sapiens
aaatctgagacagccttggtctgagggagcaaagacagagaattcacgtgctgcccaggcatagccacatagcaggtggacatccctggacacttttctgagattttatgtcatagaccctcattggattttcctggaagtacggagagttacatccagagaactctgaacattttggaaggaccccaatcctgcaaacaatgaatggcaataaatcctgggactggaaaggggcttctcaaccccaaggcaaccataaagtcctatacaaagaaagatacagcagtgtgaaagaggcctggatgaaaaaacaaagacagagccagtgagccagagccagagccagaggacaagagagaaaggcagagaatggaaaacacagacagagaaggcagatgcgtagagagacagagattcaatgagaaaataaggaaggaagaaagaaagaaaacaaaaacgttctcagcactacaacttctgccttgttctgttccagaacagtatgagctcagtactttttcagactctcaattttctacaactaataatttgctctttcagttagtggcaaaggcttaacgacaaaggttcatctttaatattagagaggcacttttaaaatttatgatgctaagccttttgttctggatatggtatgttgcacaggtctaggg

SEQ ID NO: 1068 - DNA, 439 bp, Homo sapiens
ctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtctt

SEQ ID NO: 1069 - DNA, 4592 bp, Homo sapiens
gaatggagaagttgggtaacctgccccaggtgaagcccaaattggatctcagcgcctgggagctccaactttagcaagtgcgaaatcctgtcttcggttttggaattttcatccgcacagactatatcagccacggataggatatgtgagaataccagcatgtcaaggctgggaatcatccttaggcatcacctagccagtcctgcctctcattttaaggtgatcacaggatctggtttgccactgaaaggaatcttgatgctgaccacttcacctcggagagcatgaactgctcccatgccttcaagagttttaggatggcatcaactgttccaaaaacattgctgagctggactttgtatttcccagcatgagtcttacgttggacattcttcatgacaagatgagtatagtgctcagtgttttcaatagtaatgttttctgagttttgcaaaagtttctgaccatggaaccaagtcatggcaggtactggacgaccaatgtacataacatgaagccgaagtgtggaacccacagctccataatatttctctttcagtgggtaaccaggatggaactgcggtgttgcttgcaggagaagcttactactggtttctacttctccaacctcattggtggctatgcaggcactgtctccagactgtctatattcaacccagtatccaagaatttctttaccaccatcacattcaggtttctcccactgtagagtgacactatctttggatattgaaagaatctcaagttctcctggttggcttggtttatctgaaatattttaaaataatgaaaagggagtcagctttactggtgaaataaaaggaccaaacatggcttgcttctttaatttaaccccttcttctgaattccttaccaaatggatctttgcaaacaactggttcagaagcagggctggtctcactcaggccaacatcattctgtgcgatgatgcggaactgatactcagcatcgggaacaagccctgtgacagtgtacattgtggtggtgatctgagtcttgttgtgtctgacccacttgtcagtggatgtctctttgcgttcgatgtagtagcctgtgactctagaaccaccatcatctttgggccgggaccaggacaagctaacagaactcttggttacatcgagtacttctggaggattgcttggaggttctggaggatctgtaaatataagtggaaagcacacatgtattagaatacagtcccaagtattataagccaatgactttcatttaaaaacagaaaagtgctgaaataatgtttataattttgtggttgaaagggcacttactcaatggtgtttttggtgtgactggttcctcagatttcaagggtttgcttatgccaaactggttttctgctgaaacacggaaatggtattctacattctctttgaggccttttaccaccagagatgtacctcggactctggaatcaatggtataccaggcggctttaggcacttctcgtctctcgaggatgtagcctaagatgtcagcaccaccatcatcagcaggaggtctccagctgaccctcacagagcggacttggatgtcatcatattccagtggcccttctggactgttgggacttcctatcaccctgaccttgatgtagacagccttcttgccacatttattttccagaaccaggtcataagtgccagaatcacccctgtctgcttctttgatcacaagctcagtgtgtgtttcagatgttgcaatcatggcacgcttactaatatcctggccttccttggtccatttacatattgggaatggttttcctttgattggtatgcaggctcaccaggtccaccagcattacaagctaggacgcggaacctgtattctgcaccctgagaatcagaggtggggagagtggtggaagggcctgtggacttacggatgctgctgcgacactctatgacctcagactgcaagtaagagccaatcccgaagcggtttgttgcagccacacggaacacatactcatttccttcgatgctggaggacccggtttatctgaaggaataaggaagaagagtgaatatgtggaatggggaatgagtatagagtagaggtctggagacctgggctgcagtctttctattgtcaatttcctatatgacctaggagcagtaatggtatagtctcctgagtccttccggttcacgctgaatagctccaaggtgcacagattccgctgcatggccatctttatgccttctgctggttttagcagtgtgccatcttttttccaagaaactgttggcatcggtttaccaaaaacagtagcatccaagcagacattagttccagctttcacagtgtatatttagttttttattaggaaaaatgaccatcatgaatgctgttacatctttgcctataatactcagcagaatcttaccattttctgcgaggatagtcactggatcagaaggttcagaaggtgggctaatgtttaccgcggtcctggcaatagctctaaattgatactgagctttctcttctaggccagtagctgtgtactcttcctggggaatctggtgaggtgcagtattgcaccgtacccatttatcaccaggaagtttgcaagcttctacgaaatagccaataattttactgcctccatcatgctttggacgagcccagatcagagatacagtactcttggtgacatcaataacctcaggtttcccaggaggatctaaaacaaaaagaggaacacctggagatgaagacaaggaagatgtcagtttctacattaagtaacaaactagaaagaaaacaactttttttctccttcacaaaaacataccaaatgggaactgcgcaaccatctttggagatgtgagaggctctgaaatgccaaatcggttttcagcacggacccggaagatgtactcctggcctgggatcagctttccaaccctgcaggaagtttttgtgactgaagctagagccgtgacccagtcacctcggcttacatcacacttctccactatataattggtgatgttactgcctccgtcctccagagggatgtgccatgacagggagcaagcatcagcgtctatatcagaaatgtcaaatggaggctgaggggggccgggggcatctacatgaaccaagaggaaagaaatgtggctgccatgagatagtcatgtgttcaggagtaacatccagaatattaataggacctgttggtggcccaggaacatcaagaacagtaagatgtacggctactgttttgctaccggctgcattggaaactgtgatttgatattccccagtgtctctccttaagcagttcttaatgagaatagacgccttgatggctcctctggcagttcttgatgaccatggatgagctaatggctgtggtctcaatggtggcttcttgagttactttggatccaccatcttttagtgggggagaccactccagatctgcagatgatttagtccaatctgtcactttgggaaatggaggaccaggaggggctgcaaagagccagtatacattatttacagctgtgatggtatataagccagtgtcactcctgcgagactgcggaataactaaagtgcaagtatcatctaccaccagtttgttgacatgggtgtcatagagaacaggttctttgttatcaggcttctttggaggagctttaaaccagagaaataaaaacttgattgtgaagataaatgggtctcagcagttgctaagaaaatgactggttactttctgtcccttttgaggagcatgcagagaaattgctttagcctctgataaataaaacagactgcgaggaaaattacagcgaggaaattacagacatcatctcctttgaacagggaaaaggtaacagtgttggtgacttcctcccattctgctttcttcctacttgcatcacgtttgtcaataacataatgggtgatttcactgccaccattatcaagaggggcatcccatgtcaagtagcaagattcagctttaatgtcagtaacagcaagatttcttggtggggatgggcggtctggaaaggaatcaacagagaatattgagaaggcaattcttaaacagacactggatgcctttttgatgtaagaaagcaagtcacttaccatatacttcaacgtgaacatttcggaacactgagccaaggcgattggaagcagtaactgtgtaagtgcctttgtcctcccggaccgctttgggaatgctaagctcagtttttgcctcacttcgggatacctcttccttggttatctgaagtgcatcagtgggtttttcaattacagtttcatttttggaccattcaatcttaggcattggaaggcctgtcacatctgcagggatgtggacaggctctcctgccttaactttgatagtgtctcctcgaacactcagacgcaacttaatagttggaggcactgcaaagagaagagaaagaaaaacagtaacaaagtcataaggatgtttttttcaacttatgggataaaggcacactgtaaaatgcattaaaattattattatattcaga

SEQ ID NO: 1070 - DNA, 2138 bp, Homo sapiens
ctcctcctcactgcttgagctccagggcccagacgtgctgcggccagcccgtccggcctttggttttcttgtcgttgctgctcactgtgcttttcaagatttcgttctggacagaggaaaggcgagggcgagaaaagtggaaagagaaattcagagaggatacctggttccacaccaacccggagcttcctgcgccggaggagacagtgaaccagagaggaaaggatacgatgggggagtcccagcccctgcagagaagctaccaaggttagcgctaccctagccggcggggaggcctcggcgctgcagcgctcaacaaccggatccacaagtttataaacaaccgcccgttttcgagtcgtttatggaggagcggggggccttttctcttactccagatgtaggggcgggagctggagtcggcgctaagtctggtttctctgttttcattagcaatcctagatccacatctaggaaaaatagggcgaaggagcctctgtttcggcctgggcctctcggccagaggctctcggcctccagctcagcagtgcctctcctccaaggcttctgaaatctctggttattcgggaggtcactcgattatgcagccaccaaagggctgcaggggccaaagaagaaaaattcgacaaatgcaattattttccgggcccttcgtggacatagctctatcctgcaccactgccctgtgggcacttggtaggaatctgagaaaattttaagcggctcaatttactttcgtgttatttttaataacaatgaccatagtaatgccttttcccccttaaaatgtacaggcttattcaaataaaattagaaatgccaatggaatatactcatctgggaaattacattttaacgtcatagccaaggaaaaattggagctgtattttgaagtcaaaagtacttattttatgtttaccattacgttttccgggcatagtatgagaacaaccacaaaactcagggctcagtctctggcagcctccttctgggagtggggtagggggtgcgatcaatagtgaaataattggaatcaagggcttcttcgagacttattctggaaacatctgaaagcaagattggattggaggccaaaagaagggtctaacagagacggggtgaggcatccagaccagtgcgatcgcgatcgatcgcgacccagagttttcaaggtccgtcctaagtactaggggagcagcgataacccggagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaagatggggaaattgaggcagagaagccaagacatgtgctaaaggtcatgcaggctatgaatggagctggaatgtgaacgcaggccatatgaccccagagcccatgttcttgaacccttagaaagacagcagcaacacacctggtgcagcagctgcttagttggagtggctgacaaggttggcagaggatcccgttcctcccgtggagtggctgccatgatactgcctgcactgaagctgctcctatttctgaaatatgtattgttatttttttccctgcatgttgaacattatactcttctgttctttcgcattctcttcttcccttccggatgacttctagggtttttgtgattctgtaattctaaaggagaaaggataataagaattgtgaggccgggcgcggtggctcatgcctgtaatcacagcactttgggaggccaaggtgggcggatcactaggtgaggagatggagaccatcctggctaacacggtgaaaccccgtctctactaaaaatacaaaaaattagcggggtgtggtggcgggcgcctgtagtcccagcaactcgggaggctgaggcaggagaatggcgtgaacccgggaagcggagcttgcagtgagccgagattgcgccactgcactccagcctgggcgaagagggagactccatctt

SEQ ID NO: 1071 - DNA, 964 bp, Homo sapiens
ccagaaccagccgttgtcccctggcaaaaagaggcccagggctgagccctgggcaagtgtctcccgacatcgctacccctcctccctttattagtttccctttcccaacagaaaccatttccttctgccaccaaaactaggttgcatccaaaagtttttcacaagcttaaaaaagaaaaacgaaaaattgacaagtattacacagaagagcccacaaaagcttcagcaacaccaagggcgaagaagcagcgtcagatccaggtctgcaggacacaccaaagaactcctccaagtcacacaagggagaaaattaacttcattggcttctatcaggaaagctattttttttttcctcttctttcctgcaagtttcccaaaccccatgactctgatttccaggtcagagactaaggttttatttttcttactctgtatactttatatgtggagagtccctgaaggaacactgtgatgggctgattactgtgagccagttgtgggccagacctggcctcaggtgctgcaaagggaattcagtcacccctgtgcagtgatctgtgagccccaagtcagatccaactttttcctgatagacagcaccctcctcctccctaccaagaaatagcagggttggaggtagtgacccaatattcaagaggtttgaaattctacatgagatatttctgagttaactcctaaatagcagtttccttaatcatgtggaaaataagaacacttactaaagagaccattggtttaagagaaatggaaacttatgtccacgtaaaaacctgtaaatgaatgttcacagcagccttttcataatagccaaaaagggaaagcaatccacacgtccatcaaccaatgaatggataaacttaacgtgggatatacgtgtaatggaatgctatttggtgaagaaagaaatgaaatattaatacatgcgttaacaaggatggacctt

SEQ ID NO: 1072 - DNA, 525 bp, Homo sapiens
aagacctgggtgcctccctgggtgccaaccagcctaaccagccggggccaccaaacagaagtgcttctgacattaacgcgacacacagaaggtgtgtagggtgggtagtggaagtgaccgcagaggcctctggggattgtagttttggagctagagaggcaggcaagcagttgggttcgcccacacggtgtgcctctcacatctgcacagcgcacacaaccaagcttaggagccgactgttaagatgccccagtgacacggacaagtttctcctctgcaacccaatgagagctgctgaccacgagagcatcgcgggaccgccaaaggattctggaaaatgtggtcccgggtggccagtgtgcgctgaccttcacctgaaggtacggcttgaaggaaacttctggagggtggggtggtgttgaagagaaggcacaattgtcaccattttgttcaacatgggcgttttctttgtgcattgatttgcatttttaaaggtattccattaaaaatatgtttatctatttt

SEQ ID NO: 1073 - DNA, 277 bp, Homo sapiens
cttaggtggtggtagaggtgtgggcagaatatcaggaaatgcttccctcaggaattgatgtgcatgaggaatcctggagaataagaagcactgttatcagctgtgacagagcccttcctgcctcctgtctgccagcgtacttgggaccatgcctctgtgaaggacttcaatttctctttacaagaatcaacgtggagcaaactccagttgcctactgcctagcattcttgctaagatacgtatgtaaataaaatgtctttatatacctgagaattta

SEQ ID NO: 1074 - DNA, 1914 bp, Homo sapiens
attttagcgcatggtaatatttgatgcagttgtctctccttaagtattgtgattttcttcctttattaagagggttgtgggtcattccatgcttctcttaaggtatctttttactctgttttactgttatattttagaagatagttttaagaaacataaaaaccatgcttgttatcttaacgtagtagtagtgtacataatagtaaaaagggcaagccagccccctctgccctcgaaaaactgtattctccaactcccactacattttctcatattgaatctgttccacctgtgatttattgttttcctgaactttgggagttttaagcaatgatacagttgaagggactgtttataattttcacatgtttaagttgtgaggctttaaaacttaaatataaggctttgtctaggaagaaaatgatctttaccttcaataaatttataatgtagcactaatccagtatagattggagactgaatgcattcttactcttagggttcatacctctaattcatgtggttaagacagtgttgtggtgaagtaatagggccccttgaaagaatctacagaaacataaattatactgagttgtgctgtactggtttgtgagaacatcagtgtattaaggagaatggtagtttaatttgaatatttaaagaaagtaatttgaatggttctagtactagggccattattaactagtaacatagattagtgacttcaactgggtgtccttattatctgatttgtctgaagtgaaaactgttaaggtgctcttttaaaatgtatttggaaacaccatagttagggtaaatacaatgtcacaattcactcttgcatattatttgcttagccaaatttatgaattctaagttaggccaaattgaaggttttggagttttacattgtgggtgagtctaaattcatgcgtttggcaagcacaaggacatgggaaaagaatctggtattttgaggcaggcttgagtttataatgaaagcaaactcagttcctcttcatgtcctatgtatttaagagaggacagttttccctcagtttttttccccttccttacccctacccccatcaaatacagcccaaccaaataactgtgttcttaatttaaaggaaaatggcagacttgacacctgctgaatatttcgtgtagacagagtatgacaatgaatgagatccccagtcattgcccttgtaagcctgggaacccagtttagtgggagagactaatgtaaacagctttaatcaaaagtatatcaattggccgggtgctgtggctcacacctataatgccggcactttgggaggccaaggtgggtggatcacttgaggtcaggagtttgagaccaccctggccaacatggtgaaaccctctccctatttaaagaaaaaaaagtaaggcatatcaatttatggttatcaaataggtttttttttttttttttgagactgagtgtcgctctatagcccaggctggagtgtagtgctcactgcgacttccgcctcctgggttcaaatgattctcgtgcctcagtctcccgagtagctgggattgtaggcgcctgccaccacgcccagctaatttttgtatttgtagtagagatggggtttcatcatgttggcgaagctggtcttgaacacctgacctcaagtgatctgccttagcctcactgcttgcccctaagtggtgggattgcaggtgtgagccactgtgctggcctcaaatagtttttatcaaagctacttcaattagtggttagcaaggcttaaagactaattcagtgctttattttgacacttgttcgcaacatgttgctttttttcctgtgtcctatgggacctagtcatctgtatgttagattcacagaggaattaaagagataaacatgcatgtgct

SEQ ID NO: 1075 - DNA, 653 bp, Homo sapiens
cgccaagagcgcacagactttgaagcaggaaaagacagtctctagagcaacatggaaaggatccagtatttgttttcaggcaaaagcaagcctccaaaagccccttggttcttctctgtgtgtctcgccccttctgccttgtacaccagactgccggcaagcaagcggggaggtggcgaacagctgggatcctccagtgaaaagtttgctcagcgcgagagatgtcaagaggctgggattgtcgcctatcgggaggtggggagctctctcactcacacttcctgggaaatgaaggagaactaataggcagcccgcatttgcagccagccaacctgggtggtattccttgaagtgaagcgctcataaatcccttctggggccagagccggtttcacaagctgcaggatttgggtggcctgcctgctctttgggagcgggcttgggaagctgaagaaattgaatcaggacctcaggccctttacagactcccttctacacttggttgctgattaagaacattatgtggcatttaaaatggcacaattatcttccgttggccgttcctagctaaaagtagactcctatcagcccgtgactgacgacaagaaggctcttcgtccctgtttttgaaataaacatgggtataatctgaa

SEQ ID NO: 1076 - DNA, 641 bp, Homo sapiens
aacgctattgaagtacattctaaaatgatcccacctgcaatttggatttttggagaatcgggatcggtgtaaaattctacatgcatacacgtatttgcacaagaatatttatagcaacgtggtttttaataggaaactatctaaatgttcattacaagtgaattacataaagctcaatacatccatactacgaatcactgaagagctgctaaaatagatgaaatatatttataatggcatgaacaaccgacacaagacagttgcagagtaatgtgtatttgtgattacatttatgtttttaagttatacaaacgcgtatgtgcctacgtgtatgtaaattcataggaagacaaatcagaggacggtggttacctggggaaaagcatgtgttgtcctagggtatagctttgcaggagagcttggcagagcctgccaaacctgatcagcttttccacctctcagctactgctttcggctccccagcctcataaactctcagctgccacattacaaatcagcagatgtcttgaggtgaaatgtggtgccaaatgtcaagctcaactttttggatcatctctcctgaatttcagttcctcgaatcctcactgtcctgggtctccaatgccttcaaaaaggatttt

SEQ ID NO: 1077 - DNA, 723 bp, Homo sapiens
ctccacatcactcctcagggaggaaatgaacgcccaggcaggcagagctgtgggcatctacagcaggccctgtgctgctgtcacaacctcaccctggtcccctgaggcggatatcaccatcccatttcagagacaaggaaaatgaggcccaggtgcgtgaagaaactggcctatcaaggcagagctagcgggtagcatgctggacttctaagccttcctgagaaagtgaactgcttcctctgagatgggcataggcatggctgtgtgtgcatcttgtcctgaccattccacagtggctgttatcacactccatttacaagttggctcagaaaaccggaggtgaagctgaagcagcccagctggccctaagaagccctggacgctccctcccatcctcacatcgttgagtcaatgctattatttgaatgtctgtgtcccctccaaaattcatgttggaacttaatccttaaggagcagttttaagagatggggcctttaggtcatgagggctctgctctatgaatggattagtgtcttataaaagggcttgagggggccagttcccccctcttcagtcccatatgccatgtgaagacacagttcatggtgccatcttggaagcagagagcaacccttaacagacactgaacaagcccgtgccttgatcttggacttcacagcgtccagaacagtgagaaataaatttctgttgtttacaaatta

SEQ ID NO: 1078 - DNA, 802 bp, Homo sapiens
caccccgagctgtcaggcgttccgccgcggccgcgaggcccgccggccggcggggagctacgcccggacggccagcaggcccgcgggagtggggctgccgcggctgaggcgaggcgggccgcgcgcgtcggcgtcacagcccgcggcagaggcgcccagggcggccgggcccacgacgccgaaagcgccgctgcggttgccgcctcggaggctcccccgggccccggcggctggacccggcgcgggcgggaggctcgggcgggcggtccggcccgggactcgggtttgggcgaccaggaggtgccggtggccgcgctcggacccggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaag

SEQ ID NO: 1079 - DNA, 446 bp, Homo sapiens
cccctcaagaaatatggactccgtggcagatgaatgtagatgccggttctggaggctcttctgggtagaccagaagcacccacctcctccgctcacaccctagggcacagccaccttcccctctgccctttcccctcccccaggctctgctgcactccactttccccacacttccagggtgtttacactaggggttggaaaacttcttctgtgacagtccagagaggaaatattgtaaactctgcagatcccacaatcacggtgataactcctcaaccctgctgttggggtggaacagcagccacagcaagaaatgcttggccatggctgtgttccagtacaatgttatttatagacactgaaatttgaattgcatgttactttctcatgtcataaaatagtattcttcctttggttctttttcaaccattaaaatgtgaaaatca

SEQ ID NO: 1080 - DNA, 597 bp, Homo sapiens
tgaaattggataccaagcttaatggtttacctacagcatcataggaaaatggcaatgataaaatgggagagaatggattgattattgctgcttgagcccatacagaaatagggccttggagttgctggatgccattgattgctatctattcattctcacaacaactttaaggaaaatgcagccaagaggagatatactcccaggatgaagttgttctttgaagtttccttatctgcctaaagactggacctgccaaaaagaaaacaattactgctggtcccttccctgagttttcaataactgaactcacatgacaggaggaaacactgaagtcagtaaacactcctggatagacttgtcacaaaccactgtaggttctgtgggcccagcagattttgtcccaggcctttgtatgttcttcgagcccattgacttcccctaaaaatcatttactatgcccctaaaatcatccagacttcctcatctcccttttcccctaagaagggtgtataacctgtaccccattgcatagtggggtaatcactctgtgatcttccctcatgcacatcaataaatttatatgcttttttcttttaa

SEQ ID NO: 1081 - DNA, 454 bp, Homo sapiens
tctagaagtgaacatgttccaggtgatgtccctatgtaaaccaagggttggttttcagtgttctggaggctgggatgtccaaggtcaagatgctgacagattgattgtccctggaaagcctgcttcatagatgaccatcttctccgtgtgttctccctgtgttctcaggagtggggttacctttctggtgcctctttttcataaggacactattcccgttcctgagggctccattctcataacacaacatccagaaggtcctacattctaatatcatcatactgcagcttgggtcctcatatgagagatgtatggagaaaatacctaaatctatcttataacctggagcagagccaccacagcttcagatatgtaacaattatggtgtttactctcttgaataattttattttgcttattcagaaacctcagcaaataaaaatctttttggaaa

SEQ ID NO: 1082 - DNA, 594 bp, Homo sapiens
gatttgggggtctttggaagtggagaatgtgtttgccctggggaagagaggtgatgtctaggagacctcttcactcagggcaagctctatgacctgctttgactccagaatgtggtagaagtggcatcacataaattgcagagcctaggcttcaagagaccttgcaacttgcctctcactgacttgaagtgctcccatcagagcatcttgtaaggagcaggtggagcatgtggacaagccatccccaccagcccctgagacatgtgagagaggccagaacaggccatccggaccccactgtgctggtggatgagacagcagaaggaatatcaacctaccaacagaatcctgagaaatgctcactcttacttcaagctgctgcattttgatgttatgaaaccataaataacttatgaagtcatctttgctgacttaaagttttccataactttattataacatatcaaaattatgaaaaatgtgaaaagtagaaaactgatgaattttgcttcttcatatggtctttaagaatctcaaaggcactgaagttttttatcttttctgtcttagaataaaaaaccttgaatgaaaatc

SEQ ID NO: 1083 - DNA, 564 bp, Homo sapiens
cacgaaggctgaactatctactgcctgggcctttacggaaaatagtatgctgactccttctttatatgacttgcaaagcagagttaccacagtttggatcaagaaaggtgtgtcctcttagaagcttttggctgatagtgagagaaaaccctcgcgcactgaggaagtccactggctcacatggctggaagggcagcggcaaggtcctacccatcctttatgtcccagcttagagaacatcaactgtaaagaatctatctctggtcaacatgtctgaaagtgagcgttgtgatgaaggcagggcatcacgttagtgggaaggctcattctcccagtgttatcctgtctgggcactgagtgacgtggccttgccatattccattcaacctcctcaggccctaaccatcctttatgtcccagcccagagaacatcagctctaaagaatccatccctggtcaacacgtctgaaagtgagcattgcgatgaaagcagtgcatcgtgttagtggaaaggctcgttctcccagtgttatcctgtctgggcactgagtgacgtggccatct

SEQ ID NO: 1084 - DNA, 2613 bp, Homo sapiens
tcctgtgcaggacagcttctatccccgtcacttaacaatggagaggattcttccccagcttccttccagaggacacaaaagctcagagctccacagtctagagtctagaccaacaggcctccacactcacgtcccagagatttccctggtcccacctactcccagtggcaaccagacttctgcacataggagagatgtcatactcagagtccagcctcccacatccacaggaccacctcttcctcctctgagtcttgttaatagggccatcccctgccttagacctggcccagtggactctgatcttacagccaatatggggcagcaaagtgggacatctgtctacagggccagtagccccaggtcatctgcttgccaaaaggagggggaccagcccccggggggagcccagagctcggcagggctggggttagtaagaagagaaaacagggttagtaggggctgggttagtaagtcagagcacagcaccagcggacagggcacctcagcagacacacacaggagtcgctaagagaaaaggaagaacgcacgcaggtccgttagtttgttaagggatgatcggggtgcagttgaggcaccccaggggttagacgggttagtaatcgaacaaaagagctgcctacagaaaagaaagctgagacggaggaagaatgtggggaagtgacatggattcaaagccaagtgtcttgccccaggcagaaggatctgtgtgcagaacacccagagaggccagggcctaggcagcagacgtgttcaaccaggtttgaggggccttcctccatcctcatactttttttttttttaggtgtctgccatgtgctgagacccttatattgacgggaatcctcactgcaacctgtaaggtatcagaactcgcattctaccactgaggaaactgaggttgagagaagtgaggtgacttactcaaactcactcaacaggaagtggcagagttgagaaaaggccatgtgaggacatagtgagaaggtgccacctgcaagccaaggagagaggcctcaccagaaaccaagtcttaacaccttgatctggactttccagcctccagaactggcagaaaataaattcctgatgtttaagccatccagtctggcatggtgctgtggcagcccaagctgatgaatagtacacaccactccgcattctgggaaaaaggacatctggcttttaaacttgcctaagggaggccacaagctgctctcttgcaaacgctgggactgtctcctctggagggagctggaattgcagattgtggggcctgtcctgccaccttctgttccccaagaacagaatccaggagcagtgcaactagaagcagcgatctgattggagaagagtgtcctgagactgggctaaggtgaccccttaagcctttgggatggtgcactctcagcccctctggctgcccctcccagagttcaacagcacagggggaaggctccagctcctcccagatcctgactgtctcctctttgtaaccatcagggagaggaaaagcatggaaaagccccaccaaggaagtcccccacaaaatgacaattacgcactgagcaaatggagacaaaggactccagccagcggcacccgaggagctgcatctgccctctgcctgacagcccctccccgactcccatccttgttcctgtccccatcctgtagggtcctttgagacccagccttggggaaagtgtggtcagtggggacttggcccaggccaggctctgtctggtcaccggcagaaacgcgaggaggaatcaagttcacatggggcaggaaagggcccccagacccagacaatagggcccagcaggcagggcccgagcaggtgaggagggagtagtgggctgccaggcctccctcatacccctggagctgtcctccagagccagatcagtcatctgctgagcatcaaccaggaagagttcctatccatgggaggctccatcccaacaggtgtgaagaggatgagatcttcagggagtcacccagcgggctagaaaaccaccggagtctgaccgctaagtcactgtggccagaatccaaggtcacccgaggtccaaagagaagtccaggccaggagtcctggagatgcggcccagatggagccacctgggggagaagacagcgagtgaggatgaggccacagcctccatccccaacttcccacatccccccagcctaattctgcatctgaggggactcatgttcagagatccccccagtctctcatgcccccagcacacacacagggtggaagtgagggttttggacatgaaacatttttagaagaaacttaggccaggcacagtgactcccacctgtaatcccagcactttgggaggctgaggaaggaggatcacttgagcccaggagttcgagaccagcctgggcaacataatgagactctgtctctacaaaaaataagccaggcatggtagcatgcacctgtagtcccagctacccaggaggctgaggtgggaggatgtattgagccctggagttcaaggctgcagtgagccgtgatcataacactgtactctagcctgggcaacagagtgagaccctgtctctgag

SEQ ID NO: 1085 - DNA, 2803 bp, Homo sapiens
attgggaggggttgcctctccctgtgtccacacatatgccttgagttgctcttcagtgaatatcacttttcctttcatgttttttctacatgctattatctgtatgaaatgaagaccaagaaaggatgggaagaaggagaagaaaaattttgatttatctcagaaactatactccgaagtgagagtcctggttgcagcatccttcaccgaagcacgaagcagaatcaagctgttgccatgaagcttgtttcaagagctcagaaatactccagggactcctttactactgcttttcaaagaggcctttttttctctcttctccttttcctgcaaagagggttatatccagtgctcaaggacatgggattatcagcctaaggcatgagtacatgctgtggaaacagaaatatgtatgaagggatgtatgaaaccacagaataaatggaatccacattcttgaagtagctacaactctacttgagggtaagtaattaagtattttaaaatgcaaaaaagtatatattatgaggtagaaactaaatctttatttttaggataaaacatttgaattcaaagggactttcagcatgtcgggaagcaagtctgacacaggaataatgtcctctgaagcaaaggctttttcagtggcaaagcttaagaatgctgatctgcatgatgggaaaatttagtgttggcacaagaaattaactaatatgtttttctgttgtctgaaaaggaaaataatgcttggcttcaggtatttggaaatactgcacattcgggctaagaatgagatgaccattttctcattttcaactaattatttcaagataccaaaacaaaacaaacaaatgccattggtgagtacctgctatatacaaaatgagctgtatgtagtgaagtggccaggaaaggcagagttcacagccataggtagggcaggccctggccaccctttaggggagcaagaaaggtaaaccaggtggatgaaacatatcctatagcatattgtaattggtaagtggatgcaagtggtttcttagcaagtcagaggcatcgggctgtctaaaagaggtaagaagattatactgacagagaggtggagcaaacaatgaggtgtctgggaggaagcatttgaagagctgcaaggaggtctgatttatggtagaaaaactgagtccccaggaactggggaagtgactggcaagaagaggacagggcttctagtctagaggaatcaaggcataggacatattgcttacctagagattcagtcaggggtatgggatccagcctgggtatagtttttggaaggctgcttacttgattgggttggagtgggactaacagcaagtgtgatttgatgctgacccttcagtactggcctgcgtagcttacaacagttaccctgtctaagaaggagattgattccagaacccagaataaagcagagaatgcagatggtggtcacatgggttcaggtaaggagtaaggaaagtcactggcccttctccaagtgctgtgcaggtgcaaaagttatttaattttctgtttctctcttgaatgaatatgctacctatttggtggtataacacgtaaactcattcatattaaatgtcaatacatgctttaatgttttaatcaataaatgtactaaataatttaaatttacaagggattttggaaacagatccaactttaagcatggcaggaaattgatatttggacaaggaatgttagcacattcttagatcatactcagatttaaggtaagactactctatttttcaaaccaatctaggtatataaaaccaaatctagttagaatgagaatactaaattaaacataagtttgttattcagatattccatgtagaactgtgggatgaagtgcaatcagctgtgactggttggaataaggacctgccttatcccatggagagttagagaatctgttccaacaaggacagaaggtccaggtgggaagagctctggaaaacaaaactctctgacagcgctcttgaaagctctgctggcatcccaaggcacgtagatagtacctatacatctcatcaggaacatggatggttctctgctatcagctgaagtgctgtgaccacaaaactgaaaattcccattctgtgtccttgccaataaagaatgtccatcagagcacgcccagtatcctagctccttatccagactgtgcttctcaatgtgacaaggaagactgcaaccctatttgcttctgataaccttcctatgactaagcctattcagtggaacgatgaggataaaggcctttctgatgatccccttccatttaatatcttctctggttgagattcctggggaggacactcatgacaattgtggtttttggaggatctatctttaggcagctaaaaggaagttcagagaaagccccttcctatacttcgcaggagaaaaaagagcaaaggacaatctaactggctgaatgagaggagcgggaagaagaaagggccaaaagatgacagaaaattgccctttcagatgttctaaaatggccaaaatagcagtgactcctattttgtaacttggtgattcttaatacagcttccatttaatggtctaagattaggagaccacaagtccctggagcaacaggagcaaatgtgagtgtcctagataaaccaggccatatggtcactctatgtgaattggttgttctttttaaagggatgacaagtaggatagggggaagggaagagaaaggcatattcctttcttagaaaggcaatgcctgcaagttgtcctcata

SEQ ID NO: 1086 - DNA, 1790 bp, Homo sapiens
agaagtgaaacaagagatgaaggaatgttgcttgaaagaaggaactctcaaagttcctcagccctaatctaacacaaattgcacttagggttactggggggagggtgcggccgggagggttcaattgtccagcaagggcaacacgggttaagtgaaaggtagagacaggacctccactacaccccgggactctcacccccgagtagtagtggaagccctaccgcccactcccaccccctacaacagcagactgagaggccggcaagaggtccgagctgggaagtcctgcgcgccgcccccgtcactcagccggcggcgccatccgagcagagcagctgggggagaggagacgtcccctcgccccgactggtgacccgggcagggggcgccccctgccctgaagtccccgcgtctaagtccgccggccgctccgccagtcccggtgaaaagcagggaagttgtgtgtgctgggagggggggtccgtcggctctcccagggaagcctggcggggcccgggaactcagcggcttcacctcgaggggactcccgtctagagtctcgtggcgtccgaggcagagtacagcggctccccaagtccgcaggccgggggcgggatcagcgcggggctgggggtcaacgagcacttcctcctcccagccggggatccggggcttctccagggattctccgtggcgaggattccgggtgggggtggggatcccgcgcggttccgcccccgccaggccaggggcagctggcgactcgctcggtctctggtggtacgcgccacggcccccccaccccagctctgcgcgccccctcccctccgggcaccaccccctttccaccgccccgccccgtccaggcaccgcccctggcttaacccattcccggcgcgtccggctgcagcgggagaaacgcagggaaccgagagggagaggcggcatgtggacaggccgggcctcatttgcctaatgcaatgcggctgaactctcgctgaactcgcctggcggcgcctcacctccgagtgacccacccaccgctgcccgtgacatcacccgctcgccagcccgcccgcggggctcgcccgccagccccctgcccggccgaaccgggccacctcccccggagacgcggagagcggcggcaggaggcgtagggccgggtcgcgcggggccaagtgtttggcacccgggtgtgacattgtgcagctcggacgctgtgtcggaatgagacaccggcttgtgtcattgtctgtgacatcatgtgtgactccggccgccggaacccgacgcggcagcgcgggtgctgttggcacaaacacaggcagagggggccctcctccccacgctctgcgtgcttccggcgagcaaagccccgcccaaggtgtctcctagctggggaaccagtaccggcccctggtgcactgtccagctctggagagataaaaggaagagctggtgccttccagtggactacttcatcctagaagccctcgggatgcacgtttcactggaagaaaggcctagcttgggtaggtccctagaaagaggggatacccctggaggagggggtatcctattacccccactctctaaaaggaaggatggaaatgtacatgctacccaaggacattcttctagaagaagcctggctctttatatatgttgtcattttatcctcacagcaactccaagagatgttttacaaataaaacaggtctcagcaaggctatgtgggttgtccaagatcacattactaataataaagagtagagcaggtatttgaa

SEQ ID NO: 1087 - DNA, 441 bp, Homo sapiens
ggggaagagaagaggagagaggtccataccgctgcacagtgaggacaagctgatttcctgaggcatcgatgaggctcatggcactggcatgggagaggttggtgcaagagaccccattgattgccaagagctggtccctctctcggagtcctgctctgccagcctggctccgtcttcgaatctgagatgttgaaggagacactgtagggacctcgcgctgacatctgggaaatgccattcatactggaacctccgacacactgccatgaatgtgagggtttcgtgactgatggggagactgcagtcaaataaaacagatactacacgcactcgtcggggcagccgtactgcagaagcacgttgatgcactcctggctggaggcctgccgggcgtaggtcagcgctgtgttcccgtgggcatctcgggccatgacgtccacc

SEQ ID NO: 1088 - DNA, 779 bp, Homo sapiens
gtcccagcgcgcgtgcgcccctgaaggcgggttccggtggcagcgccggggtctcagaccctgaggagactgagcccagcgccaggcgaccggtccccgccgccgccgcccctgcgcgggagatcccccctgcttagtccgcgcccgagcccccgtccgtgggaacagacaaggggcctccgcagcgcctcacaacccccgaccaggtccagcggcgggggactcggccgtggagggcgctgttcggtctggatggctccccccatcagcgggaggctacaccccccaccagcaggggcaagaggagcagcgggatgggagcaggccaacgtcctgcggcctggttgagctcgcactgacaatcgcagctcaggcgctcaggactgccaggacccagaggattcacacgccagccccggctgaagcccagctcctcatcaaccggtgagccgcctgccagctcctgctccagctgctgagaggcctgaagagaccaagacagagacacagccccgcagcaccacagggaggccccagttaccccatgcggatgagtttcatggccatctctaactaaggacaggacatcgatgtcatctgtaacttccggtgcactggggcacacagctgcatctccccatgctcacctcctgcctcttgctctgcccagtgctggagtgcagtggcacgatctcggctcactgcaacctctgcctccaggattcaactgattctcctgcctcagcctctccagtagctgggattacaggcttgcacca

SEQ ID NO: 1089 - DNA, 814 bp, Homo sapiens
cgtcagtcccgctgtctgtgtcaaatcagaaaaagaacctgaccgtgaggactagagtaagaggctgtgaagactgccgcctcctcgcacgacccacaccgtcgagtgtccggagatggacgggaaaagctaccacagtggcatggccttatttcctgatcttaacagcatttgtttgccatgagaggctgcatgacttggagccagtcaatctacggtgacagcaaagcagttgtgactctaatgtactgccaccaaaaacactttcttttccgtctctcagccttagcaggatcatctgagccactgccagttcagagtgagctggggctgcttttccaggagggcagttggggacctgacttttgaggagattctgaggtttactgaaggagcaaaccctatggggttagacagagttttgtgaaatctgagctctgccttctctgtacttcagttactgcctctgtaaaatgggggtgtggacactgtagacattaaatggcagtgtataaaggaggcaccatctggagcatttgtccagcctgcaatgatgccgtttgtctgagaaggttgtagggatcatttctggtttgaatctcagccctcttcccagctcagccaccagccatctggaattgtgggagaggtcagacggctgcaaagcctctatgtggaattggaactaaatacacatatttatcagtatttaatggaagactgcaggatgcttgcagagtctacagaaggcactggtaaggtggctcttttagtctgggaacaagaactgggcaatggatgcctcagaggctga

SEQ ID NO: 1090 - DNA, 5391 bp, Homo sapiens
tatgcctcaatatcatttatgctgaaaaacaacttaaaatgcatggcctgctcagagtggtttagaaatgtgatcatttagtcttcctcttatatagattttacacctcttgaaagtaggaactgttacacataagtcaatgagtatttgttgatagtgtagtgttcacttaataatatacgtatttcttttttctatttaagaaagcctgggcgacagagcgagactccatctcaaaaaaaaaaaaaaaaaaaagaaaagaaaaaaaaactcagtggcttaaaacaataactatatattattgtgcatacttttcatgggtttgctgggcagtttctcccgtttgtttctttctctagtttctgtggggcctgctcttatctgagatcacctagtcaggtaagaggctttgctgatcttggcaggtctagcatggccttatccaggatgatgggaatgactcttcctctaataggttccggcttcatctgctaggcccaggcttgctgtgattgatgaagacaggcatccacccgagtgagcagaagcacctaagggtctcttgaggcctagattcagaactgggacagtgtcacttttactgctttctgttggctaaaggcagtcacaaggtcagttcagattcaaaaagtggagaaatggactccatctttggataggaggagttgcagactaacattgtacaaggttgtagatacaaggagaggtggaagatggaggcatttttgtaatccatgtaaggtacatgctgaaaaaattactgaacccagctaaagtttaggttcttcagtctgaaatatgggattacacttgatcctgaacacactgctgatcatatatgtactccttagattatatagaaatctatgtggacatgtgtgggatgaccctctttattaaaactgttaattcctaactcctgtagaatagagttattatgtttttttcttttgatgccctgtttagttggtttggtactttcactggggctgtgtcagtttaaggtccaaaatagatctgactgattctgttttgggggatggaggaaggtatcttaggtctcagtgtgcttctgagaagtctttcaagtagatgacctcccctgttctgcccacacccaaaacccactgaccaagcacttgctgtcatgttaccctgttttgttttccctgtggcacttatcactggttaaaattcttattcacttacgtgttttctttttctgccttgtgatatgagcctcacaagagtggggacctcctctgaccctctttgctgctaaattctcacagttaagaatagtgcctttctgttcttaggaaatgctcaataaatatctgttgaacatttgtaataaatattttgtaataaacaagtcagcagtttgttaaaatacagtgtgtttaaatgctatgtcactggtgcattgcagacacttgttgggtatttatggaatcttgagggagggccgtggtcagtaggagctcaaggagaatgaaagcttgaagccacaaagggtttttctagattaatccagtgaaagacagatgagcaggagagttagggtatgatagatttgttgaaatgttgaactgttagacttcaggctgggaaggagggaagtagagcaaaaagtgatctgatagattgggatagagattcttccaagaccagagaactcccacagggaagtagttaaacatgtatactgcaaggttggagatttggtgttgcagtgtgatcattgaagtcatgattttagatgtgccaggttatgggtatgacaaggttctgggattaagagaatggatggctcaggtagttgaaggaccttgggggaatggggaataaatatctgttctttgagagaatgcagtaggacagctgatgggagaaagtccttaacagccaaggtactgaggtaatgctttgaaaagaggttgagggtatagaggagtttgctaattatggagcaccatttccataggtagttaaatttgtaagatagaaggtggactgtagactaggtcagggatggaaaaaacaaagccttgtagggttaatgccaggtcagtagatggattgagagaggaattggagataaagttaatttgggcattgagaggtttgctgaatttagtttcagtagactcctagagaaaggtgaccctgggacttacagaggccgtgactcatttggccaagagtggtggtcagcccaggaatttgtgggttctgcctgtgctccttaaagggtatttgggtaggtagattgtgaactcttaatagcttacatactaagcagatacatagtcattagcagcttccatattttcactatggtttttcagaatattttaagtatttttttattagaaatgacattttccaaatgtaaactctttagagatggaaaacattaatgatatatgcaaatactaaaggacagtgatttaatttaagtaatactgttgtcaagtgtaaaattcaaagatctaagcctggaacctggacttaaaaaaaaaattcaaggatcaagattttcaggttagcattttctattttttggtcatacttttttttttttttttttttgagacagggtcttgcactgtcacccaggctggagtgtagtgacacgatctcggctcactgcaagctccacctccagagttcatgccattctcctgcctcagcctcccgagtagctgggactacaggcgcctgccaccacgcccggctaattttttgtacttttagtagagacagggtttcagcatgttagccaggatggtctcgatctcctgacgtcgtgatccaccctccttggcctcccaaagtgctgggattacaggcgtgagccaccgcgcccggccacattttttttacattggtattagcagtagatattttaatgtaaatatttaatcttttttgctgttagtcattttgaaagttcaaactgtgtgatgaaccagaccaaaacttcataatctttaaaccacaaagttgcctaataggcaacaaagtaagcaggacaacagtggaagattttacaaattctcagaaacacctggaaataatttaggaaaagcttttgactctaggctcatagatagagactgtacatgaagaataattaatagcaattactttcttgtctttagtctttcgtcagatttgtttctttgaaaagagcaaggcaggttaaaataatctgtataatataaattgcccatgcaatgcaggtcagtttgttttatgcaggtagcagtagtacgaacttggggtccaatgatattttttatatactacttatatatgatggtaataattaaaatctttgagtatgttttatttctttaattatgacaatttaattaaatgccaaatgaatataacatttgtcagacataagggaaaataagatgaataagcactgcacatgatactcagcttaaaataagaacattttttttatgtcaaagagcttctctaggatctgtaaataggagtgtaattgaagttgtaaagtacatgcatttgattttgggaatttctttattataatcttttatccataatatgtgtggcaaatttactctcctacattgtagcttaccttcacattccaagagatcttttgacgaacagagttcttaattttaataaaattatgtcagtcttctgtaaattaacacaggttttttgtttttttttttgttgtttttaattcctttccagtactttaatctttttccattccagtccttacatttctttatattgctggctagtattgccagtacagtgatagaagcaactacagctctgatgtaaaaatgaaggattctaatttttaccactaagaatgatatctgatgaagatttttggaaggtatcatttccaggtgaaggaaattctctatttctactttagtaagaacttttattatgagtttaagtattgaattttatcaactatttgttctgcattcattaagattttttttcttttagtttgcttattcagtgaattccatgaattgcattaatactcttgttaatgctaaaccattaatggtaaatcttacattgttgggatcaacccaacttggtcatgaagtactcttttttccaagttaataaagtttgtattttttagagcacttttaggttcatggcaaaatttagtagaaaatgtataaagttctctgttacgcgtacacacacacaaacctttaccccctcccccactgtggacatcttgcaccacagtgatacagttgttacaattgtacctacattgtcacatcattatcacccaaagttcatagtttaccttaggattcactcttggtgttgtgtgttcattgagttttgacaaatgtaaatgacatgtatccaccatcacagtatcatacagaatagtttcacccccctaaaatcatctgtacattgttctgttgggtttgttgatacttcatttaagactttgatatttatgataacaaagtgaaattgccctgtaattttcttctcttgtactgtcattgtctggctttgatagcaaggttggtctagcctcagaaaatgagttggaaggtgttccacttttttgtactctggaagagtttgtatgaggttagaatcagtcatggagaaagggatattatagttttcaaatgttgcagtgacttcttgttttctctgtgtactctgtccttttattttgagtttatattatcagatgcatttaagtatagaattgttatgttctgttaagtgtagaatatgccatcagaatgaagccaacatttttatcatgaggggacctccacctccggtagtacttgtgcctttatctgttttgtctgattttgatatataaactttcttttatttagcattacctactctaattttttttcacccttttaaaatatctgtttatccgtatatttgggtgtatctttttaaaatagtatataatgaatctttttccagttttataaacttttttttaacttatagtcaacttatgattgttggtatatttaggtttatttataccttattttgttctttcttctcttccttgttttcttgttggttatttaaaaggtatatagttttaaaattgtgtacaaccaagatactcagcaatggataatcaattttcctctcaatctttgactttcaagaaactggaatagatttcagtatgtactacaaattgagtgagaaattattcgggaaaatgcccaataaaaggccttcataattttggaagaagtaattggaataaaggtgactcatctcttattagtgagaatggttaaatatgctaattaaatgcctttcactttt

SEQ ID NO: 1091 - DNA, 481 bp, Homo sapiens
cagctaccctatagttggctgcctggcttcagagctttttttgaacttggaagacttcaagccccaactgaggaatccttgatgctctgttgttttgtcttgctaaaatgtacaagaaacttgcacagctctgtccttcaggcttaaaatcatcccagggaggtcactctaattccttttaatgtgtgctgaagaaagggcagcacagctgaagcctgatttaaaatctgatcttctccctaatgtcacaaggacatcctgagacaatggctgaggagctatgcaccagtacccagctggatccctgatacttacattggcagatgcattatcaacagagacatcgatttagagtgaattaaaggaattacaaagatcaagatgaattcagtgaagcttcccataggactgttcaaagatctccaggcctgccattcatgcattcatgtgagagagacactttgggcctaagaaatgaagg

SEQ ID NO: 1092 - DNA, 398 bp, Homo sapiens
cagccgggttcaatgcgccatattgaagaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattca

SEQ ID NO: 1093 - DNA, 1529 bp, Homo sapiens
agctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgaagattatttacaatgctaccctgctttttctggtgtcctgaacctggaagttgtgctttttaagtcttatgatgtaatcagcgcgatttcacttcctgaatttcgatgaattctaagacatgggcaagatcgggttgtaagacctctgagatttaaggccatgccctggatcatggtgaacttaccaaagcaaacaatgcctgtgagatggtcctgcagcagccaaccagtgaactcttttggtgacatcctgttcttgttgtataactttatattcctataaatccattaaggccccaataaagtttgtctctaagcgctgtgttagatctatatgactacatctagtaaattgtgaattttaagtaaatattttataagaactcctatgtaaagcattactaaaattagtgttgaaatatgaccttcttcctacatttattcatttatttatgtctatttattcatttattttagtgaaaaatataaggaaagtagaggaaggttaaatccaaaaaagaattgtttccagtacactttctttaatttgctgtcagtttttgcatggaatctacatctttttatgctaatcctcatcctagtattttacatcttaactatttttttctgactgaaatggttgatgtgcttgttttttgtaattttctactttccttctaaaatgcttagtattgaacaaatagaatatcctaattaaaaacagtaataaatattatggtgaaaaaatacaagtaaaatgggaaaacattagatagcagctttcaatatttcatatagttcataaatgtttcaggaattacaaggttatagaaaaaaatttatagactataataatttccagggatataaaaaaataaagcttctacctttgaattgtaataataaaagataaacagacttgaaagcatatattatatctgaaaatgtcagataaacttggcttataaattaaaatataaaataataatacaatttgttcaaataagtaattaaagcttacattgtaaaatgaatatttagagagattgtgaaacctgagtattttacccaatcctctgaaattagtccctagcatcagaattaaagaatctgaaaaatcacaaa

SEQ ID NO: 1094 - DNA, 812 bp, Homo sapiens
aaaagcagagttgcatagatcaaggtatgtgagattctgaaagaggtatattaaagtctcagcatgaaagcataaaggccataatgaatgcatttcaagaatgtgatctctttcagcatgtccacaccctgccttccacatgtcactacaggagaggaggatgaggaaactgaggcatggagcagtccacgtgaatgagtctcgtagtaagtgatggaactaggatgcaactctctggtgtgagtgccccactctgagagatggaatctcgctctgtcaccaggctggagtgcagtggcatgatctcggctcactgcaacctctgcttccagggttcaagcgattctgctgcctcagcctcccaagcagctgggactacaggcttggtcaggatttgtgtagaaagtgcacagcagaactgagcctatgcattcaaagtcctgagtacccctacaaaggaagaggacacaaatgaaaaatattccctcataccaaggattgtcctgaaatccaagaccatattttatgagaagacatacatcagagagagagagattacagtatgcaatctctcagctgccaacagaacacagatgggcttgggaacagagaatgatccagatctgcaggactggagcaatccgtgggaagtttggacagaagatctgatgcataagacagtaaaggactattgaatgttccatgatagatatgcttgttcttttgcctgcatgcccttgaataaagacattttgatctccaggaccaacctgagaaacatataatttaatctagttttgaaagaagagccc

SEQ ID NO: 1095 - DNA, 525 bp, Homo sapiens
ccctcagtaatatccaaagggcgtccagagggtggggaaaatccctacagcacagcttttctccaaaaagaaggtatgcactgcccctattttattttctaacttgattcatagcacgctattattttctttcatcagtgaactacgcagaggggattccaccctccccaagacggccccatgcaaggtcaagggtttaccttgtcataatagtatcgcagggctctgctcagcttatcatagttcatatttgttttgttttttcggagtccccacagcttggccacttcttctgctttgaggagcttgaattcaccatcgttcgaggtccagcagatcaaatgctcatgtttctgatccagcagcaactgcaacaggaactgccacagcgtgattgcactctccatacctgcagggagaggaggccaggtttcctgaggcctccccagaaacccagcagatgccagcatcatgcttcctgtacagcctgcagaactgtgagcccattaaaccgcttttctttat

SEQ ID NO: 1096 - DNA, 807 bp, Homo sapiens
tatggtgtgccgggggccgcgcgggccgggagttgggtgggctgggggacaggcgcgcccgcgccgcccgctccagctgggctagtgctgcacattccggccagcccctcctcaagaccccattcccaagccccttctcagctccctcgggccggcagagcggctctgatcagtaaaatgctgttgaaggcccacgggcatgactgcacccctcactaattggtcattggtttggggaggacaccactgtcccagtggaaccttgagcacaccttggagccctcctcttcctctccggacctgtgccaaactgtgagtggcacagagcaaggactgtatgtgttctcttctttgttgcatactcagttccttgaccacagtgccaagcacacagcgagcactccctgtgtatctgctgagtaaataaacgaatgaacaaacccaacacatttcagccaagtcctgctgatgtttctcctccgatctagctcctcctttccagccttacttctgccactccagatttcacccccatcagcttcagactggataaaaggaaaccatttctctaaaggatcacttgctctctcatttcaggccatcctgcagccaccagaaccttccacatgaaatgaaaggctcaccacttcataggctttaaggaaattcttggccaggtgtggtgcctcactcatgtaatcccagtgctttaagaggccaagatgggaggattgtttgagccagctgtttgagaccagcctgggcaacgtcatgagaccccatctccacaaaaaaaaaaaaaaagaa

SEQ ID NO: 1097 - DNA, 1932 bp, Homo sapiens
gagatggagtcttgctctgttgcccaggctggagtgcagtggcatgatctcagctcactgcagcctccacctcttgggttcaagcaattctcctgcctcagcctcccaagtagctgggattacaagtgcccgccaccacgcctggctaatttttgtgtttttggtagagttggggtttcaccatgttggccaggctggtctcgacctcctgacctgaggtgatccgcctgcctcggccttccaaagtgctgggattacaggtgtgagccaccgcgcccggccccatgattagcttttaatcaccattttcagaaggaggttggtggcatgcgggggccgggctggggtggcttcctcagcatgacgtctgtgcagatgaggctttgcatcgtgctccaaaaatacttaccatgttttgccagaagagaggccaccttctgtcctccgctgaggatttgagtccttttgcccttggtgagaacaccaaagaggaccgccggaatgcgagttcaaaagcagatttcaatcctaaatctcttaaacagtcagcattggcttgtctcactagaataccctgtttctcttctagaattcttcccctgcctgcccccaaaatgtgaagcttgctgaaatcaacttgaaaggagatagcacatgccttttgtttctccgctctccccctatttctcttccttcctgctccctgcataatctgaattctctgaaggcaggaggaagccaaggtcagattcaggcaaggtaaatttctgatgtgtgtggacacggaagagaagatgtctaaaaggcaactagatgtgaggcctaggccctgcagagtctgcagagtagatctgagcttggaagtcagcatgggatggaggctgaccccaggggaaaggaactgtgcaagtgcaaggtttgcataagtgggtgcttctcagggtgaccaagacccttccggagacttcagttcctctgactatatgagacccaagagaaaaacagcacaaagtgctccttgagttcaagggaatacataaattctgaacatttccatgtctactagcatacaacctaaacagggataaaaagacacctttcaagtcagaaatagggaagatgccacttctctgcatttgctgctacctctttattcctttctttaggtcaccaaatatctattgagtgcttgctctgtgatctggcagacaactcaaaggcacagagatgaagatgaaacacaccatggagccagggaagggcctggatgctgtgggaaacactacaacaggtagagctctgtaaaaatgagatttcaatgaagtttaccatctagtggagaagagatccaaggacacccgtgactgagaaataaaacagaatcaattgggtgcaataggagaagttgctgacaaagggctttggagactgagaagagagagaaacaccaccaagttccttgcagagaaaggcatttgataaaatgtgtgttgaataaaaggaccagcggtttgtggaggatgaggaaatgatggctgtgagatgggcctgagaggaggggcagggttttgaactgggaggaaaggtgccatcccattcaggaggaggatgaaatcagggataaaatgaggtggctgatatgaaaggagtggggcatccttggcttgggcttgtgaggagtgtgggccacagtgctatgggcagtcaggagccaggctttcagttctaacggggcttagagaaaaggccgattcaagtctctttgctgatggcaagaggaggaaagggggctcttggtaaccgaggacctgcttcttaagcgctggagacttcgcattcattacctcacttaacactaagaactctgtgaggtagctcctcagtcccagcacttttcaggcgtggaaactaaggcttagagaaggagtgtac

SEQ ID NO: 1098 - DNA, 548 bp, Homo sapiens
gctgcgggcggcctgacggtggcggcagatggcggggttgctgtcgctgctgtggcctttcttccagcgcttcaacttagctgagacaccagaaggcaactttcccgagcgacccatgttgactaagccgtggcgaggaatgagcttaaatgaccggcttccagggacgtagaaacacgctcagaacccacgtggataccctgtagccttcacttcctcttcttctggcgtcacttccggattcgtgtgcattactatgaacctgagtcttgaggcatcatctgggctcatgccctctctgaaacataaatcctgtactccacagacaccagctgagccgggagatctgaacatcaggcaatgagtttgcaagatggtttaacaactatgaacatgtggtgtcctcacaggaatcctgtgggctgaacagcagccgcccctccttccacccagcacaaaacttggtttgccccgctcactctaaatctgggccttcaatgaatgttcagtggagttcttctgtggaaaaaaataaatgggaaaggaag

SEQ ID NO: 1099 - DNA, 6585 bp, Homo sapiens
atttggcccagatgaaaaccgggcgggatggcagccccggggccagggatgcgggagccgccgggaagacccgcgcgccgctcgactcagagggactcacaccttcccccgacaaaggtcattaagttaggcggccccactgtcgaccaagtgcccaaggcattgtgggagtcatgattccaagatgcccgcgacggaaaatggaacttgtcagctccttgtcatgggagcattgtgggcgccacaactcattcagctgcagtgaaaagactgttgcatgtcgctgtgcagcctcttatcgccgaggtctggcttccgctgctgctgcgcggcccctcccccgcccgcccagccccaccaggaagcccagggcggactcgtcgagctcctaatgcacgcggcggcgagaaaaacgctcttcaactttccgccggcgccctcccgcgcttccccgggccacagggtcgcctgtcaaccggacagagcccgcaagagcgggtcatgggcggtcgcccagcggcgccgagagcaggaggaagccggagcccgcgcgggcgccgtggatcccctcggcctcccgttggtatcttccatctcatgcgttcagcattgtaacctcgcggcgggcgtgcagaccggacgccctcccgcttcttctaccgactgctaggcacaccagtgggttcattttgaaagaggcccttgcaccgggctttgcaaggaagccggcaaggttagattgaaggttagaagccaattagactagaatcctgcgatctggtgagactgccgccttaaaatgcaccaaacagtttttgaacctggagggctaacaggcgggaaaaacatctgcaagactgccaccgtgtatttttctcaagtaacaggctatccacagttttggaattccttagtgaaactgtcacacaggcacaaacacatgtcagctttccttctagtttgtaaataatatttgtaatttacaggccactgtattcccaactttgcaccatgtgatttagagaaagcaaagctccctctttaaaaataatatgttacttctgaaataccgggatattccacggcaagtaagccatattgtcgccagagcaaataaaccgcagccccatatcataattcactgggtgctataagatgtaacttggctttgctttgaatggaaagaatcctgaacgtctgtgatgtgatgaagttttggagactgggggcaggatttcctttgaatgtaaggaattcggataacttgttcaaggatgattctagtgaaaaacgtttgtcccatgtttgttgggacaaaaatgctggatatggtacaacattcttcctgcaggttcggttttgttgaagagagtgaggccagctcgaggtgaaggaaaaacatcagaaaggtgctaaagtgcagaaatatcttccagaggcactaatagccgactttagttcttgacctttagctagatccacaaagcactgagttaaaattgtacactgatcccttccagaacaaattaattaattaaatggtgcctcttcccagcgttaatcgtttaaaaggactcaagtacccacacagtttaagcaaactaaaagaacactgacactttctcagagaacagggatgggaactttctatctgcccattagtatctaccccaagctacgaagacttccattcctcttattaagcattcagcaactacatttagtgcctactatgccagtgatgcaagaatggataagacagtccctacactcaaggataacgcctctagtaggtgagagacaaaccgattaattctgcataagggataagtgctgtatgtgggaagcaatccaatgagggctctgaggatggcaaaggaagggttcctggaggatttacatttaactggtgccttgaaaggtgtgtagaagttggcaagatcaaaagggagtagagtccaggtggagaagagaaaagagcagggcaggctggatggcatggctcacacctgtaatcccagcactttgggaggccatggagggaggattgaggccaggagtttgagaccagcctgggtgacattaaaagaccctgtctcaaagaaaacgaaaggagcagggtatatacaaggggtctgccagccttctcagcctttctgtgagaagcgagggtagggtagtacaggagagtggcaggagatgacactaaaagtaggtctgtgttgatctaacgagtctcaactttactgccaaaactaatgaactaggaaagtttaggcagcaagggccagagatggagtctggacttgtattgcagaaagttcctgtgacggcagcttggagggtgaatgagagtgtgggatggaggggtgaatgggtgtggacagactggaaaaatgactcatgcagggaatgaggaagggaggagccttgggagactctcaaatccctggcttagcctactgaattgcttgctacttgcctttttatgtcttcattttgcctcccattgtctgtgatattaaaggcctaacttcttagtagagcaaactttgcatctgctagcaggttggtgccctagctagcttccatgcccctctgcttagaatgcctgcgaaccactaaggactaatcctagtggtagaaatttattttcaattgttctcaaacccttgtagaattccaagttagaactgtagtgttcttttttcatgtgggttagaaaatttgctgtttggagcaacatggtgaaacacaggacttttgaacctgcttatggtgcaaaaggggaaattatatttctacttcaacactggaggaggggggacttctgggagcaaaagagaaatggaaactgagatgagacatgttttttactccatgacagaatacaaagaaatacaaggatgatcctttaatgttagaaacagtagaataaccatcctggtaaataaaaaaggagaaaaaatgttattttacattagatacagaaaaacagaatggctaagaaaactcacaaagcaatggtcaatctataactcgagtccaaataaattgtgatataacactaaattaccactgatttggcctaattgactatcactggataacattataacatgaatgataatatttaaaattttaaagcactgtaacaaacaccagatcatgttaaaactattcaatcatgttgtcagctttcaactgccagtagcatcctaaccacatttcaaactatggaaattactaaaaaatcattattgtaataaaaagttaatagttcctcatttagaataccattgatattccctcagtgccaggagaacattatggtttctcctatttctgtgaagtgtatagtctacaggttcataagtgagtatatccatgagtataaaaagaaggtcatttatgggtggagagggaaattatagaaaacaatttcagatgaaataaactacattttcagataaaggaaagagtgttcactgcaggttcctgaaatatttcagtccattcaagttttaattataccaatgaatctcaataaaaatacagttaaggaatatggtttttatagataatgtcagctccttgtttaccaataataaagataaagataatggcagcatttatctttttcagtccaatggggatatttaaggtacctatgtaagtgtgtgagtgcctgtgtgaattgtgacttacttcttctgcataccacattcatagctcaataagctctcactgcctctgcaatataacttgtctttcctgacacacacacacacacacacacacacacacacacactctcacacaaacaaatcacctaaataaaaatatctcaaggaggtatactcttttaaaatgctatttttattataccaggataaaaataattgattgaaagatggtgtcaaaaccagaacctagtctcatgtcctgtgcttcctaatcaatatttaaatatagatggtcaagagaagatgactctaaaaggcaatcaaaagttgcaaacattcttgtatggagaatcaagtttaagtagatgcattaaatttatcacattaaacttcacaacagggttgaggagagaggtgagaccttcttttgtagaattcaaacttgttcagatatttgaatacatatacttgagagaaagaattacatgaatttagtttatcttcaaggacctttatatatttcatacacaacacaatttctttgtgctcattatttaaaaataaaaatatgtattctaatagatactatgtatatatttgatatataatacaatatattgtatgtataacacgtatattgcacatgaatgtgaaaatatataaaatcaatatatttgctactaaatgtttatgaaatttaaagcagttaaatattatgcatttctcaattaagttattttacctaaaagttgaatctgtatcttcaatatcattattttaggatctggcaatagagagacagtaagcaaatacattttgaaattaaaagttcaaaatcatagaattttagcattgaatggaatgttagagagcatctggccttgttcccttgttaaaccagaggagtgcattatttaaggaacttggcaccatggcagagcagaactgacatcagtgtcttctgactctctcaggccattcattttcattgtctttttttttttcttaaagacaataaggacaagaagaagctctaaaataggcctaacagtttccccagtttaatgtaaggaggtgctacatgagatttccaagagtatagttcttccttcctctgtttcttccttctttcattttttccttcttttattctttctattttttcatcctttctttcttctttccatacagaaaacacttttcacacaatgactctattcatttcacaaacatttattgagcatcagccatggctaactcctattctaggtactgtggttacagaaatgaacagcacagataaatcacttccctcaaaggggttgcattctactagggggagacaagcaacaaaaaataagtcaaaaataaaaaataaaagataaacatatgaggtaatttcagatggagataagcgctatgaaataaagcaggttggggggatttgggagagaaggttgtgtgaaacaggatggaggactgagctggtcatatgcaggcaaggttctcggtgaagtgagaaataactggggaaagagcattcaaagcagtggggactgcatggcaagagccctaaggccagggttcatggtagggctagagagccaatggtgaacaaaaactacctaacctcaaggagcttacagtcaaggaagagggaaaaaatgaatctccatcaaattaatcacactcaaaatgcaaagctacaaccatgatacttttcctcactgggaaccattgaagtgtttgattatgttagaggcaggggtggggtggggtgatggaacattatctaaattttgttttcacaaagataactagataactcttgactgctgtgtaaaggctgatagtctaatctcagaagagactgcatgaagtccaccactgctgagaatgacagcaaaccaaaagtgggctctgtctaggaggcaacagacagcaaatggctggggacccagcagcggaatgtgatttggttgaagaccctcggcaatggggtacaacaaaccttagaaccttacatctcagagttgaagagaagccataagactcatgatcctcgagataacataacttgagggaagggagatgtggtatgcctgtttgtgtgtgacttatttattatttggagtcaacacaatgtagaaaattcgaaattagtgaaggtagaatattttgatatcagcagtgtttccagttcccagagatagggaactgtttgtattacagtttatttccttctaggcttttccaatgcatttttaaaagcatagttaatattgtactatatatgcaatttcttttccaaatttaatcttttaagacaatcttataaaacaaaggccacctcccccatgtcatttatatataatcttcatttttcatgaggtaatggaagctggagagttggcccttgaccaaagccttgcagctaacaagaggacaagcctcctgccccacagtgtttcacagccagtaccccaagctcctgaattcatctgtctaatgtgtaatatatttataaacactctacctgggatgtatgcgtaccttctactatggactgttgttaaagacaagtaaatatgcaatcgtggtctttcaataaactaaacggatataaaaataaatatagaatacagccagaagatcaaaattgacatattatctatttatgcttataatatgtaattacatgtaatattgtaaaacactttctaccatttcataaaattctgtgttgttatttagcccagaattcccttgcaatcttttaaaaatagtatctaatagggcttttaatataaatgtcgtagtgaaactgttttatgtactgtaacccaaacatttctacgtagtaacactgttccatatagaaaacaaatatgaaaaaata

SEQ ID NO: 1100 - DNA, 742 bp, Homo sapiens
agacatgccagcagaactctaaaggcagaatgtccttccacctgttttatgctgtaagacaaacttccaagtgcgaggcagtgtggagggctgttgccttgaatggcagctgaatgcaccagcgggatccttggcagcaatgcccaggcactgaagtcgggcattcaggagagctaaatggagaaaagaaacttgagcaaactgcttcctggaacactgagaacctgaatgggaaattaagaagaaccagattctttctattcttccaccagccaaggtgatgagcacaaaaggatccatcttatacagtgcttgccagcttccataatactactcaccacgatgttgaaatcacctgttccagaaccagtcctgtcctttgacaagaaggatttaattatcagtagtggtggggactggctggagagaggaaaaacacttcaaggactctgccacctttcgtagatggagagtgcaaagtttgtaccatggaactccttctctaacagttactctgtggcagtgcctatttcaaacctcccttaacttctgattgtatagatgtttgtttcatttgttcatctgtttgttcacttagtcagagatgttttaagccttaagagaaatagtggactagaaaatgccttggaaaagtacaaagttcaatccaagtaaactgtttttaaactaggaatttatgaagcctaaaatataaaatgtatatacatggatatgctctgaa

SEQ ID NO: 1101 - DNA, 387 bp, Homo sapiens
gcagtacatacagcttcgctgaggtctgtgtgtcaaacttactgagaggaggacatcgtggagacttatcgttaattagcaatgcttatgcatgcaaaccttggtcagatgatgttgtgtttggagaaaagagagaagagaattgaataagtacatgaccccttggaagctgttttcagttgaggattttgttgtgttgatgttcctttcagctggtcctatagtacccctcctcaggaatgtctccccagtgcaaggacaaagactgaagagactgctatattgatggactctcaagccaactatgaagttgaaacaaagaaagtgatcacctgaagacacctcctctgctaagaaacacccccaaattgtgcagcttctgccact

SEQ ID NO: 1102 - DNA, 541 bp, Homo sapiens
gggttgcggagggtgggcctgggaggggtggtggccattttttgtctaaccctaactgagaagggcgtaggcgccgtgcttttgctccccgcgcgctgtttttctcgctgactttcagcgggcggaaaagcctcggcctgccgccttccaccgttcattctagagcaaacaaaaaatgtcagctgctggcccgttcgcccctcccggggacctgcggcgggtcgcctgcccagcccccgaaccccgcctggaggccgcggtcggcccggggcttctccggaggcacccactgccaccgcgaagagttgggctctgtcagccgcgggtctctcgggggcgagggcgaggttcaggcctttcaggccgcaggaagaggaacggagcgagtccccgcgcgcggcgcgattccctgagctgtgggacgtgcacccaggactcggctcacacatgcagttcgctttcctgttggtggggggaacgccgatcgtgcgcatccgtcacccctcgccggcaatgggggcttgtgaacccccaaacctga

SEQ ID NO: 1103 - DNA, 528 bp, Homo sapiens
agtcgaagaggctaattccgggcctcttataaaaataagaaagaaaagcctcgtttcctctagatcagagagatggcttctggattcatctttccctgcaatccagcttctcttcctggggccctcataatggagactgggatcatcatccaggcttttgcactgggttaggaatttgggagtcatcctggatccatctgcccctgtcaacctttctctgtcaacagatatttactgggcatctccaacagccaggccctgttcatggtgctgaagaacagcatgtataaaacaaccctgccctcacagggcgatcaccagtgacctgtggtgtggagtctccttttacctctgtctcctccttcccactgtcaccatccttggtcctcctctgtcacctggaatactccacttggtaaccagcatgatcttctaacactagttttacccttgtcagcactttgccgaaaacctcaaataaagacttttttaaaaatgtgcgatggaaaactaaagttataaattata

SEQ ID NO: 1104 - DNA, 1771 bp, Homo sapiens
aaatctatgctgcttgctgaggaatgagattccacatttgccaagattggggtttctcatggactattcctaaaacatctggcagacgagatgagtccacgttgtttctgactaaatgtaacagtaggctgtgcttggctctctttggtttggggctcaacttggatgaataatcatctaacagcagactggaatctgaaaagaaaaccaagatccaaatatgtatataacagagggaaggccacgtggagacacagggagaagacagccatccatgagccgagaagagacctgagaagaaaccacccagctgacaccttgatcttggacttccagcctccagagttgtaaggccatggagatacatctatgaacaaagaagacagaaaatcctaccagaattgactgaaaagttgagtgaggggcaggaaagaaaaagaggtggcaaaggtagcaacaactatgttctgctccggaaagcataagccacagcccccaccacagtgcttggcaatgcggttgctgtttaatacctgctgactgagtggaaggaagacaaaacaattacctgactcaaagagaagcaaaagaatgctgccttcaagctgaggggaagactgaactgtccgtttctttctgctctaaagtgtcctctggagaggacgctggcggagctggtgctctcgtggtggcaggccaccaccctgtggaggtgtccatgcattgcaagtgctcgcaagctccaggaacaaacgcatccgcgcagccgtctggggtttgtcccgtcgctgccagccctctcgctgagtccccgccctcgccgataagagcccacttaggacccccattacatggatggcttcccaggacctgcccttaaagactccgatttagtaggttggaaatgacgcaattatttttatttttaattagtaccccaagtcattctttaccatcaaggaagtttgggaaacagatcacttttgtttcaatcacctgtggaactggagcagttatttttttccccagcgactttaccacgaagttaactttggaatacgttagtggttaatacacggaacgttcccgagatccctcaagaaagaagctacgaatacttagaagatactattccgcggcgtttacagcaacactgtccgttccagaaggattcaagtggcggcctgctttgaaggcgaagaccacagggcaacccaaacttcagaagggttctggccacgggagccacactggtcactgtcccctagtgctgggatgacggctcgagtgttagaggatcccactctctcctctggtaggtgaggtcagagagctgagggggccagaacaagtcttccttatcggattctgggcggaaaaagataaagtcggggaggactttctctttttaataagattcatcgttacgaattgttctaggcaagcagacctcaggagaaataggcccaagttttgattcctgttttcaccaagtcgcaagtcctaatcgtagcaagaggtgcggggaagagtcgccttccttcctgcatagtgggatccaagtcaggctgtccttgttagccagggtcaaaggggctctgccagggaaaaacgacggcaaatgtttttcaagaggaagtctccagccacttgtgacctgggaaatccgtctgggccaaaaagatagtggaggcttggctgagggccccagggacacacgtttcctcccgtatggagggggcgggactcttaataaaattacactgcacac

SEQ ID NO: 1105 - DNA, 1537 bp, Homo sapiens
atcaatatcaagatatataatgatcccctcattccagaatagtctcttgtgttctttccagccaatgccccacccctggattctggcaacaattgatctgctttttattaccatggattatatttgtctttcctagagatacaaataaatgaaataatgtagtgtgtcctctttaactttggcttatttctctcggcacactatttctgaaatttgtccatactgttgatatggcagacagaattttaagatggttcctaaaattcttgcctcctggtatgtataattttctctcggttttccgctgaacactaacctaggtgctattgtaaagggatttctcaagtgtaattaaagtccctaataagtttattttaagttagaaaaattttcccaggtgagcttgagctaagtgagtgacctaagcaggtgagttgttagaaaaaaattaagagatatttgaagcgtagacaaaattctgttggcttttaaaagaaaacttccatgtgatagagaaagccagatgatagggaacacaaggttacctctaaattgacaaccagcaaaaaagctgagacttcagtcttatcatcataaggaattgaattctgtcaacagccacgtgaccttagaggaggcccctgagccgcagatgagatcatggccctggccaataccttaaattcatcctggtgagatatgagcagagaactcagctatgccatgctcagatttctcacctgtagagcagtaaattaataagtgagcattatttgaagctgctaagtttgtggtgatttgttacacatcaagagaaaacatatgctgtatatattattagatttttcctttatattggtgggtgtatttgttatctattacttcctaacaaatcgacaataattaagtgtcttaagacaacacatatttattacctcatagtttctgtgggtcagaaatctgggcatggtttatgtgagttctttgatttaaagttgttggcaaatctgtaaacaaggaagcagtcaggaccgaggtctcatctgaaagtcaacttgggatgggtctgcttccagcctcacttaacataacagctggcaggattcagttgctcttgggtagttggattgatggcctcagataactaggtagctattagctagatttcaccctcagtttgttgccgtgtgggcctccctaaggtggcaatttacttcatcaaaaccagcaagggagagagttggctacaatctctagtaatgtagctacagaaatgacatccccttagcaatgagatattttattaattagaaagaaattactcaacaggaggggattacacaatgtagtgaataccaggaggctgagatcagaaggagctagtgtagaagctgcctaccacagtgagtagtattctattacatgaatataccagaatgtctgaatccacccaactgggcatagacgtttgtgttcattcaagatacagactattattattttaaaaataaaagttactatgaacatttaagtataa

SEQ ID NO: 1106 - DNA, 557 bp, Homo sapiens
ggtggtagcgcgaatgggaggtggagcggagctactgcgccgagggacgcttcagaaactctgtttcagtccttcgcggatcctaggatgtgacaggtgttcgagttaaaaggtcttaaggcgatcggttgatccaaaagcagctgaatctttaggaggcccaggcaggaggatcgcttgagtccaggagttcgagaccagcctgggccacagagcaaggtcaccatctctacaaaagaaattttacaaatcagccggacatgatggcgggcacctgtggtcccaactaccagggaggctgaggtgggaggatcgcttgatagcccaggaagttgacggtgcagagatccctccactgaactccaggccgggtgacagcagagcgagatcctgtctcaaaaaaaacataaccgacatccagaagtgaaataaattagccagtgtcacaaagtattaatggttgagtcacaaattgaatcctgtttacctgattctttacgtgattcccatgtaaggaatgttaaaaacagtaaatactaattcctctgcgtcctgaa

SEQ ID NO: 1107 - DNA, 1006 bp, Homo sapiens
tctccttatactagggttcgagacatgaggctgtctttttgggccttttgcgttgtcacagtcccagaccacggaacattctctcttccccaggacaggacattctctcttccccagcctccttcctgtcctggcgttgagtcttccaaatggaaaattccagccatatcaattggtgatgcacccatttcttcctgtggaacgacagtctgatggaattgcttctggagtaaatgcccagcttcttaccacttcagtgtcagcctgaatgtttggaaagttctagcacctcaaaccatttgcatctatgaaagcagaactctattttttccctttggtttagcttgtgagttctctgtgggaggaagatctgatatggccggctctctttcaaccctagttccagcagagagagagagagaatgttctgggtgacggaccctcccagcaaaggggcttgctttatttgcttctctccccaaccctccactcttagcctttgtcttttgaataatccttcctcattccacttttgtggtgggggataattagtcacaactcagtagtaagccgtgcctgctgtagagaggaagcattcagggggttggaagtgtggagaccccagtctgattgctggaatcagtgctcctcggttcagtgttttgagaccaggtctttagcttctagctgggcatatttttctgctttgtaatttaacctgtatcttttttttcccatgttcctgcctcatcagggaattgtaagatttagggggaggtgtgggaaatcttactctttgccctaaagtattcagcgatcagaattctggataccctgcaaaacacctccaacctccctgcctttgaaccctgtgttaacaatgagaagcttgtttatttgaaggctgggttctcattggcccacaggggtaggttgtaattgtgtgtctaaaaaattgccttttgcattccccaatagcatgacaactggaatagtaatttgactt

SEQ ID NO: 1108 - DNA, 448 bp, Homo sapiens
tctcgggcttctcatcagcttattggcccatttagccagggcaaaggtgcatgacaactctgagcaagtcaaaacaaccgtcagcagcgggaaacctcgatgaacaaacaccgggagagtgcattcccaggggagttccaggaggcccatggcccctcctgtacagccctccaccgcccagagccttccagcgccgtgtcttccccttggagcatctggaggccccagacagcacccgcctgacgttcagcagagggggagaccgaggcctgcagcagagtgttttgtcagatgctgctccctgaccgggagtgagagggaacccacctagagtttctgcagatcctgctttgtgacttcgagtgaagtgtggaagcgctggaagcacttagaccctgcctgtgagttgtcatgtatcatgtctgcaaacattaaaaatctcaccaga

SEQ ID NO: 1109 - DNA, 1740 bp, Homo sapiens
acacgagagctgggggactgggcacccagacagtggctgtttccacattggcaaaacaggagttggtaacccagaagccatgctgcggggttaacatcagggaaccgattcgtcccaacccagaaggaagagaaaggtcaggctacatacccaaaaataccttttgccacaggcttgggactactatcctgtgaatgtcagcaagcctgtcctctacagggatccgtggagaagataaactctacaagaaacagaaaaatgtctacctgtctccagaaccatgcagactccctccccttcaggatctcctagcccctgatgaatgaacagcacttccaagatgcttgagacaccgggcacagctactatcagtcatggcgctcccaacctgcagacattatcagtctgctggactggaaagatacacgaactgcacgcccttaagcggagcttcacctcataatattgggaaaagtaagagaatcctctgaccttccataaacccagaatcacctgcacagaacttccctccatcattactcagattcccaggccagcgttttccttccatacccaaaccttctcacaaggaaggtcggcagaaacagaatacaaactccatattgcaaaggtacaatgggttctcccccacccccgctccttttgtgccacccacttatgccatccttttcccacacacaaccacatggaagggttttcactttactctgtaaccagccttcatcataacccagtctccgtgctcagaactagaaagacagccttcttaattctcagcggaatatgggcctaacagtggtaggacaccccccagctattcaaagaaaaaccaccagaggaaataatttcaaatctggctttacaagcatgtaatataaaaataactctgcctttgtctgctatagatgactttccctaaagggatggctgtccttaaagcaatcgctcaattctcatggcaaacagattcttctttttccagtacccagcacatattcgtccctccaggagagcacccccacatcccacctctgacagtatctaaaatgcaaacattgaagtcatcagaatgactcctgtcatctctgctggcctaggaacattcaggacactgcaccttggatgaccgaggagcccctgcagttagctctggcctccaagaaccactactcttcccttcattaagatgtcagcccagaaagcttggtgatcccacaatagccacaacaggttttaatgaatccctggattgtttcttgaaagaaaactggatttcttcagatatttgattcattctttgatcagacagttagaggaatagggatggggtgctcaagataagaaaggggttggggcagtcatggtaaatagtatgagaattcacaaaaatgggccaggttgtggtggctcacgcctgtaatcccagcactttgggaggccgagggggtgcggatcacttgaggtcaagagtttgagaccagcctggccaacatggtgaaaccccgtctctactaaaaatacaaaaattagccgggcatggtggtgaatgcctgtaatcccagctactagagaggctgaagcaggaaaatagcttggaccccggaggtggaggttgcagcgagccaagattgtgtcactgcactccagcctgggtgatggagctagactccatctcaaaaataaataaacaaataagtaaataaataaataaatattcac

SEQ ID NO: 1110 - DNA, 827 bp, Homo sapiens
ttcgcccgaggcgggctgcgggctgctggggtctggtgcggagggccaacttctgggaataacctggctgtgggcttaaaaatcgtagtcattcattatcacgggcttctctctctcgaatacctttaacatttatcgccttgttagtctccacatccacctccgtgaaagagatggagtctcgctatatttcccagtctggcctcaaactcctgatcttaagggatccccagctcaacctctcccagcagctgggactaccgggctgtcaaatttacattaactatgagaattaagcagaatccgaaagtcatctgagttggctatctgcacgttctctctgtaccagtgaacttgaactgtggctgtggcctggattccgcattcaaacatgaccaactgacctctggttgtagggatgtcttgaagatgctgaagaacaaacacagagttcagaggatggaagaaactgttataccatctacaatgatttgaaatgccatttgcaactgcagttgaccgtgggttattgaaaccacagaaagtgaaactggataacgaagggaaacactatcccagcctcaacaaggagcttgatttgggcacagaaacaggagaaagagacctgccttgcctcccttatccaaccggaagtattcttcttcttctgtcttcaatttattgcatgatcacatttattgcatgggtggcttcaggaaggattttagggattcctggaaataatcagtcttgaaatactcccctcttcttccttcatctaggatgcttcctcttctctcaatatattctcacttatgggtataaag

SEQ ID NO: 1111 - DNA, 877 bp, Homo sapiens
aataaaccaagtgcataggtgtgccagtggcccccaactcatagacatcattattcagattaacaaacgccaagaacaaaaataagtcacaatatttaccagaaattatgaagtcatctttaccccaatactttcactcatagggttaaggcatttaatacagactgaacacctgaacattagtatgtgcatggagaaaaaataattaaagaatgtgcacctaaatctaaccaatattttctctggagagtggcttttgagtagaaagttgcattctatgctacctatctgtaacatttatttgtttgcaatatttacattatgttaataattaaaaatatatatactaggtcccatgtccagtgagaatattcacatattcagtagttggggaacagtacactgtttctgttttacttatccccatgagtgattataattctaacagtcccaattggggaagttaaatgtccactgagtgttcagaattctcaggtaaaaaagccactgcaagtgaacacccaggacttacagagcttgatagtttctaattcaagacgtagacagaacaagaatgctgctctggatgtccaatttggagatttctaaaaggaaaaagacgcagattaaaaattatgctggagaataaaagtgattaaaaggtatcattcaaaagaaattgtttttccttgaatcacagacattgtatttatctaaggataaactaggttcaaagcctgtttctaattcagctgctccaggaaactaaaactgattccaaaaggaaacaaaaatcaaagtatgaggccaacttcatgtattcaatggaaaacaaactaaatgagagcctgtgtatttccatgagcctggggaaccc

SEQ ID NO: 1112 - DNA, 448 bp, Homo sapiens
cagtaattagcagaattcaagggtatcttgaattttccctctaagtttgattttcttgtggttttattaaacagatacagatggaggcagtagcatggtaacacctcaaaatcaagcatccagcagctgaatccgaaaaacacaaggaacaaggtggtctcaaaaatttggagtgaagccagaggtgaagtgagactttctgaagctgcaacaatacctctactctacttaaagcaatttctggtgtcatcaccatgagaaggacataccaccccagaataaggagaggcaaatggattagacttgaaatgaacccagagcctggattcaagcacagccaaacccagcttggatctcataattcccagtcctgtgcagaagaaccgtgagacctacaatatatttccataccttctttcaagaaataaatgctcaattttgtaagaca

SEQ ID NO: 1113 - DNA, 1655 bp, Homo sapiens
agagacccatcaggcggggagggcctgggcggtggcggcgcccccttggtggggccgcagagcggaggagcagcagctgccaccggccggaagcctgctggctcggccgagaacaatggccgcctgtcactgtggacagctgtctcccaggctaaggcaaggctgcgctcccagggaatgcgggcagggagccagggcggagggcagaggacgagagcgaggaggagagcgcgggcacccactgatgctggcggcctcgggtattcgctttctctctcttctcccaccttgttccttttccccggatgcacgcatgcactagtaatgccgaatttagaacaacagggaaaggaaaggaaatggcaaaggaagggaaaggaaatggccgacaggaaatggcaaggaagggaaaatccactgcaactctgctgcctgctggcctgtccagggacaactattcagctgggtgggacgttgctacccccttgtggcacccctgctgcagcctgcgattcttacgccctgtatttctggtctaacatcaaccaacactttggcgaaatataataaaatgaaattactaggagaatgaaagaaagtcacatgaaataaaagccctgctttttaatgattatatcctctgtgaaatggatctgcagccctctccatttctgggttcccctggccacaccatgcttatggctgtcccaggagcaggctgacagacaagcttccaccagcatctaaccatggggctcatggacaccgtagagcgtctccacccaacagaatcctgacttgggggcagctgaggcagggggcccgagcgttgaggggaccacgctgctgccccgagacctgctggcatgccacctggccaaccctgacttcgcctgcccgggcgcatgttaactgagttacaacactgagggcacttgaacctggctgcatgaccagagatcgatcacctgtgagatcctctgtgaaacgggataagcatctttaatttcctgggctgttctggaacttcagtcagacaggacacaggagggtgtctgcaccacccacccctgcctcgtgggctgactgggaactatatgacctgtggagggctgtgaccgccaccctccacctcactggggccgcaagccttctctgctccttgattctgctgccgttgtgagcgagggccccagcacccttagggaccccaatcaatgggcttcccacaatgtcgtcaccctttgttgcctgctaagcagccctggggccacctcagaagaaacagaactcacaggtcacaggggccttttcctcctcgtcatcgtcctcctcctcttcttcttcctccctgggcaacttcctgaattcggaaaggtctgtctgtagcagctgtgaaactgcttcgtgggccagagcagcagcaagtggtggcggggccttcctagggatgaggagggggaagtgaggggcagcccccagcaggagaccacacctagccccccttccccaactgtcagcccacatgctgaggggtcacggccagcagggcggcccctgtcctcagggagctgggacaggaaggtcacaggacagcaaaggcagacgcacaaccatctggtggggagctggaccatacttgagcctgcggctag

SEQ ID NO: 1114 - DNA, 571 bp, Homo sapiens
acaagtgtaggctacggtctacttacacctctccttgttatggttcatgatgtgcagaaaaacctttaggccgaacttaaaatatgtaaggaggcagctttaggctaaacttgatttagcaccctcaagatacccgagtctcttgcagatttgagtcaggatggcttcagcctaaggaagagcttgctgggctcctgccaatataaattaccctcagcaagacgacaccagggagaaatgctcccaccaggcacagaaatggttccgggggctagagattgagatggtccccagccactgtgcagttctaagcacttcagggcccacagaacaaaggggctaatagggggcccaggtgaccatgagagaatggagttgctgctgcccgagggaagagaggactgtctcccatgcccagaggccccgtgggagtggtcctagcatgcctgtccaggataaaagccaatagaggcccacacaagccccaggcaggagggacccccaagggagcagccgctgaggatggagagtccgagagctgcggggctgatggggagcccaggggaagcgt

SEQ ID NO: 1115 - DNA, 491 bp, Homo sapiens
gacacagccaacacagaaagaaagggaaaagattccagagacgttccagcataaggccatgcagggccggctggagctcgtgggcaggggctgccgacctctgagctgggtgtgctgggagccagggatcactgggtgccggccacagaggaaggtccctgaggacacagtaccgaagtctgatcccagaggaggaaggaaggtgggccggggagaaggtctgagtgcagggatggtccaggaggaggactggaagctgcaggatggctgcagggggccgtggaccctcctggcctgaagctcactccttccccgcctcctacaggggcaggggagccagggctgcgagttctgtctgtggactctcaatggctttcactccttccctaggtaactatggctaagagacagaataatttgaaaatacgttctttttcctctttagctggatgtcccacagagaaaatggaataaatgtcatttggactgag

SEQ ID NO: 1116 - DNA, 1594 bp, Homo sapiens
ggcacatagtctggcacgcgagggccccggcggggctgttagaggctcgtggtcatcctgaccatgtggtccagggcgccccggtcctctgggccccgcatggagcgcggcgtcagcgcggacagctcgcagtccctgagcctctgcaggcagttcttggagccctcgggcttttgcggcctctcggggagcggcggcagctcaagctggtactttttccccaacagctcccggcaggggcgctccaggagcctctgcatgaggcggacgtataagtggccactcctctggcgacatcccacggcgggggccctcgcgtggacacccgcccctgctagctcagggctccgatgcgatccgttcgaccctgcatggcggctttcaacccgaacgcgtccctccttcaagatcaagaccctgaacgtagttcaacaagtagttggtgatgatagcgtgccctgactgggccaggatagcctctttagtaaaacagccacgaaagtcatgaaacagatgctcagctcctttcttcattttcactttaattcggtgatgcctctgtgtctgtctgacgacatctctcctggggtctgtgattctgctgatggtcttcagtgcctactgagaagggttcctggacatcatcaggtatgaaaacctcaaagctctcggtcctcaacgtgagaaccctgggccagcggcatcagcctcaccaggaaacctgttcttctgctcattcttgggccccaccccaggcctattcaaagaaagactccaggggcagggcctggcagcctgtgtttccaccagatctgtgttaaagctcaaatgaaccagcccacgtgatgctgaccaggaagcacaaggctgagagccagtgtccaaggcaacggtgcccatggggccagaggcagctcctgcctgtgcagctgtatttagggctgcgttcccctccctgtcctgccagttgacgtcagtgtggggttactcagctaaggccaccacggtatatccacaaagccgtggtagcaggcgacattaaggctggtccagccattgtggtcagtctcctgcgccttctcaacgctcacccctcgccgcaccagcgtccgcagcagccccatgcctcctggacgccctcctccgggacgctctccaagccctcgacgccgtgctcctcctcgtcctggaaagggtacagagtcgtcccaggctatgctgcaggtgtggggccctggaactctttgtagtcagcgcggtcctcctcgacctgtgcgcctaggagtggggacggcggtggcggggtcatgcagcgctcccagccaccctgcggccgggtcccagccagcagcaccatgccagcggccggaggcgtgggctgggggccggggcaccgtcccggaaaaccgggcgcgccccaaggtccctgcttctcgcttccgcgtccccagagaagccgtagctcccgcccccagcccggcagaaacctcctttctttacattattaagtttgttttcattttaattttcttaggacattgataaaatcactttcggatttttgagattaaaaattaaataattttcatcttta

SEQ ID NO: 1117 - DNA, 2680 bp, Homo sapiens
agccaccctcgcccccgccaaaacaaacagacaaaaaactgtcattctcatatgaccacggactctgcgccccggccgcaggcggaggacagggaggagcgcacacgagaaagctcccacgcgcccgcgcctcgcctccgacgggaaggcgcctcttccgaccgtcctggatgcaaattaaatacttccctccgcagaagacttatctcggggtagggccgcagccggatttccaaatcgcgggtttgattttcgctgcgtcctctccgcgacgcgcgcagggagcgcgcccggccacctgcagcctctggctgcggccatctttccgcctggggccacctggcctgcgccctttgtgcccggcccgctccgtgactgttcttcttgccgctacttacagaactcagccgccttagcgtcttagagaagaggacggcatgcatgcggaccccgtccaccacacctggagagcagggagcccttagtccctggacacttaccagggccgccacccctggtccacgcacgtgatgacatctcaccaggggcagcacaccgcccgagtccgcgacactgataacacctcctgcgggcaggagggcgccacagccacccctggtcccctagattgtgtgaggctagcatttctgcccgcctcttggcgtggacagcacgctggaccgagatggaaccacagctttctcttcccaatccctggcctcaccgttttgtttcatacctcaccgtttgtttcaaacctcgtggtgttgaaatgattaaatgagattaaggggtgtgtggtagtgttgggcaaaccacaagaaaacggtctgggtggggtctggccctaaaatcttcctcccccacctcccaggcttccttgccttgctgcttcctctcagcctttaaacaggttggcctctccaagtcctaaaaacaaaattatcaagccaacctcctcctgaagtgctccctccaactagcttccaagtgtttcatgcggacctcaaacaatggtcttccctggctgcctctgcttcctcatttctcaacacttggcattctggcttctcctccccaactctaacccttcaccttgctcaggcaagagcaactcatgactttcattttgccaaaccttgcaggcattcctcaggccttatctctctggttctttctgctacatttgacaccttgggatgactctcaccttctggaatctctctactaccttggtttcagaagagtgaaccctctggattatcacatgaagctacttcctgtgagcagcccagggatggccagtcacttgtgacctactttcagagctggcagttctgacttctagaacaaactcggaacaagcccatctacagctggttgactgagtttcctttgggctcctggcaccagaaagaattgctcactggaaggatcataggtggcactcatgtctcactgccccactcaggcaacatcatgcacgcggatgatcaacagtcagttcctggtcaacataagtaaacaagcctgtttaagataaattcccccacactcccttgtacctactccttgccctctgccccagggttatagaacagctgctttctgctattctccccccaggctctgcagaaccttctgacctttcagaaggtttgcatcctttccctatagtttttccaccgctctgaccagtcccccacaatatatagccttgtatgcaaagccaggcctgtccatgcagggtgaccatccaaggtagacagtggcaaaatctggtggaggcatcagagatagtgccatcagtttgctggaacaagcatatcaaggagcctggcagatctacacttcaccagacggtgcctgtagccaacagggcaggcccttgctccagggaaacactcagaaatcaaaactccttgctctgctgccagggaactctccaggagatcctcagtgtcatcagaagctgaaaaaaacagtgctgagaaacgtggcctgccgtctttccagctaagggagatggcccattcgaccctgggttgtcctctgcaaacgcgctgctgcaggttgcatggcaccatctcctgattgcaatttgctttcctgagggagtgaactgactgaaattggatggtaataagttgctaggttattttccactttttagtttatgaggcttattcattttgctttaacattaaccactgccttccttttaaggagctggtgaggcagcgcatggcaacaggttcagggtgaggagtggcaccacctcctttcagtgaggatttgggaagggtgaaaagcaccctaatcttctcagccgcatgtgaacaaaccacctgtcaaggtgggtccttcctatagggaggttgatgtcagcccttcagggaggtctcagttttcttcctccacttcctaatcccttcattataattccttccacaacagaataagtttcttgagcaatgcagcaatatccagcaattttagatagacatttaccttttgacctagaaatctcacttctacgaatccatcctaaagacacactttcagctggatgtggtcgctcatgcctgcgatcctaacactctgggaggctaaagtggaagaatctcttgggctcaggagctcaagaccagcctgggcaacataggaagaccctatctct

SEQ ID NO: 1118 - DNA, 432 bp, Homo sapiens
caaaaagccgagggggaggagcggcgcggccgtgagcgagggcagccaagtttggctacagcacgcgcggcttcgctcctgcctctggggaggagagaggggacagtcccctcccgagctaggctcggaccttggcccccagagccgccgcagacctccaggggtgacttcgtcgctccctagtctggactcgctaggtcccgggtgcaccggagtcgcgcagcgaacgcgccatgcaggagggcgacatcggcctggaggggctgccccccagggaagtccccacagtcgggcactgtgccgagtggtcggagatcacctcctcggctcctggctcatcactgggaaagatgggagcacccagggactgcagcagctgtggtccccaggtcctcggatacgtcatcctgcagccccacaagggacccagaa

SEQ ID NO: 1119 - DNA, 3662 bp, Homo sapiens
gcggcgttttgcccccgccgccacggctttttgccgctgtcgccgccgctttttgcccccgccgccgcggctttttgctgccgcgactttttgccccggtcgccgccgctttttgtcaccgcgactttttgcccccgccaccgaggatttttgtccccgccgccacggctctgagggcaggagcggcagactcggctgccagctctactggcgtcctggcaagggcagcgccgaggggtgctcctggtccagctctcctggctcagggattctttgcctaggcgccggcgccccgggctccttgcctaggcccctgtggcctgcatagagtggcgctgcctgtggaggcggtgggagagaagaaggagggcggtggtgggggtgatgcggcggccacggagggtggcacaggggctgcggccagccgggcgctgcagcagtgcgggcagctccagaagctcatcgtcatcttcattggcagcctgtgcgggctgtgcaccaagtgcgctgtgtctaacgacctcacccagcaggagatacagaccctggagctaggtgatgatattctgatctatgagatgcaagaagatgtgatgtgtgggacatccatgaaaactgattaatgagacctgacacaaattagagatcaagcccactacgaccaccaccatttttctcttctatcctatttttttgtgacctctagcatgaccatgatgccaagatctctagcagccacatagtgacctgaggtaaatctgagtatgaaaatcatgtgccaggatggtgtagaaagagggttttggatcctattgacaatggaaagttggtcttcctacctctgaacctctttatgtaagagaagtaacctgagttttaaaagccattattatttccattttctctgctgatgcagacaaacacaagtcctaattttatagagacctaatacgttctggacctcagaaagagattcctggaggaaatgttgttttcaaccactaactctgctaatttcaggccaagtgaggcattatatagacagtctgaccactgccacagttgcatacgttctaaatttgaaataaatcccttactctgtatcacttatagtggatctgcttctctgataaaaccctcactaagacaattatcatccactgtttgtttttcctgtggtaagtatatcattgctgtataaaaataaccttttaattattaactcagttggcccagtttagcatcttttccatcttccattctcaatttgataattaccatctttcataataattatccttcaggtttcacaatacatgtatgttgaatgttaaggctattcttcattgatatttacactttgactccatggtgagagaagctgcagtatctgagaaataaataatttgtatgtgggaggtgtgattttacagctagattatagctcagtttctagttctttcttttagagagatttctcttggtcatctttatagaggtatgaagatatttagttttactgttattatattaacattttaaaaagcagctttctacaaggtatggcatcaggtggaattattcttgctgtgctctcaaataatctccatgctaagtttttgggcctcactgcagcccctgaacacgtatgtctctctgtacctcctctgtatgatgtagtgaattttttggacctttgaatcacacacaggctttcttggctgttttataccaaaggactttcactaaattcctaagaaaaatttagcacagccgatgctgttttccaatgccaaccttggagtttgcaatttgcccagacaaaaataccatagctgatggtgatgatgatgtcaatatttttttaaaatacaatttaaaaaatggttcaacataaattatctcatttagtcccctgaacaaccttgtgatgtgattttgaacaggaatatcaagacctcaggatctggcatcaaattctggggtttgaatattatttctatcacaaactatttatattactgcttatatgtaagtgacaacctttctattccttattttttccacttgtaaaatcagaaaaatgacaatgatgagagcaccaaacttatgagcttgcgaagattaaatgtgtgtatgggtttttatcagtttgagagacattatatttccatttgttgtcattctgtcccttccatcagggtaggacctttcttcagtgcattactttgtcccctgaacctagaatggtacctggaatatcattggtgcccaataagtacttgctgaataaatgactgaataaataaatgtaatctgtcaatattttcatctgaagatatgatatctgttttttaccttattttttcaatcatccgaaaggtagtatgcacatttgaaaggtagtcattgttattttcttacaccagtacttgcacttttacaatatgtagcaataatcataagcaaagtatcatgacagagtgagaataaacttaaatctgtaattgcaatttttcttcaccgtggcctccattgtttgtcatgtgtcttggctacgtcaggatggaaagcattgcttttttctatttacaggaccagaattaaatccatgtttcttggctgaccatttggttagtttttgtttgttcatttgttttttcatgaaatgttcatggtggttgggctggaataggtatagcattttatttatttatactcagctgaaactaagagaaatatttcagaccaagaagtggggacaagagcaatacttgtgtaataatacgatgtaccattttacattatttggaagtgctgatgcctgcatctatagcatcagtcaagaaagagaggtaatgaaagagatttcaaatgaatatcagataggctttagtattacataggataagacagacaggattggtcagggtatgctggaaaagattttttatcttattttattggctttatttaaatttttttttttttcccagctggaaatctatttatttatttttcttcagtgttacaatgaaacaacattgctttatttaaattttataaaaattcaaaccatacagtactttataataaaattgactgcctttggctactctatctctatttccagtgcaactgtggaagtggcactgacagatatggttttagctacttagaaatttttctagacacacacacacacacacacacacacacacacaatttatatgcaaaatgctcatatgcatgtcatattttttctttattcagcaagttatagtggatattcttttatagcatacgtagcaatggacttctctttttaaagactgcctagaattctgtagttataatacagtcattcatgtaactaattctctaaaaacaagccagatgatatttactaagaacttactatgggtcaggcacagctctaatagtctaatctcatctaatctcaatacgttcatgagttaggaatggttgttattcccatatgttcccaatgaggaaactgaagcagagagtttaaataatgtgccctaatttacagaattattaaactggtactggaattatgcaaagataatcaggcatcagagtttgtgatgtcaactgttatgtgatactgcaataaacgttgtataaacctctgtaaa

SEQ ID NO: 1120 - DNA, 571 bp, Homo sapiens
gtgcttacaatgtaacttttggtgggggggcctttggacatgtggtaccactcaagctccagaggggttagagactaagggtagtcacatgggtgaacagaatgtccgaatggccaactcccagtaaaaactctggacaacaaagcttggaaggagaggaaaaggcccaacacctgcctgtcagggctcctggatcacgccctgctgcctgctgacctatattggactcgagcccttcttctggcatgctcacctgttaacccacctatcagcccacacctctgactgctggctgctccccattgagcctgaaatactgtgctatctgcctgtacccttttgcataagctggggttgggttatctcagatttctatttgggtcaagattgccacatacctcacctcttctgttctggtcctcatcctgtgttcctggacaaaaataacatttgagtagaaagcttttctacttgttgacatagttgaacagattttgctttattgagatgaaatggagcctaaatttatctggaaatgtgtggaatcagtagagagaagtaaacacaactc

SEQ ID NO: 1121 - DNA, 399 bp, Homo sapiens
cagtgagccgagatcgcgccactgcactccagcctgggcggcagagagagactttgtctcaaaaaaaaaaaaaaagaaaaaaacagtttaccattctatcagaaaatgttgaccaccctcatatttttggtaaactgcagtaatttttccttaatactttttgcaagcttttgcatgcataagctccagtatcacacttaattttgcttgcttgctctctgaagggagttcggatgaccattacagcaaagtggattttgcgttcaaagtgataagccaaatatcaggattttcccagtttctccgtaggactgatgtttagaggaaagccttccctgactcaaatatgtttctccatataaaaaggggaaagtaaaatgggttttctttctggtggta

SEQ ID NO: 1122 - DNA, 4443 bp, Homo sapiens
actttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaacttcacctggccccggtcctggtttgctaatggctgtgggtgggggttgctgtgggtgatgactgactggatacaaaatcctaagtggcttcatgaaattttgcctaggactggactgtctttcttttaactgtgaaatgatggttctccctaacgtctcctcaaaggatacaagaaagttgttgttgctagtagaccgaggggtgggaatcactgaaatggaaaatctagatgacagtgctggggaagagaaaactagaacagctcagttgaagacaacctttactgcatgttgacgctgatttaggcaatagcttcctaaaaatcatgtataaagttagttagttagacatgaaatctcttccccaatgttgatacctgcccacaaaatattctcaccttcagagtataagaatcattcttaaagccaaatattcagttcaaggcacatacgtcatctgcagttgtaaatttgcatttaatatttcacaattcctgtaagagaggctagtcaggagggaaaccctcaagtttaaatccccacacttacttacttactgctcatccgtcactttcgctaagtgagattaataattcagtagctggtccagaacgcacagcttgggaacgcagaggcccaggcctcatgtaatttcccactcccgtaactgaacgtgctgacccatgttgatgtctgccttcatccaggtggcaaatcagacatgctacgctgcccccttcaaacgagttcctcgtgttaggggcaaaggtcacagccaaactctgccactgacagccagtgccttggcctggatcctctctgtggatgcaggcctacccctcctcagtccagcctcatctactagaccagcttggccattcacttttcagatgtctgtgagcagaggactgcagactgaactctcactcaagttcttccatttgccaagcccgaggccttttccggctaaccagccctctctgcgctgtcttgtctcctgactcccaccctcaccattcacagaccatcacgacacagaggatgccatgttcttttagtaattcaccagctccatgcagggacatcacagggctgccctccatgagcagaggaggagggctgcctggcagagcgtttcacactccaggttagccagaaagagcatcttcatttttgtttccacacaacacttctctgtgagcctgttggccaacaaagtggcggccgattgttggaggagccagccaaccatcttgtctaacttcagattcttcagggctagaatatgttcaccccagaggcttagatgaagcacatttgcggctactcgggcagatggtctctgcaacaggaagggaagctgtagctagaacatctgttaacacagtctcaacccaaagcctgctttgttagtgagggtcttcccttctctggtcccaacccaattcttcctctaccctatctcctactgatgcccttcactcaggtgacaaatactgcctgtcccctgcccgtgctccaagcttttccatgtgtacacctctgcatggggcagcatgcattgttgaaatagcctttccccctgggtggaaagcctagtgcctcttgtgcacagctatctggtcccttgaaccaggtaagtagtctcctctatcatttcataactggttgcagctgttgttctaaccttcactgcgcaccaagatagcaggccacgtacagagagcagttaacggagtggcagaacagtgctggggtgcaggtatggctcagctctttgcactaagcctgcccctgagccagctgccactccaattatggcttcggataggtctgcctttgcattcctttatattaatttcacaatgtccagatctgctctcaggagatgttttccatctctctctgatcagttctcagctgcttccatgagctacatctccattaaacatttctcaaaaatgcctccttttctctctctgaatagccttttttttttttttttttttttgagacaaagacttgcactgtcacctaggccagagtgcagtggcgcgatcttggctcactgcaacctctgcctccagggttcaaacgattctcctgcttcagcctcccgagtacctggaattacaggcgtgtgccacgacactcagctaatttttgtatttttagtacagacggggttttaccatgttggccaggctggactggaactcctggtcccaagtgatccacccgcctcagcctcccaaagtgctgtgattataggtgtaagccaccgtgtctggcctctgaacaactttttcagcaactaaaaaagccacaggagttgaactgctaggattctgactatgctgtggtggctagtgctcctactcctacctacattaaaatctgttttttgttctcttgtaactagcctttaccttcctaacacagaggatctgtcactgtggctctggcccaaacctgaccttcactctggaacgagaacagaggtttctacccacaccgtcccctcgaagccggggacagcctcaccttgctggcctctcgctggagcagtgccctcaccaactgtctcacgtctggaggcactgactcgggcagtgcaggtagctgagcctcttggtagctgcggctttcaaggtgggccttgccctggccgtagaagggattgacaagcccgaagatttcataggcgatggctcccactgcccaggcatcagccttgctgtagtcaatcactgccctggggccaggacgggccgtggacacctgctcagaagcagtgggtgagacatcacgctgcccgcccatctaaccttttcatgtcctgcacatcacctgatccatgggctaatctgaactctgtcccaaggaacccagagcttgagtgagctgtggctcagacccagaaggggtctgcttagaccacctggtttatgtgacaggacttgcattctcctggaacatgagggaacgccggaggaaagcaaagtggcagggaaggaacttgtgccaaattatgggtcagaaaagatggaggtgttgggttatcacaaggcatcgagtctcctgcattcagtggacatgtgggggaagggctgccgatggcgcatgacacactcgggactcacctctggggccatcagacagccgtttccgccccgatccacgtaccagctgctgaagggcaactgcaggccgatgctctcatcagccaggcagcagccaaaatctgcgatcaccagccaggggcagccgtctgggaaggagcaagcaaagtgaccatttctcctcccctccttccctctgagaggccctcctatgtccctactaaagccaccagcaagacatagctgacaggggctaatggctcagtgttggcccaggaggtcagcaaggcctgagagctgatcagaagggcctgctgtgcgaacacggaaatgcctccagtctctgtgcgcgatgccctgttgaaccagatggtccacgccttccagcagctgcagcagcatcatggcggcgaggcgggggctgggtgtgttcacacaaagtctgcagtggagaggaagccacgatacttcactggggccatgaggagccagaggtgagcaggccaaagggaagcaggaacaggagatgcgaggaaagaacagcatgtggacagtggaaccacgttcctacaagttcaagaatcagtaactgatggaaattcccgtggctcactcctgtaatcccagcaatttgggaggctgaggcaggcaattgcttgagcccaggagttcgaggccagcccgggcaacatggagaaactctgtctctacaaaaactacaaaaattagctgggcatggtggcatgtgcctgcagacccagctacttgggaggctgaggtgggaggatcacttgagcccagggaggttgaggctgcagtgagccaagatcacgccactgctctccagcctgggcaacagagtaagaccctgtctcagaaaaataaaagaaaatttgagtttgc

SEQ ID NO: 1123 - DNA, 8829 bp, Homo sapiens
gagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttcccgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatcccagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgaggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggttttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaaaaaaaaaaaaaaaaactgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgcactgaaa

SEQ ID NO: 1124 - DNA, 630 bp, Homo sapiens
tttttttttttttttttgtcagccgggttcaatgcgccatattgaagaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtgttcagtctttacagaagctgacgagagatttccttgtattttatggtggtatgattggccttagagcacttcagttttgagatctctgctgtatttgtatacaagtattttggaag

SEQ ID NO: 1125 - DNA, 2908 bp, Homo sapiens
gagctgtcagcaagctccaaaccgcggctgccgcccggagggaagcagacggggagtcggtggcggccgccgagtccgcatgcgcaggctgcaaaggcccttttgggccggtcccgccgcgctaggttggcgagtgggactatttgatcctttccaggttcgccagcgtggtgttacgagaggaaagcgcagccgcagcgtacgaatgggaaggccaaacacggtcccggggagtctgagggaagctgcagggcgcctggaattggggtctcgagtgagccggtaaaaaccgcctcccgctgagcgtcccggaacaaatactgtctgaactgagccgtaagcaagaaacggtcaggagaagctggggcgatctgatgattagaacatttcagggactaccagagagaagtgcgtaattgctctaaggcaggtaggtaattggcctggaaacttgggaacgccccgccccccaccccgactttcagcaaaccaccgtgcccaggaaaaagagcgattgtggaagaccctgtgaagaagagaccaggaaggcactgtggcttaagagagcaaggcgttcctgaatgcagccaacatcaactggtaaacaaaaaactgtgagaacggatcctgaatcttgcgcttaccaggggaaattcaggagagatatgaacctgagcaagatgaggttgaagttactcaatgcggcattaagcctgttcacggccacttcctccggcgtcaccaacacacacactgtacaccagcagtatttttacacggggtatgtgtgttaagtactatcaggtggataattattacttcacctgtatttgctgccttgataccattagagaaactcatgaattataaatagcatagtgaatttgtgattccctgaagatatactaaggtggacttttaaaaaggcttctattccaaagggaactaatatggaggaaatggtttcgagaaagaaaaaagaaaaaacggagtccttgattagttgtggggaaggcaacataatgtaatgtgaagaataaaggagtcagatccaggaaaccccataactattatgaaacatttctaggctgggcgcagtggctcacacctgtaatgctagcgctttgggaagccaagatgggaggattatttgaggccgggagtttgcgaccagcctgagcaacatagcaggatcctgtctctgcaaaaaaatttaaaactagccaggtgcggtggctcgtgcctgttgccctagctactcagggagactgaggcagaggattgcttcaacccaggagtttgaggttgcagtgagctaagatcatgtcactgcactccagactgagcaacagagtgacactttataaaaaaaaaaaaaaaaaaaactaggtttttgaacttgcttaatcaaagaatttgtttaaacttttaagatgcgttgtcagattatctttccctaaaggaataatttctattcctatcagctgtttatattcctgcctagtcaccatcactagatataattgattttcagtttttgccaatctgaggaacaaaaaatgacccttatatgtcaaatttacagtttattttcaaggattttgggattctgatcaaattttggtaccttcatataaaatttggcttttatatcacatcttgtcttctctgctttccaccctcttttatgttgttttttggcttctggccgcatgactataatctccgcttttgtattcacatcaccttctgtcatttttgaccttgcctccgtcttacaaggatccttgtaattaattatattgggcctgctgagataatccaggatattcttcctactcaagttcctcaatttaatcacatctgcaaaaactgccttttgctatagaacaatgacaggagattagaatgtaaacatatttgggggaccgttattcagcttaacacaatacgtcccccttcatcaggtggagcttattttccctccttccttgagtgtgggctggacttagtgactaacttccaaagaacagagtatggaaagggaggaggagagtaacttcatagtacagaaacctggaaacactgtcttggccaggtggtcaaagttaatatcatcaagtcatgttgatagcatatactcccaatatactgtgatgagaagggcaattcacctctgtggtattctcaaaacctataacccaatctagtctaaacatgaaaaaaaaaaaatcaaactaaaattgaaggacattctataaaacacctgatcagtattcctcaaaactatcaacgtcgtggggaacaaggaaagattgaaatactgtaacagaccagaggaaactaaggaaacttaattgatgactgaatgcagtgtgctgtgttgaactggatcctagagaaaatagacattagtggaaaaactactgaaatatgaatagtctcaagtttaatagtagtgtaccattattactttcttagttttgacaaatgtaccatggttatgcaagatgctaacaatacagaaaaataaggggtatttgggacctccctgtattatccttatgcccttacttgaaagttgtttcagcaatagaagtttatttaaaatattgtgaagggcctgagtatttttaaatcaactgcagtgactctcttttgtgtatttgtgtacagatgagtttttctgcatcgaattttatctcctttccttgcagaagaaagagaattagccctttacagagataacagttgcctaagccagctcttttctcctctttttgatgttcttctttttctctcagtttgaaaattgtaggttatttgagtttttaaaatgtctattgctacatacacattctagttatattctagtccaaacaatctagtaaaatatctaaaagaaaaa

SEQ ID NO: 1126 - DNA, 2790 bp, Homo sapiens
tgtttagtgctaaggttgatactaagcagaattaaagatgtgaaatttaataaataccctgttttaagagctttgctaaagatgtgtatggaatgttctgaatgaaacagacttagtaagacatgagtgttgaaaagttttctcagttaatttagcagcactcaggactgctttgtccatgcagatacggctgacttactggggacttttgtttctaacattagccaagcttactgtcaactctgaagagatgttggagttgtcctagaacacttaaacttggaagttaaattgtctttcaatgtgtttggcagagttataaaagtagacatgagccatattgatagcggcacggcatatgaagagcttcagaatacttatgacacttctttgacgttctgtgaaaggctatagataagtacctccaaacatcatgcctccagcctcactcttgcttaaggaaatactctgaaagtagattttctttcttttttgagacagtctctctgtctcccaggctggagtgcagtggcatgatcttggttcactgcagcctccacctcctgggttcaaccgattctccttcttcagcctcccgagtagctgggattacaggtgcccaccaccacgcctggctaatttttgttcttttagtagagacggggatttggttgtgccatgttggccaggctggtctcaaactcctgaccgcaagtgatccgcccacctcggcctcccaaagtgctgggattacgggcatgagttactgcgcccagccaaatatctgttcttttagctctttgatagttcctttgtagtgacaaattattttttaaaagcttataaattggtgtttctgtggaagatgttatttctcatcgaatgcgtattgatagtgttttaagtttagaccacaaagtatttgtcttccatgtgcctgatatttacatagtactctaagctgcactgttgagtactgtagcatctagcttatatggctatttaaatttatattaggctaaaaattcaccagtgcagccatatttcaagttttcagtggctgtgagtggccaatggctctgttgtattggacagtacagatataggacatatgcagaaattatcattggacaaccctgctgtagaatgtcaccagtgtttctggaatcactgttttcgtgcttgaagtattttgtgctccactttgaaatgctaggaaatcgtgtcttcccttcacattgtaaactcttggtgattattgtggtctttggaggtgaagcccttgggcagaattgggatgggagtggaaagtaaactgctttgctgtggactagaagtagaattgggatgaggtgttcccgttctcatgagtcccttccctgtctgcactgttccctttccttgtgaacctttatttcccaaaccccttcttcaccttttccacctccagcctgtgcagaggcagatagatactggggacctgttgtactttgttctgcatcttcactagtggaaataagagttctcttaggctcactgctcgggggtggcctgtaagatgttcttgagtctagtgctttctcttttaatttgggtgccttgtgtcattggatgtgtaatgtggtctcgagctaaatgtgcagacagcagcatctgagacatatccagagagcagaggcagcatttctttgaattcagcaaaaccataattattgtgttttcttttcagaactgtgttttacgcaaataatcttcggcaaagtcttactcttattgtagatactcattttaattctgtgtgttaacttgcaccacagttttgcataatttactatcctcctccagaaagctctacagtgttccattggtcaacgcttttgccagtaatgtcagaaataatgggttgggtgatcttactttctatatttaaacaaaattttgtcaattttcagttagttgcttgttttccctgaccactgggctatctcgtatttctggtcttcagtcatgttgttccttttgtgtggtgtaacctttagcatttacgtgccttggccacctctcgttgcttagaacagacccaatctccagaaggttttctgggtgttcttcttttccctcgggttcccctttgctgccccgagcaccattgtgtacctcttgccacagtgtgcttttgttactccatttcacagtaggttcctctatcagcatcttgcacagttgcctagcaacatagtttaatgtgttggaggcaagaagggaggaaattcacaccatgttcatcctactcagtgtgaactgagtctatagttgatatcctctttgtgtcactcaatgttgtcctgcctgagttcaggcttggttcttacgttgcggcagctcttttgcctttatttaggcaacagaccagaaatagaaacccttgaatttttttttttttattcctttattttccttgccagcaccttggttagatttcttaactacttttttcttgagtctttgtaaagtataattacactttactgtgcttacgatctaaagaatacttaatcagtgttattttttatttttatgttttatttttgtattgattaggtcttgccatgttgcccagactggtctcggactcctggactcaagcagtcctcccaccttggcctcccaaagtgctgggattacaggcatgggccaccacacttggcctcacttttatttcttaaagtcactgcccaataaacattccaagtttccactagtttttgtttttggacatttgttccatcc

SEQ ID NO: 1127 - DNA, 701 bp, Homo sapiens
ctggttcctgagtcaattccatccaggtaggaggaatcctatcagaaagtatgtgagtgcgtttgcagagtgcattcctgtggagcccccttatctctggctgcatctgcttctgcagggagaaagtatccctgctgtgagaggtctgggatctggagtacagaggatggtgaagccaaggcctgaagacctttcctgcaaggtcgcagaggaagaggcagaagaaggaccagaacccagctcccctgactccctatccagtgctcttctcatagattacattgcttcagcatccacctggctattgctccatccaggggttacaggagtcactgactgttttggttgcttcttggttggaggatgttgtgcctcaccgatgagagccggaagcaaaggtaccagttcttagaggaagcataggaatgtgtcccttcctgctcgggtctctcaactgaactcaacccttccttgattgattgacaagcatgttatctctcataatccctgcccggtaagggctgatgtccccattttacagatgaggatattggagctcagagaagtgaaatgattgctgaaggtcacacagcctggcttcaagcctctcgggctccaaaaggcatcttctgttctctccgtcaggaagcctcttttggatgattaactgagattaaaaatgaaaagacacatgaaagaaa

SEQ ID NO: 1128 - DNA, 594 bp, Homo sapiens
ataaagacatgatcatctggaaacatctgcaagaaaatctaccaaaatgaagacacactcacaaaatgaccttcctcctacatcccagctcttgtcatcttaaaggcattcactccatggaggccccaggaggcgaatggcttctctcatcttgggctgcagctttgctgatgacttctggctcctcatggaaaacagaagtgcagggcatgcttttccattaagctctttctgctaaagcagattcgaagttaagagaagcaggcactgctcattcttgtccaacattcatggacaaagaactctgggcttcagtcttgtcaaccctcgtgcagggctctgctcattagcaggaatcttcagatgactcatattcctgggcatttgatcttttgtgataagaagaaccagcctggctcactgactgagtgaacacttcagtggtctgtagtccctcagttgcactggacacagttgaggccctcaggagccacgcggggtcagcggtggtggcattgggcagagcagctcaccgagttccagaagctgcatgccacccattccgagtctgtgaccctccacagcctggcccac

SEQ ID NO: 1129 - DNA, 465 bp, Homo sapiens
ctaaagggttaagcattcttaacacactcaagtgttttttttttctgcatgagacaaacaaacaaaatccttaagagtgtttttcttgggttacaaagttatgttaaataaaaataaaaatggagggaaaacctttgcttctgagccaatggcccacaccagctcaagaaaacttataaagaccgattctggaaatgtcagaaatgaagcttgagctttatttccttgtaagcatgactcagcacatgcagacaatcatctattacctacgtaacctgctctgatcatcctaaaaggaaagatactgtaaaataaccaatgagaatcaagatgtatgaacttctttttttccgttttttaaaccttaactataacctttaggagatgagcttcttgccattttctattttggagtctctgttctggaatagtgtgttctcaataaaatattcatgtcaagtaaaa

SEQ ID NO: 1130 - DNA, 539 bp, Homo sapiens
acatctgggctgctagctgcatgaaggagctacccgctgtgggtctcctctttgctgacagctggacacttgacagaatgacctgcctgaactcgggacctgcagaatgatgggactgaagaagctgtaacacaaacagggctaaaacacgcactctcctccccctgctccccaccgccccacccacttgccacattggaggtgatgagaaggagagaagagctgtggcctttcagggagcatagtcccaggggctccctgagccagggctgtgaaaccctcttccgggcactgcagttcctggcatctccaaacttctgagtgccaccgcattccccgcgtccggatgcagaaattgccacaaccatctccagctttagcaatgaccatcctgatcagacagtggccatccacagtgaggcaagaccctctaccagcaaaatgaatgcaacatgctaaaggctcaggtcaatgcacagaaagaaatctctctcctgactttagtacaatggcacgattggtggccacagtccaaggat

SEQ ID NO: 1131 - DNA, 682 bp, Homo sapiens
ggcgcctgtgtcttcttacacttctcccttttcctcccgccttgcttccctcctggcttcgctccggtctcccccagtggcctgtggcattgtaaaagcacggcaaggagcgcagcggccagaaacgtgggggcgcgtggaagggcagtgagcggcccgcgtgccctgtgctccgcactttcttcagggtttccgcgcagttgaaacattggcaacaatggataagccgctcctcgctaggtaatttccggccctctgggcaggtaggggcggaaacgaccgccacgggagccgggcatgaggcacctgctgagccacacgcgggcctcccgctttaaatttgaatccgagctaatccccgcccccggctctgctagtgcaggagacccggccccggcaaacgcgagggggagtgtcgtgtgattgttttaattagccctaaatctcttctgctctacttgcttctaacgccaggctggcttcctcgggagctaggcgtcttattaagtcgctaatttccgccctacccttcctttctgccttcacgcccctctaacgccgctccccccaatcgaaacagaccccatattctgaggcttccccccgcgccttcttcccgccttggaacaccttttaaaacctagcagtaagctgatgactaataaaaatgtcgaaatcgtaa

SEQ ID NO: 1132 - DNA, 268 bp, Homo sapiens
cccagaggcgcacaggagacctcaggcccagactccactccccagctgtgaaaggactgctggccagacccccaagctagcccgccaggcctccatagagctgcccagcatggctgcatccagtaccaagagttggtgggagacgggtgaggtacaggctcagtctgcggccaagactccgtcctgcaaggatattgtggctggagacatgagcaagaaaagcctctgggagcagaagggaggctccaagacctcatcaacaattaag

SEQ ID NO: 1133 - DNA, 614 bp, Homo sapiens
cccttcgtcgccgcggctctcgtccgggacacggctttccggagtagagcccttggaggtgttaagtgtgatgcttccataatacatttggatgctgtcagctaagttcacttctgaactaaggggttcctccaaatgttggctgaaattcatcccaaggctggtctgcaaagtctgcaattcataatggagctactgtactggctattggaaggaggagattctgaagataaggaggatgccactggaaatgttgaaatgaaaaatattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttgacttttttctaaaatgtctttattggattgaatgaatgtttatacctgaaaaaaaaaggttcaaaaaaa

SEQ ID NO: 1134 - DNA, 233 bp, Homo sapiens
aagagaagctttactggtgttccagccctaagaaacctttgttcaagaaaacggcagatgctctgttgaatccactggagattgttctgatactaaggacaagtatcaaccatctttcctgtgaaaaattccctctcgtactttagttctgtggatccaaaatttatagcattcttctaccaccacaggggctcatatgacattaacagacaagacacttttcagaaagacag

SEQ ID NO: 1135 - DNA, 498 bp, Homo sapiens
cagtggacatcattgtccagtgtgggaagcctggccccactcagaccctgctcaccctgctaccgacccagctgccatcttcctcagactccagcaggccctccactcctagcacacaggccggattgaatcttcaggaaagaagagcacacccagggtgggacctgaccttcccaaggtcacacaactgcggagcagcagatctgggtcctggatccccaaactctgatgagatgcaggccgcttcttgcccacacagcagcgtgagctgctgtcctgcggtttgaaggaccatctaggtggcctcgcagactgacctccaggaagaccagatggcatcctgctccacacgtttactcttggtgactttggatcacttggttaatttctttaggctttatttcccttatctgtgcaatgagattggtgatgttgtgtttaatggagatggtgatgataacagtagtaaaacacattaaagagcctggccacgataaa

SEQ ID NO: 1136 - DNA, 2380 bp, Homo sapiens
aattcagattctttccttagcttctatttccccatttgtaaaattgggatgatgaggacatcttccttgggtagctgtgacaatgaaaatgggatcatcatgcatcagccttagccccacgagtgccacagtaaactctcaaagaatgaagtggggtttagaccctaaatgcttcagtgtgagctgtgaagccccacagcttggctggatcaatctggacttcgggcagatgcgcactaagggctgcttacctagaggagccacgtttctcctgggcagtcaagataactgccagaggagccacatgctgggtaaatcctgaacccaaagtggaattttgccctagtataatgggttcatattcgattggctgcacttagctataaatcctgaggaggagaagaagaaagacatcagaaagtaattggactagaagaaccttagtttggaagcaaaacacagaatccagaaactatgaagaaatttacatgcacacatatgtatacaagccatgagagggaaatgggaatgtacctgagagtgtcgtcaaagcgtacagtggctgcacagtgaaatattatgtttgtacaggagagaagctcctgcatgtcctctttgctgatggcaaagtcattctgattgagatctgcataaatagctctgatcttctcatgcacatttggacaaacttctttgactttctcaaatagctgaaacataaatatagatcaatatacaaaaaatagcaccatcattatcacattgttcttgtttataacaacctgcttaattatactcaaaaactggttttagttgtaataacattacttaaagaagacatctggctgggcatggtggcatatgcctgtaatctcagcactttgggaagccaaagcagggagatcacttgagcccaggagttcgacaccagcctgcgcaacatgggttctgtggactctttcactttggcctgtgaagacttctgactactggaaagcaagaagtaggagatggtttcagcatccacccttctcacgatggggttccttacatatgataatctgatgcctaccagaagaaactctgacccagacaggatcattgcataagaggttggttttagaagtagagttggctgaaattaaagtctcgagtgacatgaagacagtgttaaagataaatccaaactcttctttattgcttgacacttttccaatcagcattgacttcattcctggcaagctgatgtaacatgaatgagttatgaagccaaagatcgcaagaagagcacacttcttaacagccacttcagaggtgacagccagggaataagaaataaggaagaactttccagaggatggagccaccacaaataataatggaaaagaaggttcctcccagagattagatttagaggctatttaaggaatttccccactcccagtgtaggaagcttctcaatactcgctaatcaggatttccttatggttatattctagggactgctgcttgcctgcctgtcttctcttttttgaatagaaggtgtctttgtttgtttgattttattttttcttcaacttcgctgttctacaatgacaagagatagaacagagacattttctacctcaacattgggaggcagaaaattcacctttttatccaagaataccaaaccagaagctgaaatatctggatctgatagagaggatagtctattcccccttggactttggactggatgcaataatggtatgagaccctggggtaggaatgagtgtcttctatgtgtgggaaagagaggaaagcagatatttggcgacctaaaaagaaggccatggcagaacctcattagttgttcaacaatcctattttccttttctcctggacacacagctatgcattttccagccatccttgtggttagatgcccagtgacagttctgagaatggaatatggacagatgtgataggcacttctgggcctgggccacaaaaaccttccacatgatgtccagtgcctcttttaccccactgacagttttttattgtcatccagagagaccttggatggtttagaagccatgtgtagaagatggcaaccttcccttagcatggatccttgaatgactgtggagtgcaatgccttctaccaattacacctactgtgtttgagaatcaaatttcatttgtattaagctactgatttggggggtttatctccttcagcacccacattagtacaactcatgcagaatggagagttaatgtgaacacatatggcacagactggtgaaacctaggactttaagatgatagatgaatttctgattatactttcctttcccgcaaaaagtttttttcaaattaaatgttgtaatat

SEQ ID NO: 1137 - DNA, 2054 bp, Homo sapiens
aacgctcatctggctgtggcagcctgtgactgaatgagagaaaagtgccctagaagctattcattacgaattcactggaagctctcaaacgaggctggcagaagctgaaattgaagtggtctctgacctaattttcttctgcatgaaacatctgcatcaaggctctctttgatgtattccacttggctctgtctacgggattgtatcacatggactcggtgttgcctccttattgaaagacatttccagcctttgcaagatggccggtttgacacaaattagaacaaccttgatagctgtcaactggagactatctgagaacaaaaggacattattgcaaaccagcactggagcaactctgaaagaagataaaagtacatgaagaaatcatttgcaggcactggacaaaaaagagtgcaaaactataatcttgagagcaggacacacacagtttgcagcatcacagaaaatgatgctctctcctgccaagtcccattttttgggaggaggaaatggattaggtcctggaggttgtcataaatgcatcaagtgactttctcagcatcatctgaaacaattgaagatcctaaaaaaatgatagcagcttttaagaaggactatagtggaacaagcaatattctaagtgacaagagacacagattctagaataaacttagccaaatatgtatgaactcgaacaatctcctttgcctctccaggttttaatttccccatctttacaatggaagcaatgacaacagcagcatgcagctagtttggagattttgaagtcagattggctatttagcattaacccaccatggtgctggttgatcttgctagatacaaatctgtcataagtgaaagcatcttgacggtgtcttggaagctgactggaaaaatactgcttttagcagtacctttaaagcaacaggagcttttctgcattgcatagagacagaatgagctttgtgtaaactgtgctgtagccacgttattctgaaagcccattgggaagatgccaatagtaattcagctcaaataatctctattagccataacccttttggttgcaagagacaaaaacatgactgaaattattttcggctagaaggatcgaggagacttgcagcatagctttgagaacagctgaaattaaagacatgaatgctgcaagtgtctctgccactctttgtgtattaactttatgtgctcagcctggcttcctccacactgcaagggatatggctgttgcttatattttcatctccatctttgccaccagagagggactgccttttgtcttgttccaatttgggaattcctggggaaggactactctggcttgggtcacatgtccacaccctgaatcaaacatctgaggtcatggagaagtacactgattggaagatcctactaatattaaaaagtttgaggaagagaagcaattgcctctataaagggatgctactcctagaaaaatgatgggtgctgagaaggccaaatgatcagtgcctactgaactgtcccataggtatttaggtagatatgggtaataaagttcttgtgaactagcccactacatggaatgcaatgtaaggaaacacagcttggttctgacaccaactagctgtgtgaccttggacctcatcattcatctctctgaattttgattacttatataaacaactgtcttccccctcaccccgccttgagtagggctctttgagattggacagaagtgcagccatccagcccagaacacaacaagaatagagttgatgagccctcttctcctcaacaaacacctgtgatgagaacattgaggcaagggaacaggtggccaaaaataccctcatagccttgagaaagtccatcttgatgttatccagtgaaacttaatggcaacgcaggagccagggagcctgctttattttggaaatgaaaaagtcagtacagttgatgagaatttgaagagaaaagacacaacaaagtagaaggctaacaccaattccaaacaatagtaaagaatcataataaagttactatgaatc

SEQ ID NO: 1138 - DNA, 565 bp, Homo sapiens
actcttgtctgcttacgagggctcctcccttcagctttggtccctcggggcgtctgggcagcctacgctttccggtgagttttccagttggttctttggaagccgttttgcggtgactggttttctgctctctctcactgctccgagtcagggcccacctccttgaccgacacctcacctccatagtccacataaaagactcctgacaggttctggaggcagccgacgccagcttctgttcccctccccagcccttggcagctcaggttccgcgggaggacgttcacctgcttcgcggtctcgtggaggtccaccgcggcggagaatcctaaacctcacctgtgactcggcaggatgagcggccagcactcccgacggaggccctctgggagaaaagaggcccttggcctcgagacccaggaaagcgggctgttcaggagttggttcgcgcagttacaccgaaagcgccgtgggcctcaaagccgcagcccggaggataaaaatggcagaatgaaagaattatgagtggaactagagaataggaaagacatgaaccaacgcccaa

SEQ ID NO: 1139 - DNA, 3142 bp, Homo sapiens
tatagaatttcaaaatgaaattatttgcccgacaagaaggcatcattagttagacttgtttcctctgtagcccgattgaaattctcagtgttaagtttaggacccaaacaccagctgggacgtaagagcaggaccgaatcaaccttgaataaactgtatatagaaaacaattgttagttgattaagtagacattggatgtttgttagaaaggaatgttagttgtaagtgacatgttaagatttatacaattgtcaaaaacttttaggaaagattccagaatgcttttgataaaatttatcgattgtggattcacagtgtgataattaagtagggatgttgaagtcttgccaagttttcctggttcccttctcaaactttatcttcccatttctagccctgtctctctatcttacaggcatctacacctcagcaagtcagaaactaaacatcatctgtctctccctgtcttcagaaccccaaccctcataatctccttccagcttccttatttcccttaccaggactggcattttctgggcttggaatttctcggtcatcctctttttttttgttcctcgtgctgttgtcctcgtctcccaacccctaaagcctagtaggtccagtgtcaatgcattaaccacttctgttctgatttccaccacccaagtggaggccttcataacctctcagacgtcacggccatgatgccagttacattatgcctagttaatcttcattcagactggaaggacctgcccccagttgtttctttctgaatagattctactctccttcaacacttccaaagtctcctgccccaaagaggcttagttagtcctgtggctggatgtgactccaacttccttttttgtaccatcacatctttcatatctttctggcatctgccatacatcataagaggctttgaccactgtcctccactgaatagcccattacagctagcacctaatagttactcaggaaataaatacatgtttaacaggccaggtcgtagagattatttttctttctctgccttttcatgtgctgctttcagaacagagggctggattggatagattagtatgatctatcctggagattcatttcttgcattaagagcttattttgtgtgatattatttataatccctgactatgtcaattataaacttttaaattatgtcttatatttgaagttcttacctacatatcagaggaaaatataatgtttatttctaggtggtaaaacaatcttctggattcttttttctttacttgtaaattatcatttaacaagtctatattgaatgccgataattttctggaacaaaacagactacattcccttggtaaagccagacattaaacagatactttcaagcaacagcatgccatgctcagatttaagtttgaaaaatattctagctgcaatggatagcctagcaattttcaaagtttagagaagttattaatattagccctttgtagtactcctgataaatgaataacaccctggactttcaaatagtggcactgggaaaaaagtaagtagaattgagagatggtgaagagataaagtgagcaggacttaacaattgctggactatgggatgagggagcgtagagtcaaggatggctctcagtccctaggtctccaggtctaggaagatggtgttacctttcactaagggagagaactgtaagaactgctgtgagaggaccacaggagtccagttttagcgctgaatctcaggtgactgaaaagcatccaaataggaatgtcagcaaggtaatggaatatatagttctcagagaagtaacacactgtacttgagatgtacacaagttaaaggcaaacattgtatatgaaaagtgatcaaaactacatgcttcaagaaattaaaccttgaagaactcaacagttaatgtcatatatagaaaggcaagtcagttaagagtgtaaatagaaacgggtaaatacagaggagaaaaacagtaagcatggactgtcctagaattcagtggcagagcatactgcaagaaagctgatgtggtcaataatatcaaatgccgctgagatcacataagtacagaatcatgaccttaatggtttgacagtttggaagcaccctggcaacaagccatttcagtggaatggtagaaatggaaaccacgctgggttgagaagtgagtggatgtgaaaatatggggcctctgaatggaggtaacccttgaaaaattccactgtggagaagaaaggagagagagagggctggaatttggaatgaaaggagatatttgggattattttagtaagaaaacagaggtgtcatgacctcagtgtaaccctattagctgcaaaaaattcttcatgggcttgagatggagttagccatattcattattgaaaactatgttctgcacttatacattgttggttggagtgtaaattagttcaaccgctgtggaagacagggtgggtgtttcctcaaaaacctaaagacagaaataccatttgacccagcaatcccataactgggtatgtacccaaaggaatataaattgttctactataaaaacacatgcacacacatgttcactgcaacactatttacaatagcaaagacactggatcagtctaaatgcccatcattgatagaatggataaagaaaatgtggtagaggtacaccatggaatactatgcagccataaaaaagaatgagatcatgtccttttgcaggaacttggatacagctggaggccattatccttagcaaactaatgcagcaacagaaaaccaaataccacatgttctcatttataggtaggagttaaatgatgagaacacatggacatgtagaagggaacaaaatacactgggggctattggagggtgaagggtgaaaggaggaagaggatcaggaaaaataatgagtaccaggcttaatacatgggcgatgaaataatctgtatgacaagcctctctgacacagtttacctatgtaacaaacctgcacagttacccctgaactttaaaaaaaactatgttctatcaaaacctgcctctcatttatgtattaggaatcttgtgacaacggaacagttgaaaaattaaaataaaaattgcctgaaaatgca

SEQ ID NO: 1140 - DNA, 756 bp, Homo sapiens
gcacattcctcgcattctaggattgagatacacagtttggttcttgtgagggcagccagggctggggaggagggcagagaacatcccagagatcaagactgctcttcttgctccctccccgactgacttggcccacactgactggcctgccacccctttacagtgatctccacccagtctctctctgcaaaggcctcccttggctctctgataaagttggagctgtgggtgcagcatttcacttggacctagcagcatcaatgagccagctcctcactggggaacatgcaaacccccagctgctggtgtgcaggaaaagaatccaggagatcacctgatgaagcccagcattttacagataggcagtggagcaggggaatccagttgacactgtggctaaatttcagaaaacctcccatgagatcttgcaaaggagatggagaaaatatggctgaatgccagcaagagcaaagtggtgaaaggaccctggtgagaggcccaaagaacaggaggtgtgagccaagagaaggtcctgccaggcctatgttgcaggctatttggaggctgaacttgaggttgacgcagaattaactgttgcatgagatgtggggtatgagagaaggcctgagtacctagaaggattgggatgccatgaactgacagaggttgtgtaatagtgtgatataataagaaatacatggtgggcatggtggctcaagcctgtaatcccagcaccttggccaccactgcaggacc

SEQ ID NO: 1141 - DNA, 857 bp, Homo sapiens
atcaacttgtaagagagctggggttctcctagatccatgctcgcactgagggaaaacccagtctctctcggcgctgaggagaaaacatggcacagcccttctcagtcctctagcaaccctggactctgcaggagaaaagagagattccctacatttgtttctatgagagaagggaaggctggagcaggggagtgggggaaatctctgcagtcctctcggaaagcaaacccttctacacctgtgatcccatgtgatttagcagagccctgagttaaaactaggccatgatgacacttggtgacacaaacatctgacaaaagagctgtaccctttatattttcaaagactttctacaaattaaggaaggcagaagacccatttaatgggcaatggacttgaagagacactttaccaagaatatccaaatggccacaaacacacacacatacacacaaatgggaatgtgttcaacttcattagtcattatggaaattaaaccacaaggaagcaccagaacactgcagcagaagaactaaaatggaaaagacgaacaaccaactatctgcaagaatatggggcaaatgaagcttcctcacattgctggcaggatggtaaactggtaagctgctttgagaaatggtttgtcagtaactacgaaagcctaaggtacgtataccatcactcagcgattccactgctaggcagacatctgagggaaaaaacttcctgtgtgctccaaaagacatggacagaaatgttcatggtagcttcattcatagtatcccaaaactagaaacataaaatgttcatgaagggagggatgaaacaataagttgtaatacattcatgcgataaat

SEQ ID NO: 1142 - DNA, 264 bp, Homo sapiens
gttcgtgctgaaggcctgtatcctaggctacacactgaggactctgttcctcccctttccgcctaggggaaagtccccggacctcgggcagagagtgccacgtgcatacgcacgtagacattccccgcttcccactccaaagtccgccaagaagcgtatcccgctgagcggcgtggcgcgggggcgtcatccgtcagctccctctagttacgcaggcagtgcgtgtccgcgcaccaaccacacggggctcattctcagcgcggc

SEQ ID NO: 1143 - DNA, 400 bp, Homo sapiens
aaggcttgcgagcagaatgccttcgcgatggacgcccgcattccacccccttgaccgctgggacccctagtggcgggtgggtggagcgcgctccatttacctgctggttacctcgtgaggcgcctcagtgaaatacttccaggccttcgaaaggccatcctttggacacatgtaaaaagctgtcttgttggcctgttattcccactgacccgtctgagtgatcacccaggagcgcggcggcagcaagcagagctcaccggatttgggacaaggattttaaaggcagctacaaagctgagctctatttgctgatgatagtctctgttcagctgtttaaaatgactgtctgactcaccatggtaatttttcacaaattaaagacacattttgggttgtgcaa

SEQ ID NO: 1144 - DNA, 2530 bp, Homo sapiens
agaacctcccctcccccgccggggcctgggcgcgcctgcccttcgctccccgacctcctgctgcagctctgggcccctcggccgctccctcccctcctcccttgctcaccccacggttggccgcggatctccagcacgccgccccagtcctcggcgtcccgcagcgcctgccagggtcgccgagcctcccctgcctcctggccgcctctgcagtgccgtcctcccggggctggctctctccccaggcccccgctttggccacccaggcactttccgccctgagcgtggcagctgctgccgggggtcctgggaccgcgggatgggaactcccacgcagcgtcccacaggctcctggccgccgcgagcccgcgcgactcgcacgagcatgtccacccgcagcgaggggccggtcactgctacggagcccgccagaaggcaaagccccagacagcaaatagggaggcggctggcacccagggaggccgaggcgggaggatcgctggagcccaggagttcgagacctgccttggcaacatactccctccagcgtgccaaatgctgctaatggacagccgctcctgccgctctgatgttgctagacctcctcagcactcagcccaaggcagccaggaagaatgaacgaatggtgattcagagggaaaggaggaagctgcgtggcatttcagagatacttattttaaaactgctggtggccatgtcttcttttcatatcagagctaatgagttttgatatgtgaacatttcttctccttcataggtaatgtgttgatttggcactttaatcttagaataatcatttctaaaaccaacccaactgcttttctttacaattttggccttagcaaacagatgagtccgttgacttgagcattgcttgggcactgtctgtgtgcaggtcaggcaggggatgctggtggctgggaaacatagaggatggaggtgtcttgggtgtacatgaaggggtggggtcaagtccacagggggtcggcccctggcagcagtcctggagggcttcgtggaggaagggagaattgagtgagaaagtggtccccaggtaagagggaagagcatccagggagaggagactgcttctgggaagaccagaggcatcacctcgcaggggctggtatggtggtggctcaggtgggaggaagagagacctcagggaaaataacaggttccattgacaggaggcctgctctggtggggaggcaggctggtggtggagtcatggctgcaggccagggagatgcctgaccaacaggtgtgttggccagggtccctgtagcaaaaacacggagctgaggacctcatggcagggaccccatgcagagggagccgcgggtggcatggggatagtcacctggctctcctgctctcggcctcctgcagctcccctcactccctgccctgccacacaaggtcaaacccaccaggaggcagaaggcgaagggcgaggtcccagggtgaggagcagggaggagatggtggcagcagggaaggtgatgcctgctgcagagtgagacctgggactgccaaacacacagtgacgggagctgaggaggcctgccgggggaggaagacagtggctggcagtgacaggaagggagggtcagcatggggcggcagtcccagagctcagggctccctgccaggccagcctttgtggcctgtggggtggaggtggcaattgctgtcatgtcataaacacgtcaagcttacaatgaaatctccagtgtggcttgggagcaaatacatgtgcaggtgtttgagtatctgtgctcttacctaacctcagggagcaggaaaacgaaagcttatcatgtaaacacatcagcagcagggcttatgtgtgtctccacactggaacccccaagacaagagactggaggcagagttgatttccaagcccagagtgctgggcagcctttgggttttatgtctgcttgcttggagctcagtgatagaaatctaggccccagaagaggaaaggactgtcctgcataaccagcacacccggggaatgcttcaggtgcagctggatccaggcatcctcaaatagtgtgattaggactccactttcctttgtcaccttggcttggctcttccctgctctgtgttgttttcagacgaggtggggccccagcagctctggtcctcctgacatcctagagaagagccagcccttccctcctggggtctacaccgtcccctaagggacctcagactgggctgatggaaggtctcaagcaggccatgtgaagggcactgcacaggaaacacagaaacgggaatcctataaggtcagcagagctctgagccctttgttcttgggcctgtttttatgatcctccctctacatgtagctcacacttccctgcttctgtgcaggcaccaggtgagggggttgtcatggcctcctgccactcttgaggctgtcagatattacctgtgctgtccctgcattctcaagctccaaattgtcaactaagaaatggtcacttaaaaa

SEQ ID NO: 1145 - DNA, 1360 bp, Homo sapiens
cactgtgaagaatctgatagtcgaactgaatgaagccaagtccagtctttacggaaaaatttacacaacacttccagcagtgacctgagaagctacgtattgacacggcgctaccacgggtggaggagcctgcattgctgaatcacaggatgaaggcgaatccctgccagcctccatccatctctggggtgcttagcagaatcctcagctcacaagatgaataaatgcagactaaatgatgcacaaataatcttcacacacaaccatcaacacatggaaagactgcaggacggccagatcccaagctaacaaacaggggaagatgatgtttcaaatgatcatctgaatgctgggtttccaccttccaccaggaagtcatatggtaaaaagaaaaaaaatggcattatgatacaaacagaaaatgtaacagtggagtgcagaaaatacaaaaaaaaggaaaaaataaatagaaaatcttcaaagaggcaatctgtttaaatcttcaagaactggaaacagtaaaagtgaacaggtttttattgagcatgtcaataaaatgtttgcataagactttacaagtgctttatttcatgaggtttttattattgatcaaagcaacgaaaatgaacgggaaattcattctcatcaaatctacaacttgggaggaggtccgatgaaatccctggaagctcacattttttataaatgaagagttaattaccggtgggaacaatgagaacctctgtggttcttcctgatgcttggatcctcccagacctctgtttccagtctccttctccacaacctggcctatgcgatgcaagtggtctaactgatctccgcctagggaaggatccttcggcaacttgccgacaagagaagcagcgatgcccgaggcaggtccaaaggagcactgactgcgtgggattgattacactggaggaacaaaaggtcctgtggctacacaagtttgaaaagcagaaggtacaatcattgtatttctggcagacttttcaaagactttaatatatgaatccctcatatgaatctcctggaggattatataataggcagatctcccagccattttcactgaacagttcttagaattggtatccttgaaaaatttcacctaaccactcaatatggtagccactagtcctgggtggctattgagcacctgaaatttgcctagtctgaattaagacacattctaagaataaagcacactgtatttcaaaggcagtacaaaaataaaaaagaatgtaagctgtctcaataataatttttgtattgaatacgtgttgaaatgatgttatttttgatatattgagtgaaataaattgtattgctaaaatga

SEQ ID NO: 1146 - DNA, 738 bp, Homo sapiens
cggcctgccgcggccctgagctcacctgaggcggaggcgcccgcgactccccgccagctccgccagtctcctccagccccggccctcgggcgcctgatccaggagctcgctgagcctccgcagcagcggctcccgcaggcggttgagggtcgcgccggccggaggggcgagcagcggccccgtgggggcggccgagggcggcagggcctgtagcgggtcccccaacagcgacatggccctcgccggcgaccccggactgccggggctcccgcccgccccgtcacgggcctcggccccggggcaccttccgctcgcctccgagccgcggaggcaggggcggaagaacaaatctggcagcgcggcacggccctcagaggaggaagctccgctccccgccccaattagacagcaggaatcatctggtttacaccgcgtcagactgccgcccgcaatctccgtcatcaaagcaggcaaccctgtagaggatgcctttccctggaatgatccggaatggacgacacctgagctctctctgccaatcttagcaacatccaaggccattatccctttgaaaactatggcttcgtttgggacaaaaaggaagtaacttacgaaatgtgaccagtcaggtagttccctacacgaggcttcctggcccaatttctgttgccattagcttttcatcacccaaggccgcaggattttctgaccagtaatttggatacctatattcttata

SEQ ID NO: 1147 - DNA, 755 bp, Homo sapiens
attggtttgccatggctctttgaaacagttactcttgtcctcattgtagagatggcgatactaaggcagaatatggtaaggctagcctggacttctttttgtggagactggattccaagattgaaagtagaagctacatgttttctccaagcagggctttcagacttcacttctgcaacattttattgatgaaagcaagtcacaagaccagactgattcaaggggtggagaaatagaccctacttcttgatggagggaggagtagagttacattgcaaagggatctggacaaaaaaaggagtgatttattaggaatcatgtttaacaatttaccacaatccccagcgcaactgcctgttagctggatccagaaatgtctacgactactgcaatgccacttggccttaggggtgatgtgacccagtgtaaagagatggtggtcttaaccaatcacagttaagatagtttagttttggaaggtataaaaaatatgtaacaacatgaatgcacttttagggtcagacaagagacttggaaagagcctgcaaaatggaggagccctgaggcctaagtctcatgagtgtcaatgcttacctgtatctagacactggcatcccccttttgataaggccaagattgattgttttccttttctacctaccctatatctaatccatgtacaaacactgttgacacacaaaagaaccctaaattcaacaatctgtgaagaatttttgcactaacatgttagttca

SEQ ID NO: 1148 - DNA, 1077 bp, Homo sapiens
ggagagttaacatctaatctggaggaagaccctggaaggagccagccccttcccccaggctgacctggtttaagcctttcttctgccaaggtcaccagcaccccagatgggtgagagatgtgatcactggtttcgtggcctgaccaaggacctccaaggaggtatctttcccatcttggcccacagaggaggaaatcctagaagggatgactgaagcttgggactaacacattggtggatctgtgctaccccctgctggccgtagacggtatgacagccaagatagggcaaggcttcgaggggcgatggatggattcaccgcagcggcgacatttctggactgttgtcaccttcagtgcagtcactgggaatattcagaacccaggtgattgataaggttttcccagggatctcttctctccccttcaccattactcagtaggagcttccttaaaaacggaaaacgagaggccgggcgcggtggctcacgcctgtaatcccagcactttgggaggcggaggcgggcggatcacgaggtcaggagatcgagaccatcctggctaacacaaccccgtctctacttaaaatacaaaaaattagccgggcgtggtggcacgcgcctgtagttccagctactcaggaggctgaggcaggagaatcgcttgaacccgggaggcagaggaggttgcagtgagctgagatggcgccactgcactccagcctggccgactgagactccatctcaaaaaaaaaaaaaaaaaaaggaaaaaggggccgggcgcggtggctcacgtctataatcctagcactttgggagaccaaggcgggcagatcacgaggtcaggaatttgagactagtgtggccaacatggtgaaaccccatctctactaaaaatacaaaaaattagccgggtgtggtggcgcatgcctgtaatcctagctactcgggaggccgaggcaggagaatcgcttgaacccaggaggccgaggttgcagtgagccgagatcacgccattgcactccagcctgggcgacagagcaagactccgtcttgagggaaaaaaaaaaaaaaaagaa

SEQ ID NO: 1149 - DNA, 645 bp, Homo sapiens
agcagcccagggacctgagaccagcgttctcaaatgaaggtgccagatctgctgttagaggagaattcttctgtcctagctgtgtctctgtgatctgtggatgagggtgggaaagcaccactcagtcaattggggtgtacaaaatggagtttgagaaggtctcacatccaggttgttttgaagcaaagtccaagcattgtatcacttcatctgcaaatatttcaataagtacccaaaagtggttggactgagtcccatgaagccagatcacttctgactgcaaggagcttggaaaagcaagtatctggatcttttaccagctaaatttggagcgatgaggcttcctctttgaagatcacaggtgagaagattaggtgctttctcagaagcccagcaacctgatgggagtgtggagtgagcaagacccaaatcggagcttcatccctgcatggttcattttgcttatttggcaaacttgccctgcagaatctactcaagcttcctcagtttctcaaatcattcttgggcaacaaatgaacaagaaagaggacgtcttattatctggtgtctggcttgctgatttaataacctaggagacagtgtttgaagaacacaaactctaaagtccttcacttaaaaaaaaaa

SEQ ID NO: 1150 - DNA, 1944 bp, Homo sapiens
tgaagaactggtcattttttttgagtgccctcttctcagttttgtttaaacttacactcagtagagtgttgggttgtctgctgacatggagtagaacctggattctggccaaataggccagaatcggaaaggtgaaggtgagtgtgatagtaggtaatctcctcaccccagcacaggccctgggagagaggcaaagcagtttgatgggatctggaggggagggaggtaccctggcccttggtctagcatcagtgagtcctgcccttccaagcccctggaggctagtggcattgcattgtgcccctttttgccacccttctctgatgtgattttgagcgaagaggagtcagtaagcccattgagaccggctgctcccaaagcccgaggactctagctgtgtggggaagggctagcattggtcaggactctgctgacagcactgagtaggcaggaatgtatttgagatttggaagtactgttaatttggtggagtcaggtgaatggataagaggcagatcggcagaaagcatcagtgtggtcccgaggctccctctgttttccttgccatggagtccccagcgccttgtgcctgtttccatttccctctctctttgaaaagtagaaatcagtggtttcttgactcctaaacagcctcctcactatagaaggagcctgagcaggtcagaagaactagaaaagtcctcagatacccccctctgtccagccccctttcccatacacagatatcaatggatgagcaggaaaagaggaggcctggactcactgaagtacttgaagaagcacaagtgtcatagatgtgccgccctttgccctgggtgttctagatcacacagaacacgtttcagctggactaagaatcagactagccaggggttcttctgaacagctcaggccagacctctgggctcctctgggggccctgggacatgatgccttgcagtttccattccattgtccccaggcctcctgacctggtgacagagagtgccctgcagaagtgagtctatttttcccaattcctcttcatgaccagaaaatggcagctggccggttggggtcctgtgggaaagggctaacctgggctgttaggtagacactaggtttaaaggtagacagggagatggcatcatcagggcaggccaggcccacttcctgtgaccccagaccttggcaggcgggtcgtgctgaaaccaggcatctccctcacacctggggaaaggtttagggcaacatgttgcctcttcatcccattaaccctagaaatcttctggttagagtggccccttaccccaaatctggcctaggtctgaagactgcaggatagtcatgatgggcccatcctagagcctggctagctggaagacgcggtatggcagggacaggagggcggcaggaagggctttgtggccctgctggggccaaaggcagttttctgtgctccctttagccccagcctggctggccaggtctcctgtacttcaggggaccatggggccgcccaagccagtcaccttccccttccaagctctccccccatgactgttgatttctggcgcgtggaggcagagttgtgaatccacaaatgctgtagcccatatctcgtaatgtgtctgtgtccacttagagcctcacgacctggctgtgtgtgtgcatgtgtgtgtagtatagtttgtagttgacaatatgtgtatataatagctggtgtatttatatgtgagtgcagaattagtgcccgtggcggttttctgtattttaaacccattgaattggttagttttattttagggaagtgggaaaggcggagtggggggaagtataggaagaaggattcttagcaaaatcattctctaggactattagtcgcgatctcccagtgagccatcacgatgcccttttcaaataaatgttaatgttgtcaccaca

SEQ ID NO: 1151 - DNA, 9771 bp, Homo sapiens
cagagggatgcccaggatgaggtgaagacgatcttggaaatcagcccagatgtgcatgcaccagtccacgtgtggcaggaccaagggaagtgtcttcacaaagatgaggctttgatttgttggagaaactgttaccagaaaaacaggtcccgatcccgaccccaaaagagtattcttggatcttgcacaggaaggaattaaaggtgagtcacagagtgcagtgagaaggagatagtttattgaaagttactcagatacagagtaggtgtcctcagaaagcaaaaggaagaatgcaccatctttgttgtaaactcttctaatgtaggggtttaatctacataaaagctaagttaaatgtctatgtgtgggtgctctgacagcatgacaaaatttaggacctattgatttaaagaaagttatccttggcattttagttagtatatcaaagcatgactataataatcttaaaagcatatattataatgtgacgtcaggacatgtggacattctgttgtctgtcataggcgtttgttcttgcaggcattattaagttgtttaatcagctgtaaacctcttatgaccatgggttgtgactggcaaggaatatgccttgctagttgaaagatggagttgactttaaaatggtgtcaccctggctctcctatgcttctgtttccccaaaaaagccaggttacttgtcctgtagaatgatccacattctgagtttggctaatgacattctcatggtattaacttgtttctttatatgttgttttttctgttacccacaaaataattcttctgatacacatttgtaatcttaccatgccagcatctgctactcttcatgttaccaaatttctgttcaaggaccactaaagccacagtcagtggacattctgagacctctaggggagggtggagatgctgtcctttaatatagtctgacccaagcaacctccccacttggcatggtgaatctagacaagctaaagaatttactacgccccaggcctgcaccagccctctcctaagaccttgggcactctcatttcccttttttttttttctaaaggaagtcatagtttctcataacctttgctagtgatcctggaccttggttgttccctgaggctgtgttctccacactgctgccatcactgctacagcagaggtgcagaaagctcaggagagagaagggaggaaaagctgaagattttgtgttattcatgctttcctgactccggcgaaagtgcttcctccacctgcaaccatttctgtttctatactgctgagtcttgtgttcccaagaccaagggaagcccattttctttaaagccagtcacagtttctgttggctgatggaatatctgttgtccagcagttgtattcctgctcacaaatgcaaaacagtttgatgccacgcacattccagggcttagactggaaatgctgtcccttgcccctttgttaccttctgacagggatcagtccatagtgtagttggtgtcacaacagtcccgaagaagccttccaatagatacccaaatgtgattcaaagtggcacaggcacacaccacggtgccacatggtgcctatgtaaagcaggtatatcaggaatgctaagcagagaagtagcagaacacactgatccccatgttctcattgtacagttgggtgcaattaagctggcacaatggactcttctcatggctactgttccagtagtgtggatgcccccaaatgctgcatatttactaggacagccaggcagagacagctgtgtactatgatacaacagtagtccctcttagaggaagtgaccttgttagaagtgggagtttctgaagctcttcagctgttactggcctgctcttccatagcgttacttcagacctgctggcccagctatccactccgctaacaggtctgtctctgctaacaggtctagctctgtctcctcagcacatgttctaggctctgactgcaagtgctgacttgggctcccagccccacacagaccctctgttccatgaaagggccatctatgcaaagtgccccccaaatgccaaaggagccaataaaccaaggaacaagacagacaaatctagttgtcagtaaagagtgttttattggggaacttacagacagaagcgtggtcttggatggcaggaagacaggtaggtttctgcacttattacccccacacccagggcttatataccacaggggaagagtatacatgctctgtgcaagacaaaggctactactgtccagaacaggtaagaatgctaatgtgtcatagcctagaatttgtataacatcaaggttgacatgttcttacaatagggatggtaaataaagtgggaatcaggagtcagtcctgggactggggctaatcagaagtcagcatagagaattagcatccaagagggagtcacttttctctccacatcccagccctctaatccagctcttacaatctcatggactcacatttcccccatagtccctgagccttcagagagggctgtgggtgacattttgatggtgtgagtgacacattttatcaatttgttttctacttgttaagcaggggccacagcaacaacacaaacaacaggcgatgatatgtatgccaggtgtaagacacagaattaaaaatgccctttaccatgtttattcaggaaccaaaccaagaggtatagagcagaacaacaataggaacagaagactatgggtggaattaaaaatgtttagtaggtatttggtggggcagttcttccccattaaacagaattactggtagctccatctctgttgattaggaacataggattgtgggctgggagtacacaccaaacatgttgcctgaggggcaaaggcgctggtattatgtgtaaggttacaggggcagcaaaggaccatgtcaaatggccagccagggtgcttcttaaaagggactgtgttccagtttattggtatgtggagtgttttggcccagacttcagcaggatcaatggagaccactttagttggtagggaattccttgctgtctggaaagaaatgctctatccaacataggggaagttgctagtccaacccccattcaagtgtctcctccctggctcaagatcttgaggagttctaaataacctttgccattggccttttatctgctcaggtcagagatgcatctggttggactttctttactattatggttaatggatccatctctgtggtggtcctgagtcattggtgtggtgccagcaccatatttgtctcaactaaattaaggtttctaatggcttgaggcaaaatctttgtctaactatgaaagatattggattttgagagtgctcaaaactgtgccttcaaaataccatttttcctttcaatcaaccctgttgcttgggggagtatacagtaagtgaaatacccagtctatgtccctttcatgcatccagtcttggacaccgtgtctggtgaaatgcatgcctcgattgctatcaatatgtggagggtatccttacatgacactgagttgctccaagcccctgatggtggctgtttggtttgctcttacaagggaaagcttgcaacaatcccatggcagtgtatacacatgttagtgcatactttcgtctcaagattactggcaagggtctgatgtagtctatctaccagtctgtcacaggggtggctgtcttatgtatatgtccaggtgtatgtgggatgtggcagaggtacagacgggaacaaattaagcagtttgctaccgccaccactaaatctgcatagcagagagccaatcctgctccctttgctatttggcagcccattcatgcactgaaatccccactgtgatatgtacctaatcaactagctcagtattctaatttttgctaggatgtctgcctccatgtttctgggaggtgaatctgaccagtgtgctgaagcaattaggtccacagtgggttcctgtagacttttccaaatgtctttccacatatcagctccccataaggatttttaaattatataccaatcatctcaggccctttgggcaagccaaattgtaagacccttaagtactgccagactgtctgtacagagaactataggtggtggctcacgggtacaaaccaaccatgtagcttggagttctgcccattgactgctctgttgcattcccatctcaaaccagatactgtctgtggttgtgcagctactactgtccatacacagggttaccttggctcaatgcatctaagtaccaagcattatcaggaatgagggccatgccttcatgtaccattggagacatctcctgtgagggctccacaataggggcagcactggactcataatgtactggccctaagatagcatgcagttcatctcttaagggatgcatggagaaggcactatgttgttgcatgtatgcatggcacttttgtaaagtggaaacttgggcaatagctgatacaggcctggcaaacactcctacccagtccttgataggaaacctgttctccctggtaccaggaaagcagcagttatggattcaacttgtggcaagaccttctatatccccaggacctgttattcaactgggaaatagcaggtttcagtacccttccattaattgtgactaaaattctaaaggaactgcttccctatgctggactttatattttcatcatccaaaattatagtttagttttacctttaaaaatatgttttttgttctcatttgttccataggtttctccttgaaatttatattgtatggtaaggtttcctattgtttgcattttgtggattgcacgccaaggtgtggtttaatgtatttctattacctgtattttctgtaaattggtagtttggtatagaggtttgtgtacattcagggtttttttttttctgtaagtattgatggttctgtaaaaggaaaataaaatcttggggccccaaaattactaagctaaagggaaaagtcaagctgggaactgcttagggtaaacctgcctcccatctgttcagagtcgcccctctgctcactgagataaacacatgtctgattccctcatttggaaaggctaatcggaaactcaaaagaatgcaaccatttgtctctcatctatctgtgacctggaagccccctccttgcttcgagttgtcccgcctttccagacggaatcaatctttagcttacatatgttgatcactgtctcatgtccccttaaaatgtataaaaccaagttgtgctctgaccaccaaagttgtgctgagaagtgacaccaaagaacatggtggcataagaactccaaggacccctcccctccacagcggcaatgtgcttgttgaaacaccagtataaaaaaactcgatgagagctgtgattggatttagtgttgatatattttttgtaaattgtggtaaaacatgcatactatataatttaccttctaaccattttttcagtgtacaatttggtggcagtaagcacatttacaatgttgtgtaaccaccgccaatatccatttccagaacattttcatcatcccaaacagaaactgtacccattaaaccataactgcccattctccctacccccagcccctggtaatctctattctattttctgtttctatgaatttgcttattctagctactttatataagtaaaatatcatatttgtttttatttctggcttatttcacttatagtgttttcaaggctcatccaattagaatttcattcacttttaaggctgaataatattccatgcttatgtgcaccgtgggttgtttatccagtcatcctctgatggacactcggttgcttccaccttttggatattgggtatagtgctgctatgggcctgagtgtacacatatctgggtgagttcctgctttcagtgcttttgggtatgcccaaaagtggaattgttggctcatatagtaattctatttttactttcttgaggaatcactattctgttttccatggtggctgcaccactgtatactctcaccagcagtgtacaagtgttccagtttctccatatcttcaccaacacttggcctagtgaagtttaccatatttttatgtccttattggcattccttttttttttttttttgtgaaacagagtcttgctctgttgccaggctggagtgcagtggcacaatctcggctcgctgtaacctccacttcccaggttcaagtgattctcctacctcagcctcctgagtagctgggactacaggtacctgccaccatgcccaactaatatttgtatttttttggtacagacggggtttcaccatgttggccgggatggtcttgatctcttgacctcgtgatccgcccacctcggcctcccaaagtactgggattacaggcatgagccaccatgcctgaccagcattccttatttttatgtccttattgtatatcttctttggagaattgtctattcatgtcttttacttatttttgaatgagattgttttgctattgttgaattgtagttctttacatattctggatattaattctttatcagatatgtgattggcaaatatttcctcctggtctgtgcattttcttttgattctcttaatagtgtcctttgatgcaaaaaagtttttaaattttgatgcattctaatttgtcatttttcttatattacttgtactattggtcaccagccaagaaaccactaccaattctaatgtccataagattttcctcagtattttcttgagggttttacaggttcaattcttaagattagttctttgagtcattctgacttaatttttgaaaagggtgtaatggaaggacatgaattttttccagcatcattcttttgcatgttgatatccaggtttccagcaccatttgttgatgcaccatctgttgcagtggggctgacacatttgtaagatgcagtgagcattaatacatgggagcaccatgcatttatttacctgtctttacttcacagttgttttgagaaggctttcactgacagactcaacagaaatgaatatatatgacttcttataaaatcatattcaagtaaaattataaattttaaaatgttaagactggagcaagactggaacatcactagacaagctgaaacataggctgaaatgaagggttatgtttaccttgctacaaattctgttggcccacaatctcttatgcttattgcttaagagagccacagagtggggtgatagctcacataaccagtccctggttttctgcttcagaaagaagtttaaatattctgcttagacagagtaaggaaattaactgaaagatgtctaatgtgaagttggcatctacaaagtgaaggagtgagtagtaagtgtaaacatcaggaatcccaggagattctatctttttgcacggaaatggcctcactatgcactgctgaagggagaaggtcccttcaggggaccttcatgatgaagaagaacacaatatgatataggaattttctgctgcagccctaaactgaattgtccttctctctaactacaggtctcacaaagttttatagcttcaatgatttcacctgggccaagattttggttttttttgatgttatttgtttgaactgctgcctggggcttagaaaagtgacttggatattttgtcaaaatggattttctttgatggaatgtgaaatccgtaaacactctgctttcctgctgtatccccagagcaggttgagtaccttgcacttcttctcagcacttcgctagaagtggtagaagatttggagttagggcctccctcaatccctaccctttctttaattcagaggatcacaaactgttgggagaagagtggtatcttgggcctctagctgatctgatgaatattaatatccaatgtcctgtagtgaagtcatgtgtgcgtgtaacatcacttcttcacgcagtgtcataggaaagtgggttcctggaccccaggttaagagcctaagcactaaaggcacagagctagagctctaggaggggagggatggctggggtggaacctcgtcttgtcatttagtcctggggccttttcactccttacatggtgggtggtgggcgtctggcaggtgccgatgttgatggagtcaagggagggaactagccgggacagggaaaaacagggttggagagataattaaggtggacgttattttttctgagcgtaagtcgtggctggaaatctggagagcctgaaagagtatccccctacccaaacctgttttttccttttccctcaagcctcatttggccacaggcccagtgtcaacaccagggggcgccacagaccatgaaggcaccgtgcagctgggattgtttgtggtcggctactgggtccctgacttaaccaggggagccaagaccctgtagccaagtggcctggattcaacctgcagctcaggtcttactgacacttctccccctggtgcctcagtttcttaatctgtgaaatggtgaggacattacagcatttacctctggggcgggtttctcaacagcagcactattaacaatttgggacagagaatcttgtggagtggtctgtcctgtgcattgtgggaggtttgccagcaacaccccactcaccccctcccaccaatccccatgtgacaaccgaaaatgtcccaggatttttaggtctcccttgggtctagaagctgcacttaggcattttcccacctgacacttgagttcatctctgctttggtccacataaggccactttaaaaaaatgttgtttctttaaagattctaaccatcttttaaacaaatccattttcttcctctatttctgcattcagttaatccttccaaaccctttgtttagtatatcttgaaatgtatcaattcctgttctagtaattaacatatgtgacttgcatgatatctgctatgacccttagtagagctctgattcctttagcacagggaatgtgttctcgattctgctctggatgatgtaaatcaatttattttactttacttgtctgggatgttgctcctcatctgtaagatgtaaatgtggatatggcttggattactaagtggttttatttcttaattcacctgacatttgttgtgtgcctgctgcaagtcaaatacatggcatggtattgtttccttgttcacaccacagcaaatgagaaaatgagacattatagccaggtgtggcggcacaggcttgtggtcctagctactcggaaggctgaggcaggagaattgctccagcccaggagtttgaggttacagtaaggtatgatatcaccattgcatttcaacctgggcaacagaccctgtctctgaaaaaagggaaaaagaccttgtgagctgtctacgtgtactctatgtctcaggagactcatatcctgtaatttttctaaatggcgtctccatgtggtctttcatgaatgtttgtctggtattctctatccttttactttcaacttttctttaccttctactgaaattatgtcttttgtaaacagcccatgattatttatttagttatttatttttacccccctgcactatttgtcttgtaattggagtgtctgagtccattatgtttaatgtaattattgacctcattgggtttaagtctgtccattgtcatttgctgccttctaatattatctctttcttgctcaactatttttcttatgttaccttctttagatgaataaaaacctttgcattattg

SEQ ID NO: 1152 - DNA, 443 bp, Homo sapiens
ctcactctgacccttaggctgtattcacagtagaccctggtttcacttttcatggttttagttatctatagacaaccaccacctgaaaataggaaaaaaaattatgtataggatttggtactacctgaggtttcaggcatccactgggggtcttggaatgtatcccctatggttaagggagaatgactacaaaccaacgaactgctacttagcaagaggaaggcatcagggcagtagctcctctgggaatagtaaagcacttctttctcctgctgccctgtgaagaaggacgtgtttgcatccccttccaccatgattgtgagtttcctgaggccttcccagccatgtggaactgccagctgccctttcccttcagccatgagtggcagcagcccgaggccctcaccacatgcctaatcttgaagactccagccagcagaact

SEQ ID NO: 1153 - DNA, 547 bp, Homo sapiens
aatccccgcaggcgctgggtctgcagatggcgtccaggtacacagtggcgagtgtgattccgcagtcttgggctgtttggccaagcgcccgccggacatggtacgccgaagggtcatcggcgtggagtcctcgctttcagcgtccgcggctgggaaatcggccatcgctacggcgggaactgggactcgggctgcgtcccggcccttccacatcggtccaccgcactcgtgggcgcccgcattggtgctgacataatttcctgacctctgacccgtattgtctcgcgattaaagagctgcgcctggatccctcagcagtgaggagacctgaagaccagaggaaacacagcaaacggagccttgctctgttgcccaggctggtgtgtagtgatctcagctcactgcaagctccaccttccgggttcacaccattctcccacctcaacccccggagtagctggaactacagcctcctgccaccacgcctggctaattttttttttgtatttttagtagagacggggtttcaccatgttagctaggatgg

SEQ ID NO: 1154 - DNA, 575 bp, Homo sapiens
cccagctcttctaatttaaaagttgctgcatttgtgatgattttcatcttgactggggatggtttttccagcatcatttgttagactattcttacctccatggtgattcttggcgccattgtcaaaggccagctgactgtatatgttaaccctgggacttctgtaatattggatcatactgataaacctaatttctgacaaattcttcctcatccaattcatgctccccattctgaacaccagcatcatgcatcctttgctctgttctaggcacaacaatcaaaagtgcttattcccaaactggacctgacttcagccagagcattgctgggacatatataaatctacgtttaatatttgaagacttgccagactgtttcctaaaacacctgcagcattttacattcccaccagcaaagtacgaaaagcttccaatttctctacatcctcaccgacaatcagttttttattttaaatgctatagttacaaagaaaagttttagaatgaattaatgctgtgattttaatcacaaagattaattttgcaataaaaatccctgataattatgattata

SEQ ID NO: 1155 - DNA, 551 bp, Homo sapiens
gaaatgttttgttagccatcaggcaaactgaaaatagatttagaaagtatttaagattcattttttcaatgcacagtaattgagaaacctgtatgtgccaggcactgtgttagcactggagctctaaagggcagaaggctgaatgtgatagatggatctctaccttcagggtgcagtctagtaacacatagaaggactgagaccaatagccatgttgaagaggagacgatggttctcccatcaccttcattactccacctgctgctcatgaaggttgctgcgggatgtgctgattaacttgtgttttggtcgaaatctgaagtgatgctgaatcttcgtcctttaatgttgtctgttttattgttgaacaattttatcatgcatcgtgtgaacttttatgcttatggtgtgtatcatcacagcactggacaataatgactcacacagtagaataacataactgtatacttgcatcaagggtagttaaaacatggtaaggttttctcatgtctttattaataatgattaaaaaattaattattcacctctga

SEQ ID NO: 1156 - DNA, 2973 bp, Homo sapiens
ccgcccgttcgcgctgccagcagcttccgcctgctacggtcctggcaagcacctcgggatcccattccttcacagggaccctagccagttaaagctgatacattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggacttccacatttgggacgagttggctgtcatcagctctagaaagggtgtggccgttttacattggctgttttcctcacattcctcaagcaggtactgtaataaagaactggagaaatacagtcagatgggaagtagcccttgctgtcaaggagcttgccatctaatgggggagacaggcaagtaaaccaaagactacacagtgcagtatggtaagtgccatgattttgatgtgacagggcacagtggacgaccttccaaatcaaagcaagtaactaggggttgacaatggtaagtatcatagttgaagtatccttgaacaaggtttcaggaagaagaagaagggaatttcatgcagggaaacagccaaagctcagtgagtcaaaatatcacagcattcttggtaagcccaattgttttttctgttttgctattttggtggagagaaaggaacacataaaggaataacatgagagaaggctatttggggaagtgtagtagttaaggttctggctcaaacaacaactgcagctcataaagttgactttagtggaaggatactggggtatctcatggaatcttgggaactgttgaataaccagggaaactctgggaaactcactggtaggaatccataaactgtcctcctggtgggctgtaaacaactcaccctctatgcatctcacatcaaaattccagtttcttgggaaaacaagtctgtttgcccaatttgggtcatatttccacgtccatgttactcaggcatgattcatctgcaagttatgtgtatagatattttgctactgttccacccttacgctgtgctggggagggaggtgtcactgtgagctgtgtcggtgccttaagagatatctgttgtgtcttattacttggttgcttttccccacatgtacaatgacaaaaatgccttcaacctatttgatccagccgttccagtacaactcctatacttgccatctttccaagcccaaaggtacatccagctgatggaaggagcatcttggtgttaatattcttttagtcatggtctctgaaagtaaaatgtctattcttctaattctggcacaatcttatctagctatagttcctcatggtcctgcactccatggactaaattgtaagtataattactaccaatgtactctataaataacttttggggccagggtggcaatagttgctagagagaaaaaaaaaaaaaaggaaggagaagaaaacagtgatagttcttattttaaaaggaaaaaaagaggcaggaggctctcttgaggccaggagtttaagaccagcctaggcagcatttcaagaccctgtctctactaaaaagtaaaaaaaaaatttagtcaggcatggtggcatgcacctgtagtcgtagctactcaggagactgaggtgggaggattgattgagctcaggagtttgaggctgcagtgagcaatcatcatgccattgcactccagcctgggcatcagagcaagaccttgtcttttaggaaaaaaaggcagggaagaggaataggtaatttttcagtgttcagacattccagcaatatgtgtggagtactcattctcactacagtttatgaggccatagctagtatgtatgactacccatccaagtttccctgcttacagttactattccaactgattggggggcttttcctaatagagtgatttaagccttcatttttagacatctaagcccttggtgatcatcagcataaaatgtgacaaattaaacaaaagcaagacagcacatcagagaacaactctgaggtggaatgattgggaaccaatgaatagttgttcagtaaatggtttatattttacagatgatgaaactgaaacacaaaaaatttagattaactcttaggtgacaaagccaggattgaagctcatgcggtctggctccagaacaactcttcttcatagttacgttatactgcccctgcattgttggtattgaaaaatttcctttcatctctggtaaaagtcagctctctaactactgcatctcacagctgaacagataactgataccgtgcttccagaagatttttctaacagtgtttgcaagctataaaatagtgctttcacttagaaaaggctagacgtggtggttcatgcctgtaatcccagcactttgagaggccgaggcaccatgctgggagataaggatccaacataagacaaacagtgctgatgcttttggaaagctcatattcaagctggggagacaaacaacatacaagtggctgtagctaccttctgcatatggatatccagttttcccagcaccacttattaaagagactgtcttttctgcagtgtatattcttggcaccgttgttgaaaatgaattcattgtaggtgtgtgggtttgtttctgggttctctattctgttcaacttgtctatgtgtctgtttttatgccagtaccgtgtcattttagttaccagagctctgcagtataatttgaaaccaggtcatgtgattcctccagttttgtggtattaggataggtttggctattctgagtcttttgtggttccatataaattttagaattttttttttctatttctgtgaagaatgtcattggtattttgatagggattgcgttgaatctgtagattgctttgggtagtatggacattttaacaatattcattcttctaatccatgaacatg

SEQ ID NO: 1157 - DNA, 786 bp, Homo sapiens
aggttctggggcgccaccgcagtcattctgttcagcgggtatagggttcttggataaacaagctctgacgatcattcccaaacaagagttcaaaaatgttttccgcaatagcaatgatatggacggaaaggatgccctcctgcactgatgcctctggaggaccacactttccattcagagacacgctcagcactcaactcatgctgcacacccggccgaccccagtaccgacactcacagaatgcaggttggagagagatgccgacttccgaggaggtgtcttcttcggactgaacgtattcccaaagaaaggcatctttggcctgatgaaagcaaagccagtgctcccttctcctagggtcagaaaaagtcaggggtacaagcagctggatcactgaccttatgccattgtcttcaaatcttgaagacatacattttatcatgtggctactaacgatcctggtgctatggtttgaatgtccccaccaaaactcatgttgaaattgaattgccattgtttaacagtataaggggtgactgggccatgtgagctctgctctcatgaatggattaatgccattgtcatggagtaggttagttttctctggcgtgggctcctggcaaaaggatgagttctgctgccatgctgtctgtctcatgcacttgctcaccatgtgagccttctgcctcacacaggatgaccctcaccagatacttgcaccatgctcttggacttcccagtctccagaactgtgagccaaataaacttcttttctttataaatta

SEQ ID NO: 1158 - DNA, 415 bp, Homo sapiens
cccttccctcccctcctcctctttcctctcctctcccctcccctcccctcctttctcccccttcctcctcttcctcctcctcctcttgctcctcccgggcggggaaacccagccccgcgctcgtctttggggccaccggtcgcccccgcctccgggacctgcggggagggcccgcgagagatggagacgagagatctggacttctgaacatctaccggaaaagataaaatgtgcaagcccttcagaacgctggggaggttgggctgaactgcagtgggagaggagaagagatgctggcgtgaagggctggggcagaagatcaggggaaaattgcggatgatctgaatgatagcagtgaccaccagcaacctacagagctgcccaaccaggaaattgtcagatggaagcaacgctt

SEQ ID NO: 1159 - DNA, 295 bp, Homo sapiens
acaatgtctcttctccattaagaaaacctacttcaacatctccattggttctcaacatagaggaggaaaataatcatatttcatcacagtatttaagtaaggatcaaagactctaagataactgaaagcactaaattaattttcttcaccaagatcacaggaaaaacagaaactacaaggagaaatggaaaaagctggaccttccctatggacatggggaaaagtggctatctggaagtcaagggaaaagagagatttttctttataaaataaaagaaatgcctgaaccaccaaa

SEQ ID NO: 1160 - DNA, 476 bp, Homo sapiens
acttgcaaactaaggggaatgagcttccttctgaatgtttatgaaggagaggccactgtgaggatagacagtgaagtgcaactacagcccgcaaatgaaaatgaataatattaatccagcccctcaaggcagtcatctgtcttagagctattggaatcctggatcattgtgggaaatgaaagatacttcgatggaatcagcagccattgatccaatgccaactccaagactggaacgtcgcaatgatagttccaaggcggaaatttgacgtaattcttttcgacacagttttacaggtctggatgcccattttaattcttctgaaagcatgcctcctccttctggcttcaggactccatctccagcctcttgatctaaaaataatccccaaaccaaaaaattagatactatttcctcaaaattaggtattttaatcaaaacatcttaacataaatacattattatcacccaatatg

SEQ ID NO: 1161 - DNA, 612 bp, Homo sapiens
ttggaaaatggcatggaaataatccagcttgaacatcgtcctcctcacctcctggactagggcgagggccccttatatttcttcatggcaattgtgtcacagttcaaacgctcgtaccctgactccatctgggatttggaatgcactcagggaagtggctgtgcatggagactagaaatggaagaggcttccaaggtcatgcctttcaggctcccttcaaattctacagctactgtgaagagagttgcattcccacagagaacatgtcagactggaggaaaattgtgacaaaaggtctccccaaagatcgaggaaaggaggtttgcctgaaaaggagccagagtggttccgcccagactgacgtgcttctggcagccggtgtgtactgcttggtgactgctctttcatttcaggtggtgatttaccaaatgccgctttttttctgtatgacacaggcgtggccaaacatagtcaccactcagaatgttggggaagtttctcgtccccatcaaacagagggagcaacccttggtggttcaacaatgaagcctccattagctgagaagtctaactgtgatttatcattccctacctataaagattgtaaacaaa

SEQ ID NO: 1162 - DNA, 537 bp, Homo sapiens
acggggcagagggactatgttgtgagcctgcgaaagaagtttgtgtggggactgtgggcagtgaacgcgttgggaacaatatggaaaactgggagccgccttggaatctacagggccgggctgaagaaaagaagaatggtattcacgcagttcccattttacagatgaaaacaagaggactttttctgtgaagtcaagaaagtggttacaatggtactttcagcctgtccgaattatgtattgcccctcccctttttattaataacattgaagtgtgatgggacaaccactgaagccgtcagttgaaacctgctgggactttttagccattctcttcaacataaagaatgggtgtttttggagggggtgagaggaatggggaaatgttgtcaaagagtacaatgttttagttgagacaggaagaatatattttgttgagatctacagcacagcatggtgactgtagttaacaatgaagtattgtgtatttccaaattgctaagacaataaatttcaaatgttctcaccacaaaaaag

SEQ ID NO: 1163 - DNA, 323 bp, Homo sapiens
agttgtctcccaggtggatggaaagaggacattttgctttgcaagggtctctcttcaaaaggttcaaatttcgtgcagcttctggaaattctccatcttgatcatcgtaccgtggagctgtgccaccatctccgtgatctctgccaaagcggctgtgaaggaaagacatacacagtctgcagcgggaaaggcaggcaggggtcttcccctagcagctgtcagctcaacgctgcagggaaatcactccagtccctgcacagtattcaaaggtgtcttttgagcaaaaacagtgctatttctctataataaaaattgatggtgta

SEQ ID NO: 1164 - DNA, 1492 bp, Homo sapiens
acacagctgtgtgggccaagggggctggtgtatctccacatgcaagcacgtagataccgaggaacctggccagccctgcagcctgactcgggatggctgcctctatgccctctgcgtctgactttctcctttgagataaaggtgttttggcccaagctgagtgcattgctgggcagcggccatgccgaaggtggtagctgaagggacccttgatcgaaagacgctctgccatgctttctgagtcctgtctcctccaagcttgtctcctagactgtttcccctgtctgttttcctgcgcccttgtgtttggccatttttgcattaggctgtgtctctgtacccaaggccacgtgacaaggtagttggaacccccactcaagtggtgagtgaagagcgtcgtggtaataataatagtagtaacacaacttccaaatttctcagtggagagtgtcacgtcctgggggtatcaagatctgtgaggcctttccaagccctcaccattccctctttggtcccacgttgggtgggcagctgggaaggtcctagttgattttaatctccggtgctttccccagaactgctgctctgaataaaccaaagctgtgaaagagtgttctgcgcaggctgcgggcccagcctctgggtgcaggccctgggcacttgagctgagcagctcagctggctctgctgtgagggaaagccgtgaacttaactgtgctgagagctgggtgagggcaaaatggggaagactgaagaagaaggagcaggtgggagagaccagccgctaacatggtgtctacttctccgtggatcagagaagggatgagtagcaaatgcagaggcagggtggtctcccagcaacaaggatgtccagagttctcctgaccctgtctgcacccacttccatgcaaggcagaggcatcacagttttccatcccaggccacccttcactcttccaagtgtcaggcctctttaaatctgcatccctttgggttagaagcaagagaggtggcaaagtctccctggcactgagagcctgtcccaccatgccactcggcatgagatggtggaggaagaagccaagagcagggatgccttcctgtccccgtggcctctcaggactccacaagatgctgtggaccaagatgagagatttcaggatggggccactggccttcctaggttgggctctgggtcctttcaataaactgttcctttcctgattcttactcccttctggtccttccactcccttccctctgccaggtatggaaaaggtggctgggctcggtgtgcgctccaaccccggtagcattagctgagtcacgcggcgagcacacaacagatttgtagcagctcatctgccatataaaccgcttggctgatggagtcctcattgagttttttcattatcgtgtaaagtggaatcatgtcattcacctttactataaacaaggctgtgagaacataataaacagaacctgaacaagc

SEQ ID NO: 1165 - DNA, 318 bp, Homo sapiens
aagccagacgagctgtaaaacatgaacggaagagtggattatttggtcactgaggaagagatcaatcttaccagagggccctcagttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagcct

SEQ ID NO: 1166 - DNA, 1101 bp, Homo sapiens
gcatgatgtcacctgcctgtgataccaactgtattttgggcacggttgggtagatgagctgtgtcctcggccctgaccagcgctgactcagtgtttctgttgctcctcattgtatgaaaggagaggaagaggccagcagtgcccttgaacccactgctggtttgccagtcatggtgggttgggatgcacacctgtgattccggtctccactttgaccctgtgtttgtgctttctgctttcatcactgtatgatgaagcagctaggagcacaggaatttctcttaacgtctaactttataccacatgctgacagttagtgcctaaagtacagtgcgtgtattatttttaccctcttcacagcccgtcgtgtccccagcaggagagaccgtggagggaccagggacaggcgcttaggcctgtgactgatcctctggattctgaaaccagagcagccaccctttttgctgacattaacctggagagtgatcaaagcacaagaaaggggataacttaaaactattggtatttacttagttggaacattattttacttatttatttttttggcgatagaatcttattctgtttgccaggctggagtacagtggcacaaccatagttcactgcagcctctatcccctggcacaagtgatcctcctgtctcagcctcccaagtagctaggaccacaggcacacaccaccatgcctagctaatttctttttttttttttgtagtcatggcgtcttgctatgctgcttaggctggtcttgaacagcctcaagccctcctcctgcctcagcctcccaaagccgaggattacaggattataggcatgagccagcaagcccagtctagaacattctttatccttcctgttttcctcagatactttcactctttttttaaactttatttattttttatagagacagggtctcactatgttgcccaggctggtctctaactcctgggctcaagtgatcctcccaccttggcctcccaaagtgctggaattacagcgatgatattttcactctaaaaagatagaaagtatattgaccagcctggccaacatggcgaaaccccgtctctactaaaaa

SEQ ID NO: 1167 - DNA, 4226 bp, Homo sapiens
actgaggaagaatataagttagcctcgtagtgaccatgtggaagtcctgacctcgcttgcagacttgacctctggatgtgacaaggtgaggttctgtgttcactgatacatccccttccttcaccgggctcatgaaaagaaatgctgaatcagcaaatagagtgaacgaacaatcaagatgagatggctgctgttgatgtgattctctaggttactacctttcttcctgctgcaaatgctgcatgacactaagcttacaggatctagaagcagactacaaaaaaagaagaaattcactctgaagactgaagaaacactaggctgatcttaagtttccgaaatacactctgtaacactacactgattctttgaatctcttgcaaaaagaatcaaaccaggacaaagttcaacagataactggtcaaatgcttaggaatgtctatgtccaccaagaatatggaaccattaatgccatgcttcaggtaaacttgttacaaaatttagtcttcgataaattagtctctgcaaatgatttaccattgctctacattagtaagctgaatgtttcactaacaaataagaaaataaaatatttcatgtttttacagctaacaacttagtaatacctactcagagtacatacttctttatgtacccatatgaacatacaatgctatggaatgtaaagaagtatgtatttttggtaggcaataaaccaccaagggagaattaaactgagctaaaagaagctcttgcttctttctacgtgaatgaccgtcatatggtaaattaacctagtcatgaacagatgacctttggcaatactaacaccaaaaaaaaaaggttatctactactgatagatagaaactatccctaaggtttttatttcatgaaggaaaagaagatccagtgaagtagatttcaattatcatgaaactccttttaaatcatctaagtttaaaacagacatcttacatttttaaattaggcactctcattattaaaatttgactgcaaaagggaaaatagtattactagcacaaaagaatgaggaatacacatgacctattttctgtctccacaatttaatcttaagtatatctcattagtagggctcactgatttgtacagaaaaataagatactaagagctggcttcattcacataataagctatttcttctcattttgataaatgtataattaatattagaggaatttctgaccaaaagttttgttgttttaaaaaggctttcttttttgacagctacaaacatagtggcccttgtccttccttctcaagtttatcagggtcttaacccaaatctctactttaaatgtgaagttaaaacttaaaattaattaaaatgtaagatttaagcatgaaaaatgacaaaattctggtccacagctgtaagtcagcagggtatattggtaacagactaccaaatatttaaaagaaattaatttatctgtattatcttcgaatttgctttctccaaagagggcatgtaaaatgaaagcactatagtcaagaaccaatttatacagatcgaagaactgtttttattgtactatgcaattacaattcaatttctctaaacttgatcaatccattgtttagaaatatcaaaatacttttatttcacacagtttgtatattatttataaaaaattccaaataatgctcttagcaaaatttataagcagtacctgttttaagctactaatgacaaagttagaaaataagagtaatattcacatattctaaccatttcttactaaaagtattatttcaactgaaatatttacacatgtataaaagcataatattttaaattttttgtatcagaaattgaatggaaatgactaagtttaactatagttcattttctgtttaataagactagttaatacaaagatgattttcattttatcagattataaagaatgagaatgacttacacatggcatcatatgtgttactgcatgtttactggaaattataaaaggcacataattttaaaattctacactttcaaagaaattagttcaaagcttaactcacataagcatagcccttctgatcatccacaaaacagaatggcaatgattcatgttctatttggtaagtttacctgtataggtcctaaataccaagaactcaaaatatatacctcaaaagtagaggttcttctataaaaatactcaaagcttattactctacttgtgttttataataaacagttatattggtcattctataggtatacaagttgtttaataatccttctcaaacatcctagcaactaagactctctttgctataatattaagactatataaataatccttagaaaataaaatgacaggctattcatttttaaaagtaaaattatatgctgattctggtgcttgcgagtttaacttatctaagagtattttcaatcactctaaaatgtcacatctatcacttagatcagctgttcatttttaactgagtacatattaaactctgggcatctgctgacactggtataactcaaacatttcaactgtctccctgacagggataacagatgctgacattatcaaatgctgtactatttttttcccatggcctctccttgccccgatatggccagtatatgaaactgaactgccatccaaaaacacacttgagcaactggatctgctaaacagctcccatataactagtaaaaatagaagccagtattattgctatcttcagcacttaagtttaggcagtttaacacctgtttcacttctactagaaaaaatgatgaaaaagaattgtagttaatttcaccagcagtatgatacttaccaaccaacagacgcagaatatacttagtgtaagagtcatttgcatactgcctgaattagcgttgacctctcagtttaaaatagtaactgtaaagaatatttctctactctatatttctctgagagcacttaactttataggcaaattataatttatcaaacttttattttatgcaagaagacacccctctcaagacattgaaatcaacagtaaaaccacattataacaaaaatttactctgatttttcaagtattatccacacaatagattttaatacttgtatccatggattgtaactaaccaccatgtattactaaggcgataatgagaagtaacttggcaatctgtacccaaaatgacaaagaacttagtcaaggaaatagacctttaaaagggttaaattactaagctatgattagtaacaccacgtaagcaaaaacaaagaaaaactggcatgcatggtagttcctttcgacacaagtccaagcaatacactgaatacacatgtgatctatttataaatcaaagggcagaggtactttcttaaggccactgatattcctacacccatcaacaatttgctattagccctcaactataatgctaaaagaagcagtggcagtagaagggggtgactaactgaactcttccccaaccttttagcttaactatttatctggtttgctgcctagagataaatggaaaacattactctaaaatacatcaaggtctatttgttcctttaaatactattggttttgaaatagcttattgtctacatgtaagaattaagcaaagacttcggctgtggacaagattagaaaaagaaaaagaagcaaagatgttgaaaacaaagacgtacattgatcattccttaatgcagtaatgtgttaaaaggaaaagatttttaaaccattaagcgcaggaaaacagtaggaaagtgacttcaaaatggaaaatttgacattcagtgactgaagcattggtatgataatttctaacacttgtagaaggtccatgactgtaattttaccaatgaaaagcatttaactgttttggattccaaactagcagcactacaatgctttgctagagctggtaaaatggaaccaaatcgcctcttcaatggatttggtccccttcaaccagctgtagctatgcattgattactacgggacaaccaacgttttcatttgtgaatatcaattacttgccaactaatttcaacttatttacattatgcagactgtgattataatcaaataacttgttactgttaattctacctggaaaagctagaatggttaaagatgtttataaaaagctttatgaaaaatgtatggatgacttaaggatttcaaataaaaattttactta

SEQ ID NO: 1168 - DNA, 5334 bp, Homo sapiens
agacaactgagaggaaggaggtaccacgggcactctctcgcgagagggccgcagagccgcctttgacgggggcgtgtacctggagagcaacggtaaggacggagccgacggctccggcgtcgggtcggttccggcatcgacgtatcgtttggtcgccccagagaggagacaggtttcttcagcttgccgctgaggatgtggcatcggctgcgctcaccgccgccgcctctgtgaactgcgggagttgggacagcggccagggctagatgggtgggacgcgagtcctcgccgaaagcttgccctgtgcggggcgcacttggaggcgagctctgggccgtggcgagttttgcagcctaaggtcttggcaggcgcattgctgtgggctgccggagagcaggctggagttcgagaccgcccaccggagagcaggcgagagttcgaggcctaggtacagcgcatttcgctaggcatccccaagaatatccgcgtgatccttgtggccagagtttgttgagctaatatccccagcccaaacagtagagcacatcacatgtcggccacctgggagcgttgaacctggtagttactaggcgcccctggtggaaataaaactcattatgccctagttatgtcttagtgcctgggtgacgatgatgtagcggttaaagattaactgagcgcacttagaggttgtctttgtctacctaaggaaaatatcaatagattaaacccccaaccttaaagaatctccgtgaatttttctgaggaaacgtgcaatattgtcatacaaaaggccccaaatatgcaaacattgctttttgttaaaagtttgttttgttttgcagtgacatctgtttgagcagatgaatatgccattgggaaagtcaaggactgtcggagaggaggacatggcagaccttaactaaagtgagggggacagtagagcactaaaagttctaggaaaggagatgaactgcttattccatcagatgaaaatatagtcagaacagatgagtagtagaacttaaacatgcccggagttgccaggaatttgcaaaagccttgatataattcctgttgctgtagaaagactttctacagtcactaatatatcaagttatgttcactagaaaaaaagtttacttagtttatagaaatgggctgaaaaatcctaattacttatctgtgaggttattttcatgaaggttaatcatccagaaactattagagagcctcggaatatatttcttctaatctgctctacctatcccattcaaaggagggaatctgaagatttaaggacaaagagcagttgaaaactcagagctgtggttaatgggagaatttcaaggatggtgaaaaaaactaacatcattgcatccctgttttttgtattctggactttttagtttagctcttggtaaactacatcagaaattctttatgctaactctaacacacattttggggtattgctaatttaatctttgaatactgtttttgctgtttcatgattatatgttatgtcctaccagctagattgccaactcttgactactgactggaagtttattgtttattcagcaaataatgaattaagtcagtgaagtgagagatttcgtgtgtaaggattgttaacttgaacatttcaccagttacacacagttcagccctacttaaattttaaaaatcattgttggcacttgacattgttatgaggagttttgtattttcaacttgtattttgagagtgtcctcatgtgactgaagtatgtgctactcttcttaattgaataaccccagaatctccagaattgataattggaggaaattctactgttggaaagaatggatggattatacagccctgttttttgactgttcattttgtccttggagtcactaccacttggcctcaaagtgtgaacatgtaaccctttccttaatactttgctacacagctgagcagaaactgtaaatttggatcctttgtcagtacaacttaaaatggaacaatttcaatggcttagggtaagataagtatgtaaagatacttttgtaatagaagaaaaaacattggatattaaaatcacacagtagtacctgggtgtggtggctcatgcctataatcccaacgctttgggaggccaagacaggagcactgctggaggccaggaatttgagaccagcctggccaacatggtgaaacctcgtctctaccaaaaaatacaaaaatcagccaggtgtggtggcacatgcctgtaatcccggatactcgggaggctgaggtgggagaatcgcttgaaccagggaggtggaggttgcagtgagctgaaatcgcaaaactgcactccaacctgggcaacagagtgagacctcctgtctccaaaaaaaaaaaaaaaaaaaaaaaaaagtgggtgtggttgtgtacacctctacttcctgctactcaggaggctgaggctggaggatctcttgagcccaggagttcaagtctgcagtgagctatagttgcactgctgcactccagcctgggtagcacagcgagacccccatctctaaaacataaaagtaaacaggctgggtgcagtggcttacacctgtaatcccagcactttgggaggccgaggagggtggatcatgaggtcaagagttgagaccagcctggccaacgtggcgaaaccccatctgtactaaaaatacaaaaattagccagtcgtggtgccaggtgcctttaatcccagctattcaggaggctgagacaggagaatcgcttgaacctgggagacagaggttgcagtgagccaagatcatgccattgcacttcagcctcggggacaagaacaagactgtgtctcaaaaaaaaaaaaaaaagtagaaaacagaatagcataaggataatcttatatacaaaataagactactcaatttctgaattttttttttaactagatatgccacctcctgatgacagtgcccatttcgtaacttgtcttactcagaaacagctcttagataattttactctttaagttcaggtctgagcacagaggacaaagaattcccttgattgcctatgaaagaaaggattctcaaccttggcactattgacattttaagtcagataattctttgttgtggaaggttatcctgtgcattgtaggatgtttattttatcagcatccctggcttctacccagtaaatcccagtagcaccccaccaccaaccaaaactgtctcaaaatgttgctagatgccccttggggacaaaaatcctctccctccctcctccttgaatgccactggcactccttgagcctacagaagggctcttctcacaagtttgataccctgtacctcccagttgatagtgggaattacttctcctttgaagacacaattccagttaccctgagaagtatggcattggccttgctggcctccaccaaattactatatcactgtgtttggtaaccccagacatcatactagggctttaatttcagtatataaatagtaaattagtatccttgtataggttagcttaatgagtttcagaattcttcaagtcatatcttcataggtaggatcactgtggagttaatggcatttgaactatgtactcagtactatgctagtggttggtgcaaggggaagatacaaaataaggtgtgattttagcccatgaggaatttatactttatctgcagaagcaaattaatatggaaccgttagtgaacacctggataaaacagaatgctaaattttaccctagaggtgcttggcctggacttcaagaattctaagtgaattgaagtatgttcacagtaagaaaggttaaaaatggctctgcccacttgtaggcagatgggaagctaggatggcagacttgccaatatttgatatatgtaaaaagtgcaatcatggcctctgttgtttcctcttttatctcgttctctttattagtccaggttctctagaggaatagaactaataggagatatatatatatatatatatggagtttattaagtagtattaactcacatgatcacaaggtcccagaataggccatatgcaagctgaggagaaaggaaggcagtcgagtttcaaagctgaagaacatggagtccaatgtttgaggacgggaagcatccaacatgggagaaagctgtaggctgggaggctaagccagtctagtcttttcatgtttttctgcctgctttatattctggtcgtgctggcagctgattagatggtgcccgcccagattaagggtgggtctgcctttcccagcccactaactcaaatgttaatctcctttggtaacactctcacagacacattcaggatcgatactttgcatcctttaatccaatcaagttgactgtattaaccatcacaagtccaccacttgtcaacttaaacacatacatatctcctgagatcattcataatcttcaaataaagacaataataatgtcataattacacctaatacaactatcctttgtacagctggaaacacaccagtccccaacccaaatgctattacataaagttaacaatacttaaatgctgatatgaagtaaatcttaatgtcccatgataaaaggaggctgggcgcagtggctcacgcctgtaatcccagcactttgggaggccgagatgagtaatggcttttgacagtaatagagggtctcaacctgatttttcttaagtttgcataaggcttaggagaggataaaataaggcaggatctagagattggtgaggagaaacggaagtcctcattcttgacagctctcagcacatgcagccctccccacacacacagtcacactcacacacactcacaaccagattcacattcctacccatgcacacactaacacacacttgtgcacttaaactcgtgcacttacacattcacattcatatactcacatgcacacattcaaaacacacacatactctacaaacactcatgttgcaaaaggggatttgtaagctgaatgtttagaactcagaacacatattttcacaaaaataatattatggtcgggcgctgtggctcacgcctgtaatcctagcactttgggaggctcagctgggcggatcacttgagatcaggagttcaggaccagcctggccaacatactaaaaatacagaaattagccaggcatggtggtgcatgcctgtaatcccagctactcgggaggctgaggcaggagaatcacttgaacccaggaggcaaaggttgcagtgagccgagatcctgccactgcactccagactgggcaacaagagcaaggctccatctcaaaaaaaaa

SEQ ID NO: 1169 - DNA, 4722 bp, Homo sapiens
ctcatgcttccataatagttctgggataattctaaacacaagccatttttctaaggagagtccacattagagaggtctttgttttgtattcaagatgattaaaattatgaactgggaagttagtccctggggtgtcctggctggcctttggaaatcttcactacatctttctgggttggaattctcaccacagcctgaacgtggggctgtatctgagctgtctctgagtgctgtccatttgatatatcgagtactgggtgtttaccagggctcttcaagccactgggagaaacagctaaagagtaacctactgatttgagatgtggatttgtgccccatccctttctccttgtttcccacaggagttttatctcaaactcctaagccatttttaaggagatcactggaacaaactccaaacctaccctctaatagtcaagtttacctgaattttctcagttctctcgggagaagactaatcacacattgtagtaccaacttggactcttcatgtgcttttcttaactgattagagttaacacctcagctaaagtgtatagaacatacatggggcttcatcaggcttcagaatcagtttcactagatgtgctatgtaggaggccacggaaaaattactgtagtagtaaaagttatcagttctgatgtaaacaatcattttgtcccatattataaataaattggcctgaaaatatcttttcatatgtgaggaataagtatatgatgcctttctcctttaaagtatgaactgctaaaagacagggataacgtgtattctgtattccagcagccacagtgtgtttctggtctttgtaccaggtgctcaggaagtgttttcactggcttgggttgactacttgccatctgctctctgagcattcatttctgaatgaaaggggagaaagtgaaaggagaggtgggaagaaagaggaagctgcagaaatacgaggaaacagctggaggagggaggtgaagttgaggaggtaaggtcagtaaaacaaaaagctagcagagggcagggtcaggcccttggggtagagggctaattaacttctgtcagctagttgaatagagccttgtgtgctttgttagagaccaaaggtacttcaaaggaaaaaaatctagattcttccctgtgtaccttaataattgttcatcaggtcaaaatctatcctgtcctctaggaattctggtcttccctcaggcctagcagagagctttctgccactactcaggcaaccaagggtgaagtgcttcaagtagtatttgtggacagcagcaggtaagcttgatgtgttattcacagcttaaagagtagatgctgagtacagctgttgtccatgtgtagagcttttaataaccagcgcagcaggccccttcacctgcttttatgcctggaccagatgactgaatgtagaactttaggcacttttttttttttttgagacggagtctcggtttgttgcccaggctggagtgcagtggcgcaatctcggctcactgcaagctctgccccccgggttcacgccattctcttgcctcagcctcccaagtagctgggactacagactcccaccaccatgcccggctaatttttatattttttagtagagacagggtttcaccgtgttagccaggatggtctcaatctcctgacctggtgatccacctgccttggcctcccaaagtgctgggattacaggtgtgagccaccagatcggccctttaggcactttctacttctcaaggtcaagaaacatcctttaaaaagttaattcccttttctggagcctaagccagatcttatctaggccttgtgttgccatctgttagcattgatttctggaatggagcagctttctcaaagtttggtcttgctagtcatgaggtcatgtcagtgtcttaggtcactgctgctcaccttccttacccagggagtatactgcataggtttctgaacacctgttttcattattcactgttcctctcactgccaagaatggagggaccctcagttgaagatcaaattgactctgaagaaaaactggagatgtttctcttggagtttggatagagtattcacttgataacatgtttttcccctgccttgctcttcacaagaacatctggccaggcattaacaattagtaaatttttttgcatatgaacagtatttttctggtcatgtagatgggtgcacatgacactaaacagcattgtttagtgttatccctcttaactggtgggttgtatttggggtggaggctgtagccgaggagaagacattcacctctgtactcgagaaactttgtgtaggaatttagtttatttttttattttttttaattttttattttttactacttttactgttagcacaatgctataattgagctaatctttgtagtttggtgcaggaccaccaagtttgtgtgacccattacctactttttccatgctcagccattaccctgtcctggggcatctgagggcagtaaggaacaggtgtccaaaggaggaatgttggtgcctatgagtatgttttccagttgtattgaatttcttacttggtgtatttttgacttgtcttagtttctttccttgtggtctatgctattttacttgcgatttgttggatattctccctgtcattaaagagttgtaaaatggaagttagtttctctatgcaaatgctttaatggatgaagctgataggtttagcattgatttttgctggtgtccttcaacaagcatgaaggtgataaatgtgtttccatggctttagactcatttttgaagtcttggattgtgtgaacattcttagaaacaataaaatgttttaattaaaagccctcgactaccagctgaattcagtgtctactaggaaaatgggtagatttgttacattgtccctttgctctctatgactttgttccagttgtcaaggaacttaaatgggtattcaggaaaaagaattcttgtttccctttcctcaccttgccagttaaataactcctggtgacacttcaggtggtagaattgaaacacaaacctgacttctgaccacatgggtcaaaggcaaaaggcaaatggcttcaaagcccttagtgtgcttatccagttcaggcagtgaggagataacctctgctttcctccctgaggagtttggagtatttaaggggggatggggggggtgtcactttgaaaatatgttgctttttctcctgattgtattgaggctgatatggaagggttatttctttctggccaatactttttggtatttctaaatattgcaatcttgatttttactattaaatttgttaattgtcagttctggcttttttgcataaagagttggtccattaacttgccaatttgaagcttctaactagatattccctactgaaagttttggatttgtttttagtttgtggagcagtcttagctggggacaggtaattgacaacggcagagatactttcttttcctaggattctaagtctgtaatccacatcctcaatgtattcacaggactttaaaattctctccaaatgaggaaggaaatatcctgttgctttctaatgtttactaaaagttgtgtttagaacaacagattttaataggcatcttcctttgttatgtgtcattagccctttgcccgtttaccttagggctctttgaaggagaaatggatgggagaaaacctgtcacttggcgaaagtaaaagggataattaactggctcagagcttatgtgcagagttccaagccccaaagttaatctagaaccactcgataacaccaataaaaatatttatttcacatctgttatatatctggaaaatgttctaagcatcttacacatatttctcattaaatccacaggtgaccattgtgaggtagatattttgttctaattttccagatgaggaagctgagaccctaaaaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctggtgactgaggggaggaaagaatgggagggggtattcttgtctagtggatggaaaggaaacacactgtcaaattactatatctccttggttttctattacagtagaattctccagccatatttttattgtctatgggggaagttggagatggtgaccttgattagaagtgtctggagggggataaatggaggggataagattcagttggttttggaaaatgttaaagtcttaaaataatgcgtccatctgaagaattttttctaaaaccagagtttataaaaatatcactgatacagcctgccccctcatttccctgccacaggagatgtcttggactagagacacttgtttaataatagcttgtctctgatattcccagtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttgtct

SEQ ID NO: 1170 - DNA, 2067 bp, Homo sapiens
ccgtaggagcgaagtcgaatggcgcccccagcggcttggggtgggatctcagtgcctcattcctggcggccccgggagggcgatgccaagtttcgctcttgttccctgggctgcagtgcagtggcaccatctcggctcaccgcaacctccgcctcccaagttcaagcgattctcctgcctcagcctccccagtatctgggattacaggtatgcgccaccacgcccggctaattttgtatttttagtagagacggggtttctccatgttggtcaggctggtcttgaactcccgacctcaggtgattctcccgcctcggcctcccaaagtactgggattacaggcgtgagccactgcgcctggcctactaatactaggttttattccgggcccttcacagttaatgttggaggcctctggaggatggccacacctgggctatttgcagaagcctggacagcacagcaggcagagttaaagcagttaaggcagtatcagctgaagggccacccagctgtgcgtgtgcccaggctccaagaataaggaggttggggggcagtcctaagaaaggaagtcattacctatcggcaacccaggagcagacgctggcataacggcgcacacacagtaaaggtcagaggttcttcttagaatagtccttaggtgttagtcaaacccatgccctgccccaaggagttcattcattcattcactcattcattcactcactcactcactggttctgtttattcactcatttctctatcacatatccatttattgtcattcacccacttatttactcatacattcattcatttgctcatcaatttatttggtacctacatggagccaggtacaggtcttgattaaagagatctggggaggagtgctcccaagaagttcagagcctcactggtgaaggaaagccatgtaaagacagatcttgagaacccaagatcatcaaggagtatccatgatcaagcagagcagggaaggctttttgctttgttttgttttgtttttaacatgctgtgtggttcagtaaaattaaaacaggcacaatgatatcctggatgacaagagctggaggctgtcattctaacaatgtagtgagactggctgtcttgtctcatgcccacccctggaaacatgcgcaggaactcaaagcacctagcacagaggaagtgtctggttgttttaaaggaaaaacaaaaccaaaaaaagcacctcctgctctgaccacccctatttccagttttcccttttggcacagcaaagatgaccttgggactgaggtggaaccatgtaattcttcgtaatcccagagtcaggcagacctgggtatgaattccatctttactaactgtgtgactcactgtgtggccatgccaagttacgaggtctctctgtttcctccttcctaaaaaggagataacatccatctcgaaggaagatctggcctgaagagcagtcactcttgcctggcatgcagagaatgccaaatcatattaatgactggccagaatgaagtgcgtgacctcatcactccataactgacaggaaacaactgctagggcaagaaaaaagggtctccagtgagtattcttgtccacacacatccccactcacgttcctggaccactgcatctaactgccgcagcagctaatgaaccttctggaataaaggaccagtttcttaagaagggattgagacctccagtggcctcccacattgtttccggcaagaatttaaaaattatttgtaacatatagtaataaaaactaaccacaggctgggcgcagtggctcacgcctgtaatcccagcactttgggaggctgaggcaggtggatcacctgaggtcaggagttcgagaccagcctgaccaatatggtgaaaccctgtttctcctaaaaatacaaaaattagctgggcatggtggtgggcgcctgtaatctcagctactcaggaggctgaaacaggagaactgcttgaatctgggaggtagatgttgcagtgagccgatatcgcgccattgcactccagcctgggcaatgactccgtctc

SEQ ID NO: 1171 - DNA, 898 bp, Homo sapiens
gggagacatggttcatttcatagcatatgggaaaggctgagggaagagcaggtttaggagatgagtacaagagctcagggcctctgatctggacatgatcttcatcagatcacactccagctatgacagtgattgtccaagctccattccctgtctctcctcccagactaggacatcttcttcttctgggttcccacatcattctaggttccagtggcacttttcttacttgatgcaaggatgtgggatttgggaacatggtttcatctctccaaccacaataccagcaactttcaggcaactgtctgatgccacacagcaaatctgccccagggcagagggggcagtaggtaggcagtaactgggagcacaggcagagaggctggcatgaagaaacctgcccatgggaagcagggccaatgccacctaggctgggttcaaggatgtggccaaaaaagcagaacttccgacaaacttggaaaactagtcaggttactgaaacaggaacttaagcttctcagcaaattagacgtaacatataaactggaaaaatcagtgaacttgaagatagagcaacagaaatgatctaaagaaatataaagagagaaaagaaggctgggggacagaacagagcacccaagcattgtgagacaacataaaatggtctaacatatgtatagttgggatctcattaagaaaagagagcagagtagaactatttgaagagataatgaccaagaacttgttaaagaaaggcaacataccacaagtccaagatactcagagaaccttaatcagaatttttaaaaaaatccacctagatgtgtcatgatcaaactgctaaaaaccaaagataaattctgaagacaaccaaggaaaacagaatgccggtgtcccc

SEQ ID NO: 1172 - DNA, 534 bp, Homo sapiens
atatgccattcaagctaaggggtgctacacttgaccgctgcggtagtatagatgagtctgaagaatggtatgggatggatactttcgaatgcactggagtaggggtctccatccgcagggccacagagccggagaggagcagtggctggatctaccatgaaagacttcagagtccaggaagagagactgactgggcaacatgttattcagttacaaaaagacttggactatgactcaaaaatgatcaaataatagttcatgcatcaaatgcaataggaagtacttctggagggtgagagaagcatccagttaagcaagaagaacttttagtaaatacattccttacaaacaaacagaaggcaaataaacactgttgtacaggaacttcaacacacactgtacaatattcccactttgctgatgtcagttatggaaattcttcatggtttacttgactatcgctatcagtattttgcatctctcatcatttttgtcaacttcctcatctgctaacttctctccaagggtcttgct

SEQ ID NO: 1173 - DNA, 7083 bp, Homo sapiens
gatgaggaggtcggcgcggctgtgctgcgggcaggcagcggagagggctcgcggcgagggctccagcttaccccgccgccgcgtcgcgtgcacggagcgcttcagaggtttggagggggccggaacctcaaaagcaactggatgagcacaacgcggacgccccggagaagcggcgcaagcgggcccaaaatggttgctgatcagacgagtggcatctctcgcccccctaccgcgggaattgggacctccagactgtgcctgggggatcggcaagtggttcccctctggttttttcggcgctgccttcccggtggtatcctcactctctctctttgaaatgacctctgctttcctatctctaactcttcccagatatttgaaagcaagtttttgtacaaagcaacatatgaatgtattcagccattcgatcgttcggcgaacatttctaggtgtctcgtgctgtgccagatattgttctgagtgcgctgaagatgcacctgttagcaagacaaagtcctggctcccacggagcttattcgaagcaataggggcccccaagcaggtgcctgagaagtagggaggggtggacagtgggaaaacaacctaacggtggagacacacgaggggtctttttttacttttagaaacgggggtgggtggtcaccctatgttgcctaggctggtctcgaactcctgggcccaagcgatcctcccgactcagcctcccaaagtgctggtattacaggacaccatgcccggcagaggggtcgtttttgttgtttttttagtgtcgtcaggagactccctccatcagaattactcaggctgattgttttgagtcctgggacccagttggtatccagaatcttggcttgtttgcctaggaacctgcattttcacatccccatctccacacccctggtgattcttatgcatataataatgtgaaaagcattgcattgaagaattgctaaagggtgtcagaaaacggattaacaaaatcaggaagctttaattttcaagattctattaacctcaaaattcaacatatccaaaaattgaatgtctttttctccagtgttttctaggagagtgccaacactagccacccaagtgctcaagccagaaacctggaaatgatccattactctttcctctgtctctggagtccccatgttaaattagatgtgtttgtttgtgagacagattctcactctattacctaggctggagggcagtggtgcaatcattgttcactgcagcctcgacctctctgggctcaaggatcctcccacctcagcctccccagtagctgggactacaggtccccaccaccacgcccggctaatttttgtatttttagtagagatgaggtttcatcttgttggcccgggctggtctcgaactcctaggctcaagtgatctgcctgccttaacctcccaaagtgctgggattacagccgtgagccactgcacccagccccaattagatttttaaaactgttgttccctgtcagttcttactctggttcaggctactgtcatctctcctagagacactgcggtagactcctcttggtctccctgccaccgaaattgccctctccaaatccactacagcttgaatggtctttcaagaaagaaaatcatgttttttccctgtttaagactcttaaaaagatctgattaacacgtaggataaagtctaaaattctttgaggtggctacagggccattggtgatctcatccctgttgccatctctgacctcatctgccacagatatttctcaggctacactcaaaactgggaagctctcaggtcatttaagcctggaaattgtgccacctcacaactgttgcaagggctgttccctttgcccataacttcatttctctctacaccatctatgcacttacttgaatcctcacctgaataattcttaccattctttcagatcccaacattaataccatcgcctccaggcagcattttttcatctcccaagattgggtgcattagaccctttgtcatcacacccagtactccccacgtttattgagcgctcacgatgcgtcaggccctagtggaagcctttatgcacattatcttctttctcatttaattatcaagtagagcccacaaggtaggtactaccttttttttaacttttgagacagggtctcactgtatctcccagactggaatacagtggcgcaaacacagctcactgcagtctcatcctgggctcaagcaatcctcccatctcagcctcctgagtagctgggaccacaggcagatgcctgttgcccaggctggtctccaactcctgggctcaagccgttctaccttagcctcctaaagtgcagggattacaggtgtgcaactgtgcccggcctgggtagttactaatattatcccattttacagatgaagaaacaaggacatataggggttacttgcccaaacccagacaataagctagatctgaaagtcatcagcctgacctcagagttgtacttttaaccattatcagggtctcaggccagtacccactgatgaaacacataagtaacttagtgggtcattaccaacatttcattaaagaaatagaaaatggcagagaacatcaaacttagtaaggctcttgtttcgtgaaacttgtcagattctctaatatgataaatactaaatcttacaaacattgaaaatacaaaattaaacaaaatattaccaaggttaacacaaaagtatgaatactgcagatctgatttattttactatcctcatctttaatgcagaaccttcttaggattaaatgacatttaccattctgagcaaactgaggttactgccccaaacggactgggcttacctttgcaggagaacaggggaggctgtgttttggctggagatttttggctaagagtcaagacacagagattcttctgctaccactgtgaacacatcaagtccctttcacatagatgctgtttccacaagggtctccccacacccttccctacagattagattcccgtgatgccttatttaattcttgttggatctgttgatttggttatgaagtaggtgaaattctggtaacctcacccaggttccttcccctcttgattagatccagccagtctgttcgctggatgattaaatttggcattcatttttctgtgctttccctatctgctactatcctaaagtcattctaatgaccaaaaaaggtgccttgagccagactgtagagggttctaatggcctccttagaaattgtgtttttttgttttttttttgagatgaggtttcgctcttgttgcccaggttggagtgcaatggtgcgatcttggctcactgcaacctccgcctcccgggttcaagcgattctcctgcctcagcctctcaaatagctgggactacaggcatgcgccaccacgcccggctaattttgtgtttttagtagagacggggtttcaccatgttgcccaggctggtctcgaacccctgacctcaggtgacccacccacctcggcctcccaaagtgctgggattacaggcctgagccaccatgcctgccaaggaactggttcttagtaggcaatagacagttgacaattttgagctaagcactaaggtcataggagtgtagattcaccagggagtgagttgggcttctggtctctagagggcgctcaaggcttctccctccccaccctcttccttcccccaaggtggaggtaggatggtgaagaaatttcatctccccaccaccaaacacacacaaaggaagaaaatcttactaaaattggagaatatggaataacattttcttgggatggagcccttaaaagataacacgttcaacagaaagtgctgcgtctttcccgttcttcaacatactctgagtggtaacaagggctgcccttgcctttctcagaggcagcccagccagcttgttctctttccctctcccacaaggtagccaggccctaaggctatggcccacagaaaaagtcttagcaaggccccgggcttggggcaaagaggctgtggatttgtctttctctctactttttctggttagtgtgcctctatcccactcggaagaaaagttccaagactcaaatttgggcattgatgtggggaggatagacagagatgaccagaatccagcctatctttcctgacttctgcattgtggttcatacccagctaataataaagtgttcctttccctggtgtgtcattgcacatgtactccccacactcctgatgagtagagatggctggccaagacaggattcagacattcccacatccccaaccaaacatcctctccataccatcttattaatcagtctttgaacaatttcctaaactccctaacaggttggagatggctggaagaaatgaaaagaagaacgccaacaaaggcgataaagaaaaattcaacactgcttgataactgatgagatagtgaaggagtaggagggcaaaagtcagaagtaattccaggtgttcaagaactaaatgctgaagagatgttagtgtcgttgacggtcttctaatgggaagtgaatttcaatagaaagaggatgtgtttggtttcagacagaccgagtgactggtgacaacaggaaagccacgtgtttggagcagattactcggtacagtcagcagctggaatggaagtgaagaaggcccagcagagcatcagacctgagtgcaaactatggtggtgttggtggaatagagggaagggagagatttgagagacattgggaagaaaggttttggtttttgagacagagtcttgccctgtcatccaggctggagtgcagtggcataatcttggcttacagcaaactccacctcccgggttcaagcaattatcatgcctcagccccctaagtagctggaattacaggcaagtgccaccacattcagctaatttttgtatttttagtagagacagggtttcaccatcttagccaggctggtctcaaactcctgacctcaggtgatccacctgcctcggcctcccaaagtgccgggattacaggtgtgagtcaccatgcccagccaccagaagtttaatcaaggctcagagactgattccagtttgagttttctaataactgtctaatacttagctaatagctttggacagttgctctttttaaaatgagatcattcaatcattgcattcatctttgggtatgactcactagtcaacagagtcccccttctgtagaaactgcctcattcacagagatgacctccaccagtcatgcctatatttgagaccctgtctctctttatcccccattgctgcgtgattcaagggtggtcacctgacccaggcagtgccaagtttattctctgtcttgggaatttagaatgtttgtttggctaagagacacagaaactggaagctggagctgatgatggagctgatcacgctaatgatggagctatagagataagatgcatgaacaccaccgaggtccccaagattgccatattcctgcagtgccttctggccacagatagttggtccagaagcaggttcctgactcaacctgggccaattagagcctttcacggagattttgaaatcaaagttgagatctctctttctctctatgccctttggtgtatgtgtacttgagctacaagttacccaactttggaagctgtagacagaggcaattttccactaaatgaagtgagaaacagaaagtccatcattagtgagagaggagcaaggcagatgcacacagagaagcagatagaggggaagcgggcgggagtggggcgggagttcctggagtccccacagtgctctagtttctgattctcttcctaagacccacaggattcctgcctttgggtttcttaagttcctgaatagctcctgattgcctttgtcttttttacgaaagtcctttgagcatggtttcaggtgagcagacagtcctaacctaaagagctgtaacaaatacacgtgggctgtgtgtgagattcggggagaggcaccagggatccagtgtgggtcaggcgtggtgccgccctcaaggaacttagtggggagaaaatgaagtctgtacttcaataactacagtgcaggctaggaagagaacacccttagagatgtgcaaatcaagctctttgggagtttagaggaggcctaggactgctaaggaaaggctgggactaggaagaggtaagcaagtcactgaggaggcaaaatttaagaagccacccactctcagggtgtgtgaatgcagcgttggcacttgcatgaccctgagaatgagcaaccccttaaatgtatcttaggcaccttgccagactcacttttagcttgctggactaattgtggggatcagtaggccttcagaggaaagttagtgtctgagctgaactgaaggatggggtggttttggacttggtggcaatgtcatctacctcaaggtaaagtaacaatatggaaaacgctcccgtgaaaattcacaaggtctgttctaggatcatcaggctcttcggtgtgacttaagagttcagagcatgaaggaggagggggcagtaagaaaaatggagagaacgtagcatcagattctgcaggcaaggagaaaattgctaagctgggaaataacataatcagagcggtacttaagatgaatctaacggaatagcatgaaataaaggaaaggctaaggagaggacaaacaggaggctattgtggcaatccaggcgtgaaagtctaaactaatcagcactgggaatagagatgccataggaaaaataatacatcattaatataacttggcaattgagtagatgttggagacaagagagaaatcagaaacactgctaaacactatgcagctataacaaagaatgagagagcattcagtaagatcacatccaagatatgtacatgaaaaacacaagggatagaactgtgtatatggcaagctatcacttgcattttttattttttaaatggtatttatttatttcttgttttttcctttttttaagactaaaaaatcaattataaaatcctcaa

SEQ ID NO: 1174 - DNA, 199 bp, Homo sapiens
gcgcaggcgcccagaggcgcacaggagacctcaggcccagactccactccccagctgtgaaaggactgctggccagacccccaagctagcccgccaggcctccatagagctgcccagcatggctgcatccagtaccaagagttggtgggagacgggtgaggtacaggctcagtctgcggccaagactccgtcctgcaag

SEQ ID NO: 1175 - DNA, 237 bp, Homo sapiens
aaggagaagcagaaatgagaaggttggagaaatccgaagaggcagctagggagagtgggagttctgggggctgagaagtccaagatcaaggtgctgccaatttggttcctggtgaatgagcaaacagcacagaaaaagaaacagcagtatatgtggaagaaagcaagaaaaatcaactggcctggaacctaagacttgtccaaagatgtcacagagagtaaaatgagaaaaatccag

SEQ ID NO: 1176 - DNA, 453 bp, Homo sapiens
gcgctggtgaagcggctcatcaggtctatcaggaaacctgagaattggagtgagaatcccagtgtggaaaatcaggaaagaggctggtatgagcgacagagaagtcattcaggaaagaggttattgaattcattggagaatgaatgctgttctgaatttgtatcttaagggaaatactacaaaatgtcgcagaaggtgctggatggatatctaaagttcaaaaaggaagagaaccacacgagctggagattcaggaagcatcagtagaagtcaatggccattaataaaaacattttttattaaaatattgaatctgaatagaaacctcctgtacttcatttcttaaatcccttgagggtagtaactgcatcttctccattgatatagcccctgccaagcacagtgcctgaaggcaggtccacagacattggctgaataaacgagtgctctgtt

SEQ ID NO: 1177 - DNA, 768 bp, Homo sapiens
cgtctcggccgcggagaaggcgagcagcgagccctctttggccaggaagcctttgccgtcctccgcgtcagcctgcagcgcctccgccttgtcgaagttaccgccgccgggcagcggctgcggcgcgaacttgcgggccgctgccgcctcctggtgctggggcgacgcggagaagccgccggggagcgtggccatgagcgtagagggtagatctgacgggtggaacaaggatgagttgttcagagtcaagtctgcaagggtgagccagcagaatgggggtgaggtcccaacactgcaatgacctgggcagggcacttcacctgaccgaaccccaggtagagggagaatatcacctgcctctcgtgtttcactgcaatgtggtgaggaccgaatgagagaagtctgcaaatgtacgaagcactctcattaacaaggtggatgatcagattgggtaattttgtttcagatcaaatgccagatgtggcaaaagactgattttcatcgttctgaaaatgacactgatgatgagctgccaaaatattttgagctctgactgcatcatcgaaataagtgcctggcgtccgtccccaggtgactactttgaaaggatgcattcttcacatgcaaccccttaattgtctcgtggctctaaccagaaggcttctaggcccctgttcctcaaaatggggtcccaggaacagcagtctaggccacacccgggagcttgttggcaatgcaggctctcccaccccagaccggcagagcaga

SEQ ID NO: 1178 - DNA, 399 bp, Homo sapiens
cctcccctcgctgctcaccttggttcccaagagccgggcggccgcaagacggggtcttgccatgttgcccaggctggtctcgaactcctgtgctcaagtgatctgcctgccttggcctccaagagtgctgggattacagctccgactcagattttgaacggatgtttgcatgtataccacagtgctacattaaaaaccagtcatgtggatgtggagaagggtgctgatcaggactccctgtttgctaacaaattctacagcagaaacaaagtattaaggtttgcagccaggaagcaagtgcatggggaataagcctgcagcttcttccaaatgagacagagccaaatcttttttctgagtctgttttcttcatttctattaaaccaaggtcctttttaa

SEQ ID NO: 1179 - DNA, 1036 bp, Homo sapiens
agaggctgtgccttccacaaatgctatcctgtatctgtcagaagcagctatttctttgccatccttaaaccaggacaccctcatggggagggagcctgcaattttgcagtccagtctgcagatgtttggcttccagcttcattttcagccaggcacgtgtatttgcctccaaaactaatctgaacatcagggattatcaagactgcaacaccattggaaaagctcattttgatttttccgtcttctctgatgacctcttgacctttcatccatgtgacagaaatgggctctgaccctctcacagcagcttgcaggctaatttcaaatggtccagtgcctgagacttcacactgaagtagagcatttgttcctctcactatgtctgcaggctcaagagttttgatgaaagaaggaggttctacaaaagcatgaaagcattgtgtggaccttcttattgatagcggactgcacaggctctaattctttaatgaaatgtggcttatcaatgatgatcaactctgcttggcagatgtctgctccaaacttgttggaagccttacaagaataaactcctctatcttgaatggctctgcagtacctacctaccatgttactgtcttggttgttggtctctccagttggtaatacaagcatttcccacacatgtacagaaagcaaaaaggacaacaatatgaaatgaagtgacaacatctgtgccaatgtatggcatttacctgtcacagttagtgtggctgtacagctgacactgccatactcattggaagctttgcatgtatactcgccgcagtcaaccacctgggttctcaggatttcaaggctggagatatactttgaagatcgaatagaacacttgtcactctcataaatttctcggccagctttaaaccactggaaccggacattgggagcactttggatctcacagcatataagcattagaagacaggactcaagtgtctgctggctgtaaaaatactggagaaactcatctatagcatgcagaatacatattcag

SEQ ID NO: 1180 - DNA, 690 bp, Homo sapiens
tcggatccgtttattccaaatgtcccagcccacgccgtgcccagagtgtggcgacacgaggccaaactgcccacctactgaaaatctgtctgtgtgccgagcacgcgctccccatccctctaccaaatgcctggctggcgcgtcatccctggctttgatggacggagtcttgctgtgttgcccaggctggagtgcagtggcatgatctctgttcacttcaacctccgcctcctgagttcaagcgattctcctgcctcagcttcccaagcagctggactacagcagggatgacggcgctcctggaggctggctgggaagctggtcagggtcccaggactctgacacccccaatggcccttgtagccttggggagtcctgtgatccaaggctggaggactgagtcccctccaggtctcatagcagacgaatagcagcttcacccaggcctgttttgtcgtggccccattcagaggccgccctcctctgtggtttagagcatgccctggaatccctagcacaaccaggggttacctcctgctggctgaccccttcctgtgctgcgggctggaatatagggtttaaccctgttataacccagaggaacacaaaaggaggaacatcaggctttatggagagactggaaatgaagtggaggttttccttgctcatgaaacctggctcaccctacag

SEQ ID NO: 1181 - DNA, 2890 bp, Homo sapiens
ttagaggatcctgtttggtagttaaaaccgtattaaaatagagagggaagaaattaagcctccttgatggtgaagagattgggaaccaccactccagtgttagaaaatgtcaaatgacagaaggtgggctatattaagtgggaatttccaaaccccaccccctggaaggaaggaatgcttggtgacaagccttagaggagagagatgcttgtctagcccattgcctgtgtgcccaggaagagatgtgcataccttgagatatagagaagactctagtggggagaagccccaggccagcttgtcagcacagggcatcggaggcccccaaccagctccaagttctgaacagcacacagccttcaaaggcttgtactgctgctcatacccagcagaggccttgcaccaggcctccccatgcaaatcagtgtccccgcagcgtaggtaaaggagctctagctgtgctccctatgggggaacagatataccgtgggacactgagagactggaagattgcccaacatttatttactgatctgtgttcaccacagaacctaaggtatttattggtattgtttcaaccagtacgagtgattctttcatttagtggtcatctctgcactccaccacagacttttgggaattacaagatgaaaagggccacatcctcaccctggcatagctcagaaaatttggttggggaagtagggacatagacgtgatcactacaccataatttactaagctgtgagaactggaggtgcatcagtgaccagagtgcatttgagccagaggtagaaggtactgtagacaaaaggaacaacatgcgctctaggctgtatcattaggtacaattttctgtccttgggggagtctttttaaccctaagacaaaaattatgaatatagaaagaggccacggttcatctttgcaattctttcaggagaaaatttgctgcaactcactttctaagtttaaaaaaaaaaagagtaaatgatatgaatatcacctgaaagaatttgaggtctcaaacttgggaggatctttgaacaacaatcttggggaatgcctaacagttcatactcatttcttgatatctacagatggaaactctacagccttacatatatttcttttttcttttaactactttatactcacagaaaatcagtgttcagcacttctaatagcaggtctagtggaagcttgagatcagaacagagttccataaagggaaactgagggcacacaaggcagagcagtacccccttatccatggggacctgtctgactggaagtaagggagaagattctactccacagagaatcagggaaggttaaaactgtgtgtgtttgtgacacttttgctctcttgggcccagatacaggccggaaatcctttgggttctggtgactcaaagtgtggccaaaaggaccagcagctttagcttctctgggagaacatatgagtgcagaatttcaggcctgcaccaagtttttaaacgtctgcattttaacaagctgctcttaatttgcttacgtattaaaatttccagaagcactgttctaggaccatctttaagtgttatccaaaaacatgtaagatcttttttcaaagcaaattctcaagctctaccctagagggattgcttctggttctctggggttggtgcaggaatctacattttcggcaagtgccttagatccttgtgcacactagcatttgaggattgctgccttagatggtgggaaatctgagcaggggagggctgtgggctgaaaatgaaatgatgatgtttaggaactggcacaagcatgcttctgctcctggtgggaagcagtgggacagatccagttgattgtagagaatgcagacctcgtgtcatgctcaagtgtcaccttaatgtaatggctggagacagccacatatgaccctctcattgtccagtcagtaagctcaatcaatgacaggaaccactgactctggtaattaaaaacttattgtggccgggcacagtggctcacgcctgaaatcccagcactttgggaggcaaaggtgggcagatcacctgaggtcaggagttcaagaccagcctggccaacatggtgaaaccccatctctactaaaaatacaaaattagctgggcgtggtggggttgcctataattccagctactcaggaggctaagacaggagaaacacttgaacccaggaggtggaggttgcagtaagctgagatcgcatcattgcactccagcctgggcaacaagagtgaaactgtctaaaaaacaaacaacaacaacaacaacaaaaacacttattggtgggcaggttctcataagaggccatgggaaagccatgtcctatctcagggacacagggtcatctgggcctctggctaatagaggccaaataatgggactattttccctgtgaaatcctgaaaaccaaaaatggtggcgtctttatctgcattagcagaggtaatttgctccttcttgaaatccaaggtcacgtctactgtctggggattttgatccagggtcagtgtggtttctcctttacaggagagccgagtctcagaaaggtgaggtggtttgtgttggtcattggctacctcagattttagagcagctctaccttgattgtggggttgacctaattttttttgctgtcttctttcttctccaggtgaggaaagaggacttcctgtatatctctatccttttgtttccattactcactttctgtggctgctgctgcagaagccactgctgactgatgtggatacctcaatctttggtttacaaaaagcctaggtgtcttttggcctctctccaggttgatagccatggctcctgaaagaaataaaagatgatcatctttctaaaaa

SEQ ID NO: 1182 - DNA, 869 bp, Homo sapiens
gatgggctcaaaccactgacttttcagtcaacatctgacagcactaacccagtgttccagagacactgcttgttaaacagtgaaagctgttgctcaattgtgtcatccgtaattgtcaaatattgccatttagtagcacaaggaagtattctctgttgccaagctagagtacccataactcttctgttttgttgaacattcttccccaccacaaaccctctttagaagactgggggctcctaaagcattgaggccgagagtcccgtccttgtgcatgtttgggcattgacccagggccaagtcagtgggagactcctccacgcctacgccaggtccccaggtgacaactgcagtctctggatctgaagtcatccactttcccattcctagctcacctcacccatcgtgaagcctggatttcctttttatcactggttttgatggatttgattaaggcgttccttggtgaagttttcttcatgtttcttgttcttagaataatcatatttctgtaatatttgaagtttatggtttccatggagcttctaaatctttcatccagtatgttttaaatatctttgtctctcttctccactacacgcccttcagggattccatttagccctatactggggggtttaaagttttgatgccgatggtctttttatgttttcaagtcatttgttactgtgtgtttcatttatgttagtttcaacttctattccttctagttcaataatcttctcttctgcaatgtttaatccactgccttcttccatttcagactgtaaatcatactttttatctacagaatttgatatttaaaaaatcttcaacctccccatttaattaaaatacaattatactaa

SEQ ID NO: 1183 - DNA, 598 bp, Homo sapiens
aggattgggatattccgactccttaagggcctggcgcacataaggtgtgaccttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttt

SEQ ID NO: 1184 - DNA, 974 bp, Homo sapiens
ggccgctgcccggcacctggaggaggctgggctgtgcgcggcgtttgggggtcggcgtcgcccgcacgctctgcgaggcttgggctcgcgtaccttccagtagagcaccccgagccgccgcagctgctccaggcccactgggcggccggggtcggggcggtggggttgccgcgggtcgcccggggcgtcgtccatataccaggcctgcaccatgacgcgcagtgcgggtgccgtgttcgaacccaggggccgcgctcggagcccgtcggccgcgctttatcttatagggaggcgtggacgcgcatgggagccgggattgggcggctggttggaggcagggccggcgcgggggaggccccacggctccgctgttttcggaagcaaaggcattcaagccccgaccctgtcctgggcaccctcggacctgcctgaggcccgcggcccggggccagccgttcgccagacgcgccgggcaggtgaagctcaccgtaggcatcgcacgtgccttgtgtgtgctgccgcggtctccctgcaccttcagagcaatcttgtgaggcaaacgacgttaaacgtgtttagagtatggaaagcaaatgcaaaaaaaaaaaaaaaagaataaggattttgttaagctcatgcagtccatatgggcacagttgagacttcacagctcggatcccaggtatgggggaaacagttttatgccataaaaaacatactttagaaaagcaagatgatggagaggctctgaggaattgccaaggcagcccagcacttgctgctggcaggagttcaagcgggcagaatcagatgagaacagcactcattacttcatacggacattgccggcccatgggattcctcctttgaagaggaatctttggaacttgaactgtctcttccagaagaatagccagcagcagcccaaaaatatgtttcatgaccagaatttatcaccccgatgtaagacactt

SEQ ID NO: 1185 - DNA, 478 bp, Homo sapiens
atacagtgagtgctgccaacatctggcatactagaattgatctactgggcactgcagcctagtggctaaaagtcctgccacttactaaccatgggaccttggacatgttcttcaactgctgtgtgttatgaggattaaatgatttaatccataaaaaatgcttgaagaatgccaacatgcacaatgttgctccaacagccaagttatgatcttggaagagtttgctgtccagtgacttcctgatggcattcaaggttggcatagaacgctacctggcccatgggttactcgccatctaaaaccaaaaatcaggacatatttatatcttattgctatgtccaaaggttgatttttcttcacttggtgagcatcttctgtttggcatttccacatgtaataagttaagaactgatttgagaagatatccaaaaaatgcaattgtataaatccaaataaaaaatttaaataatcatcccaa

SEQ ID NO: 1186 - DNA, 541 bp, Homo sapiens
ctgagtaaggagcatagagacaaatataaaatgaacgcactctacctgatttaattatagtcttctggtgaagatcttgctgttatctctgtgaatcaggagagaagagattgatgaatagacgagattggatttggtcatttccccaaggtgaagagcatggcgatttcttctgtggtaaggagcaataatgaagaccatggttgatttaatcagtctctgctgatgaagatcttggctgttacctttgtgtgtaaggaagctaaagacttaagtaaataacagtccaaaaacttgtcaattagggtaaatttttcattaatgttcactgaattatttaaagttaaggcatatgtagatcaatgagatgaatgtgttatgaaacttagattgtggttagtccaattaagcacaattttggttaaaaataagatgaaagacattttattcatttttttatctgattaataattcatcttattttgtactgcatttaatttaagatttattcactaataaaatctatggctgcactgttcaa

SEQ ID NO: 1187 - DNA, 680 bp, Homo sapiens
tttgctctcctgatgaagacaaaggctgttgatccactgaacccacccagacactatgtggtttcttgaatgtcctacgtacattttgatggattacccaaggactatctgatgaagaataatagagacatataaatacatatgggctacatcttggcaaaataaagtaatcctgaagtaaattctaaggatgttctgaattgacacctcttaagcacaaccgaatgtcctggtggctttgcctcccactggggctttttggctcttgtttggccccagcggctgctgcagctctgtctgaattcacacaggagcaacatgatggtgctcagccctcgccgaagtgtcttgctgaagagttgggagatgcttggactattcagatagaagccagctggaagtacagggcagtcaacacaaaccagagaggcaaacttttggccagtgagacatggaaagggagaagaaatacattcttctttctcccctagagtgaggaccaacctgagtcccagtcacctggaatcccctcagacgagcgtcccttgagatccagcacatggcagccagcgtgctgacgattccttcctgcctactggctccttcttatttctgcctccgtggaactgtattctctaatcaatattagcacatacatattgccccagactgtacctcct

SEQ ID NO: 1188 - DNA, 3549 bp, Homo sapiens
agcccacgttcactattgaacacaacggaagggggaattattgtgcttcttgctttgattcccaagctggtgttgtctgagcctgtctggcatgtgctctgcctgccctgacttctgaccccaggaggagcattcaaggagccaaggaatgggtccaggcattgtgctagtatctagccatggcaagatgctagatctaaccatgacgagagcagctaagatcggactgtacctgagtgagcccattgaatcctccaccagcaccacacggggtttctattgtttgtctcagctgcagcaacataatatgagacaagggccaagaactgcagaactgtgcacggtgtttagaagaggctgcgagctgctgctctgcagagttgggaggtgctttcgggctctgcaggctccctgcaggcccttgctgactgtccatggcctgcacctgccctacctgctgagctgccccatcagctgctcctggctgtggtttcctgaggggtcccgtctgcatcggctgccctgtgtcctgacactatggtgggtttgcaagtggcaaagtccagggaaggagactggggagcatggccatgggtcatccggggggcacggagggttccggctcccgcccaggtccacctgcttcatcagcagtggtcaccaagattgcataaccaggacgatgacaacgctgagagctctgttgcagttaaagacttaagaacaacttgtgcctgctgactaatacattttatcacccaggcagcgtcaggactctgagagcctctcacatgctgctgtcatctgagcgagacctcaagatttgtcatcgagcaggctgacccttgcctgaatggacctcacattcttgaggcagggagagatctgcaatcagcatgatcgatcagcgattttcataagacgttagaagtcatcagagcttaggaaacagggtgaggaagtaggggaggagccggaagggcccccatttaaaacaaggtggccaggataggcctctctgtaggggtgacattgaagaaatggtgggagagggtgtgaggtgcacatctctgagggcagagtgttctggagacaggaaaccatctgtgcaaaggccctgtggtgagagggtgctaggagctagcaagcccagtctactcaacacagccatcattttaaaacctcggtgagccctgtcccttatcttctgaaccccctcccacagaagcggatgtcactgagagtgaaagctgcagtgtagggtggcctcctctgcacaccggccctggccctctgacctcttctaccccatgatggtcccctgtcagctgggtctagagtggaccgtcggggcagacctggaaggggaaggctgtcaagttcctgctcccctgtgacatacagcaacacatttgtttccccctggattctggggatcagcaacatgtgcgggtgggggcagggcagtcctgctgctctgggatgggctgccccctcagggaggactggccagctgggtggctctgctcctggagagtgaccggccatttgctgggtggatggggtgactgtcctgagagcttggcaccaccagaagtgtagtccacgcagcccttcacaggtggctcagggtgcccagcggggcaagaggtggccctcaagctaagcttgagcttaagcctaagcctaagcttgccacgcttgggctaggatgccaagtctccatgctggctgctggtcacagctctgtccctgtgggagaagacgactgaagcctggccaggctgggccatctccccagcagccaccagggcttgctgtgagatgtgggagccatgctagggtcctgccccggggatgttggtaggcatggtgggaagcagtgcaattatggatattttctggagataatcatcaacaggatttgctgatggaatggacctggaatacaagaagaaaaggaatcaaggatggctctgaggttcggggcttgagcaacttggatgggggtgctgctgagtcaggtgggaggggagcaggctcaggggatgcggactccatttgaagtggccgcgttggagatgtctgtggacatccacgtgaaatgctgagtggccagctggacatgtggatctggtgtccagggggaagtttgggctgcagatacagatttcaccaggacatatttttagtgatgcatagactgaccaggctcgaaagaagcacagggtgtgcagccccattctggtaagcgtgtctctgcctttactgaggtgtctccactgcatccttgatttaatggaattcaactgaaccatcattgagcatctgttgtatacgatgtactctggaggcataaaaactattgggagaaatgaggaagtaaataagtaatattgatataattcttctattaataagaatcaatttatctgaaaacaaaaagtctcttaagcatttgaataaaatagaaagcctttattaacatatgaaaataaatccatacccataaataaaaatctgcacactcacgggtgctgaccagtatatcctagctcaccagcacagtgggctgggtgtggagaaggtgggcattcagctttcacatcaggcagagggagccttggagcggagggtgctggctcaggactgctggccaagcccatggtggagtcaggccggcctgcagttggacactcttgactgattaaacattaataggcaattctaacaaaaacagagaggatggcaactccataggaaggagggccacatgtgggggtgaattccaagtcaaacattttccccaaagaatttgttgttaaacttttaattttgagataactgaagattcacatgtagtggtcagatataatatagcatgatcttctgtgccttttacccagttttctccgtcataacatctgcaaacgtagcactatattacagtatctcaaccagtgtataaatgcatacactcaccagtgtcactggggttcctccagtctcagttcatttgtgtgcatttattttccgtaactgtatcactgctgtagagtaggatggccaccttgacagtcaagaggcagaacagctccacacgagggttcctgtcttccttgctcctggaaccattaatctgctctccgtctctataattttatcctttgagactgttacataaacaaaaccacacagtaacctcacaaggcatttttgcactcagtaaaatgcccttgagacccattcacgttgctgtgtgtatcagagcccgttcctttccatagctgagccgtgttcctggtgtggacacaccactgtttaatcagtcatcgtcgaaggacggctgccttgtcccccattttcgaccattacaaatgaagcttccatgagcattcatgtacaagtttctttgtgaacttaagctttcaagaaattaaaaaagaaatgttttcaaatgcttgagcaaatagccaagatcccagggcaccgtgggaaagtgtggaagtgaggattttttttttttttttgagatggagccttgctctg

SEQ ID NO: 1189 - DNA, 1700 bp, Homo sapiens
ttctccctcctgcctcggccctggcaccagtgatctttttattgtttccatagttttgcttttttcagaatatcatatatttggaaagctacagtatagagtcttttcagattggcttccttcacttaataatatgcatttaggatttcacatgtctccttgcggcttgttagctcaatttttttagtgctgaataatagtccagttctggaggtgccacactttgtttatcctttcacctcaaaggacatacaggttccttccaagttttagcaattatgatgaaagctgctataaacacttttgtgtggacataagttttcaacgcatttgggtaaatgccaaggaacaggattatttaattatacggtaagagtatggttggtattataagaaacttccaagctatcttccaacgtggccataccactttgcattcctacaggcaatgaataagagttcctgttgcttcccatccttaccagcatttggtggtgttagaatatgtttctagttgttttagtaacaatgtttcttccttcagcaacagctactctcactgctgaagagaaattattttgaggccacaaacctctgaatggcttgataagaaaggaaagtcaaggagaaatgagagtgagacttcctaaaaaatacagtgagtccactttctgtgtcaactgtttatgtgaaaagatatgtgaatatactatcagccattccataagcaggctgtggcatctctgagcaaattagtcatgttagaatgatatctgaaatgctataagggaacattagtaagttgttcttttttcctacttaagtgacttataaattagttgcttacattcactgtaactagtaatttatctgtactaatctgcctaatttaccttattcttctgtataagatgaaaatcttttccaaaaagcatgagtgcatgttcaaagcttcggcattcttcttccgtccatgcagtcattccttctaagaaaaattttaaaataaaatttatgggcccccaaattttcttatgtgaatcactgattttcagtatgttttccctgtaaaaggtcacaaactctctctctctctcacacacacacactctctctctcacacacacacacactctctctctctctctctctctgtatgcaggagatttcagttagaattaccaaaagcatgcatactacagttcaagtctagaatacaaaaatataaacactgctttttttccactacattatgggatgagaatttaagttttctataacatgcctgtttttctgattaaaaaaaatttttttaaacaatgagcgtatttttcaattagaaaaaaaaactctacctcctttattgggggaaagaagctctgttttggtcttacttcaaaaccacaagttctagccaggtgcggtggctcatgcctgtaatcccagcactttgggaggccagcgcaggaggatcacttgagcccaggagtttgaaatcagcatgggcaacatggaaaaaccctgtctttacaaaaaaacaaactagccaggcgtggtggcgggcacctatagttccggctacttgggaagctgaggtgggaggatcacctgagcccacgagatcaaggctatactaagctgtgatcatgccactgccctccagcctgggagacagagtgagaccctgtctcaaaaaagac

SEQ ID NO: 1190 - DNA, 481 bp, Homo sapiens
tctaacctgagaacctattaccaccacccagtgtcctcagaagtcatgatagtcaccatgatgcagctagagttataaggaccagagtttgactcccagcctttgaaaacgatgttccttgggggtaggagcatgctctcacccttgtcttctatctctctcatcctttaagactcagttcagaacttgactcttcaggcggaggcttctctgagtcctgaagctggctgcctcactcacagctttctctgcaacgggtgcctccacaattgtgatagagaatgacatgccccagcataatgcctcaacccaagtgtcaacctacccttgacagagaagagaaccccaaatgaatctcccaagcaacacaagctgacccaacacagcaaagcgagtcacctttgaagagaaagaatgacgcttattttctcctccaaagacctacttggaaagtagacgtggtttactgcaaatctctccc

SEQ ID NO: 1191 - DNA, 477 bp, Homo sapiens
catttctttgttaatgaacttttcatgcactttttttacttatctagtagtctgcttattgagtagtttgccttttcatcatgtgtctgtgacacagagcaagtatcttttctatgccttggcaaattgtcatattgctttctaattttctttctaatcatgatcatgatgtgcatctgttatttacgtagtaatttgtgaactgaaaggctaccaataaagtttatactttatgcaatttcaattaatatacagtggtaactgttatttgaaccatgatgtagggaactagtgttatttaactaaattatggtaactgaaattggtgcataacaaagctgtaaaacaaggactgcctatatccttttcagtgcactaaatgctacatgattgtttcttacctcaccctatgtacttgtcatgtctttttaaaaatgtactcaaagaacagaaataataaaccaaatagagaagcaa

SEQ ID NO: 1192 - DNA, 2043 bp, Homo sapiens
agatgctcccaggctctcccgcagtttaaagacttaactcagcggctttcagggcctgtggttgagggactccgaaagaactgttgctggtggaccggttcagggtcttgacttcgccacacaaaagaacttgagagcacgtccaaagtaaagctaagacctctagtacagtgttcaatggaactggtgagaaaagacgtccttgctgtgttcctgatatgaagaggaaagcagtccttctccattaagtaaaatgctgacaacatgagcctcccgtggtcggaacgggcttgtgaaggcggtgctggggtgcaccagggcagcagctacagaatgcaccagctggagtcgacattaaagggccccatttcccatttgctgcagaagatgtttaattggaagtctctccctgtccttttaccctctggtgctgggcaccaatgagaagctcatctggccccgggatcctggcaggacactgggagcactatttccatgggcagcagggttgttcctggagacatcactgacccaggacacctagcacaatggcactcgatgtgaaagtggcttcgtacaaatctgccactcaagcctaaataagtgcattccagaagagccgcagcccctctaacagctcctgaggtgagggaaaccctagggatgggaagttggagcagaaagagatggtggcctgaagtcaactgcagtgaaaatctctccccatcagcaagttttgcaaagctatggccacagggacacatgactggggcccctcctagtcttggaaggagcccccatggaaatgagggcctcacagtgaatccacctctgatcctacttcacctgcagtcaaatgagaagagatttcaatcagctaaagacaccctatcccctctccccgacccctgcgaccccaggagctcctgccttgtcactgtgtccccaaacgaaccgcatctgaatcaagcccctttctctccctagtggtcaacatctgggctgtgatgggcagctcccactcttgccttagaatatgactggagaggtgacttctcatcacatggagaatatgttcaccccatggtgctttccacccaagctgaccatggcttgactttttggtgtagttgctagctctgtgccatccttggcaatgtgaccctggagcagctgtccccagtgtgcatttgggggatttcatgtaattatgaataggatgcaaattttatagccccagtgaagggaaacacccctggcgaggcttcccggggccagagagaggactccactgagggagatggtggcagggccattctttgtgtcctgcttttttttttttttttttttttaacatcctctttatgtcctgagagccatgtgcagatgaggaaaaatgacatgcaatgcatttttgcctgccacaatgactttgcaatcataacaagcaaaatgttctaaacagtaagtgaatcgaggaagatatactgccaagtcaggaagaaaaaatccacctgttcagtgatttcaggaactgctgaagaaaatcaccagtgagtatcagtttctgcaagagaatctaatgcaggctttgcttctcatcggaatcccccagctggtgtcttggttgactgagagtctgggggagagggcagagaatggatttattctctgctaggtttttaacagtcaagaagggctgtggtcctaaggggcactggtcaaaccttagtgtgcatcagaattatctggataaggctaggcacagtggctcacgcctgtaatcacagcactttgggaggctgaggcgcgtggatcacctgaggtcagaagttcaagaccagcctggctcttttagtagagaaaccctatgtctattaaaaagtacaaaatttagccaggtgtggtggtgagtgcctgtaatcccagctacttgggaggctgaggcaggacagtcacttgaatctaggaggcagaggttgcagtgaactgagatcgtgccattgtgctccagcctgggcaacaagagtgaaactctatctc

SEQ ID NO: 1193 - DNA, 579 bp, Homo sapiens
aaggttgcaaaatggcgaggggggaggtaagctgtctttgcttggccatcttgggctagcaggccttgcagagaactacctttttagctgagtgaagggatcaacctgagttggagttctcctatgctgtggccagatccactagaaattaacccagaatcttagcctctcagtggcctatcggtgatgccacactcaatcagaaactatgctactgctgaagaggtatattgagccctgcctggttaacctccagtgaggttattagagaattgggagaggctcaaatcagcatcctgcacctagttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagt

SEQ ID NO: 1194 - DNA, 549 bp, Homo sapiens
aagagattgagtttaacgtctactgatcacaggtcacacagaagagattgctctttaaaaataaatccctgagagtttatatgaacatatgtctttttcctattatataaccatttaagtacaggaaacaatcgacttagtgctacacctttattaattctgaatattatttgtctctatgtcttctcccacttggtttcctcaaggagaaagagtactaactgagaagagttaaaaatctacattttgttttgcacagtctgaggaatctttattatgaaatctatactctgttgcccgggctaagtgcagtggcataatctcagctcactacaacctccgcctcctgggctcaagcaatcctcctgcctcccaggtaggctgggactacaggtgtgtgcaaccacacccagctaatttttgtatttttaatagagacagggtttcaccacgttgaccaggctggtctcaaactcctgacctcaaatgatccatctgcctcagcctgccaaagtgctggattacaggcatgagccactgtgcccagcc

SEQ ID NO: 1195 - DNA, 444 bp, Homo sapiens
ctttcagccctcacctcccaggaatggggagggggcatcctaccccatatctgaggtgcgactgcgggacgtagagcggactgggcctttcccgttggcgcgtggcctcaatcagggagtcttcctctgtcacccaggctggaatgctgtggcaccttcaagactcactacagcctcaactttctggcctccagcaatcctccaaacacatcctccaaagtagctgttattacaaagatggggttccgccatattgctcacgctggcctagaactgccgagctcaaagaatccacctaccgtgacgtcccaaagttgtggaattgcagtgcttcactggccccggccttatttccaaaatgaaataactcacataagttctgtggtgacatgtaaaaacccaattcccgtaacagctttcccaacgttgattttttagacatga

SEQ ID NO: 1196 - DNA, 3334 bp, Homo sapiens
aacaggagagggagcaagcgcgagaggatattagaagagaggcttgtctccaagatatggaaggaagtgagaaatgacagggctgcaagctttgtatgtaggagcccggcagggcgggggagcggcgaggagagccaagtggattctcagaaaaggggggaagccatcgaagagctaaaggtgattagagggggatattgatttcttattctgccagagatttaagcaggcatgcgaggaatctgcaccatggttggcaaaaagagacccgttgcctcctgtaaccagacactcaggctttccaggagcccagggagcaagccgagaagaaagggggcagtgtggtctaggaaaattcaacttgtcgctgatttgtgcctgatgcctgctgtccgtcagcagcctcccttacaatctttttttctctctctcctttttttttccttgccttctccttcttcactgaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagagctggtcctatagtacccctcctcaggaatgtctccccagtgcaaggacaaagactgaagagactgctatattgatggactctcaagccaactatgaagttgaaacaaagaaagtgatcacctgaagacacctcctctgctaagaaacacccccaaattgtgcagcttctgccactagaactctcagaacaagagacaatcttttcaagaaacagaaaaactcaataatgacatctagattttcatgagccaagaactttcccttcctcatgtgtattcctctgtttgtacttaaattcatgtgacattcatttttttcctagtatggatatgcttattaatgcacttgtttcaaaatcccaaattgcacaaatgtgttaatattttaagaaacaaaatgaatcctacaaggagaatgatttttagccacacatagggttggatcttgagagtgacctacagaataaaagtacttttaaaataaagtagtcagaggctattcaaagggtaaaataatcatagtaccacattggtccacttgacactaaccaatcgatcatttttttttaatcaagaaagctagattctatcagataaaatcactgcttctaaagagtttaaatctagttagaaaaagttatagaaatgtttgcaaagataagtaacagatagagtcagtagaggataagatcaaaaacaaaaccaagcaaaagatgagttcaggggagtttgccatcaagttggcaaaactgacttacttagggaagaaagttataaaacaggaaaatatgagatgaaccttgagtgatgtggaagatttagataaatggaaaggaaggagaaaatggagttctttaggtggttgtaattggaggaggaaatgaatacacacatcttgttgacttaaacccagacattcagcagctctctatacatatctggaaaagactgcacagtcacctcctgtctctcaccccaggtattacttagaattattatcatatttcccttcctttaaagtaagtaagggtgattggtgacaatatggagaactatgatttttccattaacctaataataattggtatttattgagttctgttaagcattttacatattaactcacttaagcctttcaacagccttgcaaaataggtattattatccccattttacaggcaagaaaactgaggtttaagtaacttgccgaagtgccatatacagggctcacattcagtattgcagttgcaaagctcatgatctatagtgccaagttgcaatattgtagtcaatgtcacaattattacccctttttatattccttgatatttttccatggcaaacaattagctatttcatttaataatcacctaaaacttttcagtcttctgattaaaattacgctggagtgatagaatgtattttcatgatagaaattgggaaaaaaaatggggaatgaagtttatcagcatttcagacttgttttttttttttttttttgcaagactttgatgagattgttcacttttgtctatgtaaaatcccaaatccttgagaataaaaaagggggaggtttaagtcacttgttgcaatgccctttttaatagaggcaataaatctaaaggccataaatttagagtgacttacagaagatcgaactttggagtgtggcagagtaagggatggaaaccgggccctccagttcactatcagtagcttttgcactggtctgcccttcctaaattaagtatgcacttcaatttgatgagtggaaacagtctatctgggcagtaaccagggagctttgtgcctagtagattgcttctgttctgcacttctttggtttcccacctcaatgtaaaaaatagctagcaatgaagtccagaagttgtcaatggttcatccccagaagaatgcataatgtccaaagttgtatgtgtatgatgtcttcaatggtattaagttatttcaaattcttagttcacctacataaatcatttctaacaagcatcttcttaaccaactttatgcacagtgtatgtttgtaagtgcttctgcacgaatgtttatacatgactgtttccatagtacttatgtttttaaaaatattcagtcatttcctactataatcctcatgtatccatgtaactgactcaaaaatacttcagccacagaaagctaaaactgagcaaatctcattcttcttttccatcccctttgcatgtggctggcatttagtaatgattaataatatggccagctgaataacagaggtttgagacacaattctttctcaaaggagtcagctaagctgggtctacttatggacaaacatctaaatgtgtggaagtatctgatatttgacaatggtaaatttccacttagctagctagcattgtcagacttcaatctcctcatggctctggccgtcctgttttaagcatgataattgttggccacatctcacatagttctcattgagtgagttcataaataaacagggtttttttttttttttaaagagcagccaagcacaaagtgtgactttgttgacattttatgtgactttgtcatatgttcctaacccccaataaaagcaatgttgcatcaactgt

SEQ ID NO: 1197 - DNA, 622 bp, Homo sapiens
caggccatcagactccaaacagttatgcaactggagcctcctgaggatgaccccttctgcctgggacccttagatcagcctctagagaagctttgactgctgtttccccaaaacagcaccccctgccatcaggaagcaagctgatcaaggagagaagataaggcatggatattcagtttaaaatggtagagaaccataataatacctaccttgaagtgatgatataaactacatgacacagagtacttgcttcacacagtgttggaacacacagagctgccacctggaaatccctgctcatctaagggttgcatctagactctgaaagccatgttggttcaccacatgtatcgcatcctgataatgtgaagtgaaaaagtagagcctggaagcctttgtaagatgactgtgccagaggaggaagataaatatctcgatgctatggaggcctgtcagctctttgaagtatctgggcaatatcaagatttctacttcagatgaaaaaacaaatagttattcattgaccctgttgccgccaagaaagagaaactcaggaattctgctcttgggaagatggattagatgtattattctttactcttcccactaactacaactaaaa

SEQ ID NO: 1198 - DNA, 613 bp, Homo sapiens
agaagaattcctggactaacaattctaagccaaggcagctgcggcaacgttgaggcagaatcaaaacctggggaaagaccttaggtattcagaacaaaacaatcagcaggcgggtctgcggcattctaagaacagacactggcaggaacaaaggttacagaagtgaatgactctaagaatcaagcaagacatggagtggcagaaaattaaattctgaatccctaaaagacatgatgcaaagatgacctcctctcccaaggacatgtcctcatcctgcgctgaccgtgtgtggtcatttcagaaaaagcgaacaatggagaacctgcttgaatgatacttagacctgggacaactgaaaggagttgcacttatacaattcggtgcagtggagtcccctgggaggagccccagtcacacgggaagagacagtcacagctgtaataaatgatggctagcatgtatcaagcactggccgagtcctcagcatacattacattacagaattcagtgtgcacctcaacactctgggggtgtattttataggagaactgtggcacaaagaggggttttgcaatcccaagaagagtcagcgtttgaattttgaatttatgtg

SEQ ID NO: 1199 - DNA, 746 bp, Homo sapiens
ggaatatgagaaatgtcacctcctggctaccacaataatgcaactaggagttctggttctccgctgactacccacaggagtccttagaggaaccacacaggaaacctgggaaacctaacactctgattccaaggctccaagcttgatatagaagactatcatatgaaccagaaagggtaactgaaaccaaagaaatgactccagtatcaagctaaagacatgccttaaaggatgaggaggagcagaaatcttaccagcaaggcaagaaagaagccgtacgtgaacagcctctgctttaggcccagaaggaaaagaagcttacaggagacaatcagtcttacactcttccatggtcacaaacaagaggtccctggatctacaggtcatcttgcccctgaaatggccctggaaagctatggctgaagaatggaggaaaagatgactttctctgtttcttcagaccaggcatcaactgggatgttgggatgttgataaaaggacatctcatcctttgttttctgcctatgctttcaccatacccattcccatgtctggtcatcacagcatccttcacagcccttagctgaatcatgttgagtacaggatggtgtgaatatcatggtttgaatgcaaccatggtctgtcagtgtggcttgttttttgcagcccacttagacttaagccctcttaatttcaaaattacgttcatatgtgccaataaagttgtccctacatgaactgaaaaa

SEQ ID NO: 1200 - DNA, 500 bp, Homo sapiens
aagagatcagaattcagcttccccagggacagcaaggccaagaaggtgtccagatcctggcctctctccagatcttggactctctcaaggccaagactctctctcttaagatctctatctcaaggccaagatctctctccagatattggcctctctcaaggtacttccaagatctcagagggccattcactgtggatctaatatgaagacagagaaaccagccttccagaggagcggacacatttccttagtcccaggatacactttgtgtggaatccacagatctgccctgatgatcatgaaggaatgcgaaagagcctggtaaaacgatatggacttgtgcaaatgcaaagcaatggtgaagtcatcacgaaccgcacagactggacagaactcctatctggctgcaatggcttgggttcagtcagcccaggggccagagaattggctacaaagagctctggagtgcccctccctccaaataaagtattctaagcgtg

SEQ ID NO: 1201 - DNA, 2517 bp, Homo sapiens
ggaaaggattccttatcagcagacagttacagctcccactaggacactgccttctcagcggcttcagttatcagatattcctggacatactttccaagccatgaaaaataacagccacagctttcccagcactctgacaaacatccatgagcccccaaagaccgggaagtaatgatgatgcagctgcggcaccatagaagaaacaagtgatttcagtcaaagggcctggactcacgagctagcaactttggacagattcttgaactctcagcctcagtttctgcttctgtaaagggagataactacagtgaccttcaggttatcttgaagatgccaatgagctagtgaaaatgcaatttaatctgtacagaactaaacaaatgctcttttaatacaaattaattaaaagcaggcatcttaagaggtggcttaagaagactcctgcatcatcatagggagttaaaattctgagcaaaaagccttctggaggagaagcataggacaggcagccccaagactggactggatagatgttgctgagccaccaactctctgagggacctgagacaaagccaggtgacctcaccagtgctccatgttctcaccataagttctataggacactcaaatattctcaggacatcagtttactatacacatgcacacacacatattttacatttcattcaaagggtaaaacatagactccctttgttctataaacctacaaacatgtctgagcattttttacataaatatttcacaaatattttacatgaatacttcgacttataagtccatattttaacaatggcatcttttccaatgtgtacattatggaagtgtggttggggtgtacagcctaggagctcagggactgcacaggcctgttctttatggatgcattgcattcatctcccacagccatttgtagcttcagctgtttctgaaagcagccactttcccttttgatgtctgaggtccattattttcatttttgacttaaccaacaggtgttctctcttgaactctttcctacatgagctgtcttgcctcagggttcccacggacaggagagtttttcctacagtgttactgagaggcacagagaaatcagttcctcctggtccactggctccgctctcagcactgcagtctcttgtgaccacgctgaagtctcaacgtttcccccttctgaggacatgcagggacagaagggtgaaccacaagggccagacctaatgctccaggaaaacaatgaaagaacaattttccatccttttatttagggcttaagtaagccaggcctgtaacaccaaattgtgagagtgcacaagatgtttttgaaccttggtgcagaatccagaaagaagtgcagcctctggtgacagggtcttgggctagccatgtgaagcctggctttatgtcaggcctctcaaatgtgctgtacaaacctacctgcaggtctactctaggcagaaggggtggaccgatggcaccaacaaacacatctgtacacacaacagtgcagcagacacttgtggatggggtatgagacaagctgtagatgccctcaattaaatctgaggacaaaagaagactgcccagagagtggcactagcatggcaacaaaatatttcaaaatattaatgggttttacatacacgcataaaatcacatttttctgaccttataacacatttcagtcatttaggtattgagtttgtaatgcttgtggatactcgaaaaattgaaagaggcaaagttagacttcttgtccccaagactggaaatatgtcccttcgttgggagttgggtggtgttgaatgcagttggggtggaaggagaggagagctaatgggaaaacaaagaataagtaaatgttctacattcctgagaaaaggggccctgccccctagccatctctgcagcaaagccctgggggagagagagagaatgctcagacatgtttgtaggtttacagaacaaagggaatctatgttttaccctttgaatgaaatacaggaaagcaaaatacctagagcagaaatggctgtgtgacatgtcagacaaggtcatagagttttccatggccctgcactgcccgtggctcatgtggcatgactgtaggtgaaacccagaatggactctcaaggtgccctgggctcccttcctcaatggctgaagaaggcttctcttgacctaatggagtttaaagagacttggggatatagtgaactagaccccagaagcctttcaaacaggaactagggggcgcccaccaggaccttgtggactgacagtggaggctcaatgagacaaaatgtgtcatggagatgccttcaggacagacagcattcgggaacagataccagctccttacagtcttggcctccagattagacatggccctggaaaaaggtgatgggggacctggaattaccagacagcaattccgttcccccacttagtggaatgggagcacaacatgtaaattaaaggaattagagaaaaaca

SEQ ID NO: 1202 - DNA, 1097 bp, Homo sapiens
atttctggtgagtcagccaggaggccgtggagaggacaggttggctgtctcctttgcctgtaggtggtctggggccccagcagtgggagacctgtaacttcaggcaccactggaagaacttaagcccagagaaggaaacggctcttccactccccagcgcccctccccagatggtgcatcagaacctggagggttgcaggacaatctcaagagcagcaggcagacatctgaaccgtggtacatctagttcttctatttgtctacctataggtgcactcataacattttaatttatttcatgtgttgtcatcgttatcctctgtattactctgagaaagaagatgttacctgtttgtgaaaaagagggtcacagagtatgtgtgaaccaatacttcatttgagacagcctcacatggagaatgcaatgagccattctcttctcacatacagttgaatatgacatttactgcagtttgatcactaagcataagagccaagaactctggaacaagaagaagaagacgaaggaggaggaggagggggagggggaggaggagaaggagaaggaggagaaggagaaggagaaggagacggagaaggaggaagaggaggaggagggccgggcgcagtggctcacgcctgtaatcccagcattttgggaggccgaggcgggcggatcacgaggtcaagagaccgagaccatcctggctaacatggtgaaaccccgtctctactaaaaatacaaaaaattagccgggcatggtggcgggcgtctgtagtcccagctactcgggaggctgaggcaggagaatggcgggaacccgggaggcggagcttgtagtgagccaagatagcgccactgcactccagcctggaccacagagcgagactccgtctcaagaagaagaagaaggagaagaaggagaaggagaagggaaaaaagaatcctcatcattaatgcaagtggaaggaaactcttcaccaaagaattgatcacatcatgaaaggtgaaatcattacggaattgcttaaatatataatttgaatctggatttaaaaataataaatgtaagttttttctttaaaaaaaaaaaaaa

SEQ ID NO: 1203 - DNA, 4494 bp, Homo sapiens
agtatacatgaatttgcttctgcctttgccacccctgagacagcaagaccaacaaccccttctcttcctcttcagcctactcagtgtgaagatgataaaatgaaacagttggtgatgtttcagagaacccaactcaaactgacttgaacaagagaaatcagtgtttactgcagagaacacagaagccagcaagcagcagggaagggaggcgaaccaatgcagcagcccaccgggaccgaggaggacacacgcagagcaagtcacaggaagcgcagctgaaaacaaatggacgcttatcccaaatgcacaggacacttaccaagaactgatggtccgtcaaagtaaagctcaacagctttggctggcaggacagtcaaacttttggacgacagaaagtaacagtgggaaatgggacaacatctgccagcaacgcgagaggccaagaccatggctgctacaggaggggtcagcgtcacagtacacgcatggcggcggttgcacatgcatgcctggggaatgtgagtgttcagacatgccaggagtccagcctcaccaggaaacaggcacacggggacagaggcgcaaacactgaaaactctcgctgaatccactcggctgagcggtggtcacgagagcacggccctgcgctccccacaaaactgcacctgggccccagggcgagacaggcgtggaaggtgcaggggtgtgtgtgggggcaggggctcctggctcagagccgtatccaggaaccccccttcaggctggagccctgccctgagccccctgtggagagactgtggagagccccctgtggagagggtgactgtgggagagcagcatcaggcctagtctcggctgtgaagtaccccccacctccacgcaggatcccggggattctgtcaaggtgggggccgcctgctcagcccaggctccctgaacgtgtggctagctgagtttgcggaagaaaccaggagagtgccaacaccaggcttgcaagcaagaggctccctgactgcctgatcctggagcgcaccccatcctccctgtgttccctgggcctcagctgttccccagtgaccttggagacaccctgccccaccctggctccacaggagccctgcccatcaccgcctcagctctgagtctcccctggggacacaaccttcctcctggtgcagaggcgcaggatgctgcccctaaggcccatcttcctctgcagcatgttttgatgtcagctcattcacaggaaagaaacaatcacatctcagtgcccagaatggggaccaataggagaggtcactgggaataaagcccacacgcaccccagggtccatgggctccccagaaatgcaggtggcctccgccagagccaacaagcctaagttgctgatcagcccctccctgcttccctgtgtggaagaggaaacagaggcccagactagtagggctctgccgtggtggccggctgcgtccccagacctctggtcccagggctggctgggagtgcccctccctgtgctcacttcctgctctcctgggaaatggctcagggatggggcgtgtggggacagatgctggcatagctcacaaaatgcttgcacaagggacactccatggcaggtccctgcaggagagcaaagtcacaacattcagagattccctgcactctgaggcccgcagagcctggccgaccaagcgaggctgggaggatgttgcctgctggtcagggcagccctctgatcagggcggccgagtgaggctgggaggatggtgcccgctggtcagggcagctgagcgtggctgggaggatggtgcctgctggtcagggcagccctctggtcagggtggccaagcgaggcagggagggaggtacccaccggtcagggcagccgaacaaagctggaaagatggtgcctgctggtcagggcggctgaatgaggctgggaggatggtgtctgctggtcagggcagctcaggaggtgctgcccaggaggtgctgtccaggcagagcctagggctggtgtgggtgtgccatgctcctgagaagtttctgggttgtggctttaatgttctcctgcagtgagaacgctgacacttggccaaagggtcctcacctctcccctagtacacttctgagatgccaggaaggttctgaacatcagattgattcctgggactcccctccagggtggccttactggagtcaggagcccctgccccactaggatggctctgcagtggcctgaggacagtgagcactgactggtcactggtgcaaagttgcccactgtgatggttttgaccgttgatgggaaccaagtgaaagccctgcagctatttctaggcatttcagagggtgcttccctgcatgtactctgctgcagaccatcctccctgggccaggagcccgctacacagtaggagattctttttcttctcttttgagcacttttattctctttttcttaatctctgctcctcctttgaactgagaaatgtgcaaatcttttttgttagttttgaggttgcttcttatgcatatttcatctggaactttcccctttgggggtgatctgttctatcagcctgcccgctgctagagaggccgaggtggtccggccagccgtgcgctgctgctggtgtctctgtgggcatgacctggtgagatatcattctgcatctgggggtccatcctatcagccctgtgttctagattccccagtgactgacatttagccagtctcctctgtcactctccagtgacatgtacacactgttggcacgaactgcagatgtcacgttctgtggctgagagcctcagtgtgcatctgtagtaggaggatgtcagtgaggactgtcctgtcgctgctgagctggcaccgactgtgcctggtctacactccaggtctgccaaacgacccagcaaggtccttcacaactcttctgatccaggatcacacatcacttgtgctttgatgcctgcttctgaacaattttacctcctgagatgtccatttttgggagtgtgagccctcctctcctggtgacagctggctgaggccgtccagcctcaggacacacagggaacggctgcataaggagatctggggcagggggcccaccaggatgttctgccctgtggggggcaacaccggctgtggtctgccggcggcatccagggacagtctgtctaggtgaggctgaggccgcccccactcgctccctcacccccatgctgacagcagtgagctgaccacagactgggggagccccacagggagactggcctccccagcacatgccccgcagtgccagacgcggtcatcacagaggcaggtacacgacaccacggacgtgccacgtacccgccatcgggaccaaggaccactgagaaaccatgaaggccatgcagcgactgtggtggcaggaccgtcaggaggccataggtgccacggctcccctctggtggttcacctgcccacctgtagctggggtggcccctccagtgcgctccccagagcagaacaccccccaggcaacacgtctgatgaaggccaacagcgtcagtcctctggtgtttggtgacatcaaagctgtgccgaaaggccttccctcactgctaacacttgaagggcttctgtccggtgtggaccctctgatggcgaatgtggtctgtcttatgcttaaagatccacctccattaactgcactcttagggtttcttcctctgaaaaggaatgaacacgggaaccccctcaaaggcatttttaaatgaagcgtggaaggcatcaaagatgtgctcttcttcaggactcaggcttctccatcattctctgttccttggaagcgtgagggctaaggagctgctgacttctctctcttggccccacttcaagaaaggcttgcttcccacacacctctccacgctcccagtgcgggactgacactctgcaccgggaggccaagggccaccatcgtcttgctgggagaaggtgtgacgtttcttggtcataggagggagtgtgatctgacaccagaggacttaatataacattgcagtgttaacatcttcactggcagattcatggactttccccctcctgaatgcatttcaacaccttgaaatgaacgatgcctcatgtctctgcagggtggacatagctctaactctctgaagctgattatatgtcaagttctgtgtgaaatgagagaccatggggattcattattgctggagttgacggtattgcagttttataaccatctaataaattagcatttaatactgagagatttcatcttaaactcagaggattgctttgttttaaagaagatttttgcaaggagaagcaatggaaaccattcagaaaatgtgggagataaaaatcctattcaagaaaacggatcttggatctttgcattcacttgatttgtcagaatattattctgtgctaaaaaatagaagggattaaatgttaaaaatcactgaggcac

SEQ ID NO: 1204 - DNA, 3444 bp, Homo sapiens
agtcttgtcacaaaatattaaacctggacctgatcaagcatctggactggcttatggatatagagaaaatgtaggggatagatgagcacgggaaatgtctccgtggggcaaaattcacgaaattcagattgttggacactctccaggacaaaaggtctagattcttcaaaaacaacaacatcgaaaaaaaaaaactgccagaaagaaaaaatacagagggagaaggacacagaacacatttatgagtcttttcaccctcatttcgttgaagattttattggccgaagaaccctcagtaggcacgaaattcattctcacaagcagagagatgcattatgctccatttattgctcatcctaaattataaacatttccagtgaatgtaaaggaagatatgattgaaaaggactctgtgaagacaggatgtttctgtacagtccttgtatctgctcacctattccaaactttccagagattttaccagaggtttaagatattctcctgagggtttgctgtagagagatttttcttaactaaggagtgcaagtagcaagcaatagcccacccagttggagacaaaaaagaagggtgtcagtgttcccactgttaaaaaacaaaaaaaaatcaccctggacacctctgagaattatacaaggggatgtacacagccctgctttatttgagttcaaaaggaaggtgggttttgaaagaagaacaaggagagtagatctctctggatcttctgatgctcacagcaaagagctcaaggtatctgagtcaactcttgaggcttcttcgaacagagggatgaagagagaatatggcaagcttgccaacagatcccagaagttttaagagaaaagaacagattgctctttgcaaaacaaaccgagctgggtgcatggagccccagtagacagaaagtgaagaaaacatcaacgttctgaagttttagataggtgcaccatcccttatggataccaatctgtgctccccataaacttctgtgcccagggtcaactggccagggacaactggctcaccaggaggcctacatagcctcttcttcaggccctaattacagctctatgcaatagggactctgccatctgacagccaaggaggtggttcggtttctgcacatggttttttccgctgggtcccttgaggtccatggtaacctcttcctcattctctacaggcagatcacactttgtaataagatcagaggcagagaactttgaccagatcacactttataataagatcagaggcaaagaactctgaccagatcacactttataataagatcagaggcagagaactttgacaactatctccttgccctctggccctggggtcagggctactcaaacaacacctgctgtcccaaacccggagaagtgtagattttggcactggtagaggaataacagctattgttgacacttaatcttgtgggcctggaatttcaactatgttttcacaactcggagcctattgctgccacctctgtcagggaagataaatgggcatgaataatagacagatgagtttcccaaaagcccagacaggctgcagggaacacgtaatgagcagacagtgtggttcacgccggggagcccaggtttatccaggcctcatcctcactccctttctctactgataattggacccaacaggaccattccgaatcatttttctctcttcagttattcttcagttctactcaaagggtcagtttagggcataattaaagtcaattactttctgaaaggccatcaggacaactgttagagaaaatgatagcagccccgcacttgctgtaggaattattagcttgtcagcctccaggcttatggagacaaaggatcaaaaagttagagagatccaggtgttcacctatttgttcactaattcttttattgtgagtgtgcatgtgtgtgggtgggtgtgacatttattatgaaccagagggcaggagccagtgacacagtggtgcagagaataatcatattccctgccttcctggggtcatacagcttggtggaggacacagatgtgaattcggtaatcactccaataaatattctcctacagatgaagaaagatgatacgatgtgatggacaacagagacttatatggtggggtctgggctggtctttctgaagctaagactggcaggatgagcaggagtttgccagacaaagaggagtggagttgttttccaaacacatctcagcacaaagtgttgtctttgctgggagctgaaaaaagatagtgtgggcagagaccattaggtgagacgcttgatatgagatacaacctcaacaggtggaagaagatcatgagagatgaagagaggaatatagtacagcagagaggacacagaagctgacgtcagggtgtctcagtttgaaaccagtggccaccctgttcctctcccatgtggtcccatcatgggcctctagggtctgggataagaggttaatgaatatctcataccctaagcaggggtggtccctgcactttagcaaaaagttaaggaactagggaaaagagatggaaataataaagagatgggacaaagactttgaagaccaaagcccctgggctattctcttttttaaatttttttatttaaattttcatttatttttatcaagatagggtctcactatgttgcccaggttggtctcaaacttttggcctaaagcaatcctcccaccttggcctcccaatgtgctgggattacaatgtgagccaccacgtccagcctcctgggatatttctcaatgaaacattggatgccaagattggttttgtgccacatgccaatttcacagaagccagtctatgagccaccagctctactcagcaattacagtttctggaactttggctaaattcctgtagatgcaccactgcttgtggcctgactctttgccacccaagtgcgctcagcctcccctggggagtctgccaggcttgcatggctcccactgcacttgctgtgctgggaccgaaaacagtttttgtgcccctagcttaactccactggattcatagaggctttggcctcctcaatggctgtcctgggacagggaggctggttagcacaattaacacaacctggtcatgcaaggcattgatggtccgtaacatgaactttgaccagtaggagacagagaatggaaaaaagccagcagataaatcatctggccttcctcccctatgacagactgttctgagccacagtgtttcacatgtcttcctggagatgtcccacatgacttgagcaaccagctggagctctggagaaactgtggccatcctggtaacatatgaccttgtatttgctttctctccttcctgctttatttccctatgtcccttactttggttgttgggattgcacctcccaataaagcattagcatgtcc

SEQ ID NO: 1205 - DNA, 2351 bp, Homo sapiens
caggccaatacccttgatgaacatcaatgcaaaaatcctcaacaaaatacgggcaaaccaaatccagcagcacatcaaaaagttaatccatcatgatcaagtatgcttcatccccaggatgcaaggttgcctcaacatacacgtcaattaatctgattcatcccataaacaaaactaaagataaaaaccatgtgattatctcaatatatgcagaaaaggctttcaataaaattcaaggcctctccatattaaaaactctaaaaaatctgggtattgaggaaacatagctcaaagtgatgagctgtttttgtaccagtatcatgctgttttggttactgtagccctgtagtatagtttgaagttgggtaacatgatgcctccagctttgttctttttgctgaggattgcttggctattagggctctttttttttttggttccatatgaattttgaaatagtttgctctagttctgtgaggaatgccattggtaatttaatagggataacttgcatctgtaaattactttgggcagtatagccattttaatgatgttaattcttcctatccatgagcatgaaatgtttttccatttgtttgtgtcttctctgatttctttgagcagtgttttgtaattctcctagagatctcttagagatctttcacctccctggttagctgtattcctaggtattttattttttctgtgtgtagcaattatgaatgggattatgttcttcatttgactctctgctttactgctaggaatttttgcacattgattttgtatgctaagactttgctaaagtttatcagcagaaggagctttggggctaagactatggggttttctagatatagaatcatgtcatctgtaaacagagacagtttgacttcctgtctattcctctcttccctcctctatttggatgcccttccagttttgcacattcagtgtaatgttggctgtgggtttgccatggctagctctcatcattttggcacttccgactagaagtgcgagaggggccagtgttgttgttacctgaaaggtaagtgcagcccacaaaaatgcagtgaagaagaagatatatgcatatgtttaagttaatacaattgagatacatttagcagacagaatcaatagagttgatgagtgactgactggatgtgtggggagtttatatcactcccaggtttttgacttgggcaaccgggcactcaagaaggaaaaagaggatccagggagaggaacttttctgaggactggggtagggctgaacagctgcattcgagactggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgtgaggacactgaagaaggagtgagcagacaataagaagcccacagaagacagagaaggaacaactagagggagaagccaaggcaggcatgtgtgataacatataggaactgagggagaggacatttcaagatggaggggatgccatacaacaggactatgtgatggtttttggctgtgtccataggaagtcacaacaggcaagggaaagaaaccagaacccagtcatggagttaagaagtgagtcagagaggagatgggtagggacagtgaggtaaggcctctttctaaggaagtttggctgaaggatagactagctggacacatgctggctgtgtggggtagagggaggaatgatggagggtaggagagccttgagcctgcgagaagagtctcctagaatagagaagctgaggttaaagttgtggaagacagtggggataactgagtgacagataatcaggagaagaaaaggagatccagaatcatgacagagagatgacctttgccaagagcacagccatctttcactgtcacagagaggtaggacaaaacgattggtgttcaagaattggtttgtagcacaatattttaactatgtcctttaaaaagtttctccacagacactacccaaagcagtccttcactacagtggcagacagacctgaaaattttcatctgaagcagcagagtgaactgcagagtcagagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaa

SEQ ID NO: 1206 - DNA, 127 bp, Homo sapiens
gttggttgaaaatcgcccccggctttggccgtggccgcgggtgagattcggcgcccagagcccccgggggcctcagctcaccgcgcgctgccccatgtgcggcggtgaaacccaggccccgacaggc

SEQ ID NO: 1207 - DNA, 728 bp, Homo sapiens
caagtactcaatatttggctttacatttcagctactggccttcaacaccacggagagaggtgttttcctggtttttcagagctgagaagtgagctgtcttccaactcacctgcataggtggaagtcttcccagatgctgtgcttgaatctctaatttgatatatttacaagacttgcagaggctgtgagctgtgtgaatacattgcacataagaactacagatgttttaaagccttctgtgaaagtgattctgaaggtgtggtccctgggccagcagcatcaacatcacctggaacttgtgagaaatgaagattctcaggctcttctctatacctactgaatcagacattgggtgcaaaggggaacactacagtctgtctttaaggagccctcaagaattaggagcctcccaagctgagacagatctcagctactggctgtatggagttggatgagcttcttacctgacccctgggcttcagtttttcatctgcaagatgaagtttaccagagaatgggacaaacaggagagaagttcctctgcttttatgccagataatcttagatgaatgtatgatgattttacaaggtgcacggaaaggactgtattgaattacatcatgagaaagttattcccttctgatcaactctctttccccagtttctacattgaggcaaagtctcagtttaatgctggaatattataacacttgctaatctttctttaa

SEQ ID NO: 1208 - DNA, 3018 bp, Homo sapiens
tttttcaggttttactgtttgattatgctccaaatcaattttattgcccactaaggtaaccagcggctgagtttctgactcttcactcactttcttcactaatcttctaaaaattctcaaagctttgataacttgtaataccatataccaagatgatttcctgtgctccatagatggatctgtccaacattttgcttcttattgtccggcctcctgtatcccaaactagagagtaacattcaagtttcctggcaatgttatccttctcaaaagaaatccagtcctatagtttgtactggttcctgaaagttttttgagcaaaatctgtagctaaggaggtcttccgggaggtgctgttccctagcacgatgattttcagtgctggtcctggctctcttccttagagtcctacatgatgtcccaggaaccatgcctgccccgctcccccgggtggagggaggaggggaaggagaaggtctccaggggtgagggaggaagaagggagggtagtggggacagtacctcacttgtctgctcgatgtcagcagtggctggagaatctctcgccaggtgccatcttgccaatctcttctccctctgccctctgtgggtcttttgttgagggctgggctgtacatgcatagtatgagattctgtgaggcctagaaaagagcagctgctatggggttgaaagaagaatggagaaggccgggtgcagtggctcatgcctgtaatcccagcattttgggaggccgaggtgggtggatcagttgaagtcaggagtttgagaccagcctggccaacatggtgaaaccccatctctactgaaaatacagaaattagctgggtatggtggcacatgcctgtagtacaagctacttgagaggctgaggcaggagaatggtttgaacctgggaggtagaggttgcagtgagccaacattgcgttattgcactccagcctgggtgacagagcaagactctgtctcaaaaaaaaaaaaaaaaaaaaaaaaagaatggagatactagaggttgcacagtgctgagaaatatgaggttctgacctagccagagtggagagaactttttaacatcataggcatgcgccaccacgccctgctaattttgtatttttagtagagatggggtttcgccatgttgctcaggctggtctcgaactcctgacctcaggtaatccacccaccttggcctcccaaagtgctgggattacaggcgtgagccaccttgcctggcacctcttccacttttatgattagattgggcccatgtggataaaccagggcaatctcctatttttagtaaactgattagcatctttaatttcatctgcaatcttaattcctctttgccatgtatcataagatatatacaggttccaaagattaagatgtagacatctttgggtggccattattctgcctaccacacacaatatgtcctctgactgtaatggaaccaaactggaaatcagtaatagaaatacataccaccacgcctggctaattttatttttgtagagatggggtctcgctgctcaggccagtctggagctcctgggcttatgtgatcctcttgccttggcatcccaaagtggtgggattataggcatgaaccactgcacccggcttaatttacgttttatagtgtgcaattcaatgttttgggtttttttttctttttaaagcatatttacagagttgtgcaaccgtcaccactatctaacttaagaatattttagccaggcatggtaggtagcacgtgcctgtagtccatgctacttgggaggctgaggcaagaggattgctcgagcccaggaggttaaggctgcagtgagctatgatcacacccactgtacgtcagtctgcttgacagagtgagaccttgtttcaaaaaaaaaaaataaaatttctatcaccctaaaaagaaaccccatacttactcttagtcacttgctattcctttttgtccctgggcccggaaataactacgttctgtttctatgaattttcctattctgtacttgcatataaattgaatcatacaatatttagtctttcatgactggcttcttagaatgtttttgaagttcatgcacattgaggtacacatcagtacttcatctcttggtcaaataatattacattgtatgaatgtatcacatttgctttgtccattcatcagttgatagatatttgggagttacactttttgtctatgatgaataatgctgctgtgaacattcctgagcaggttttggtaagaacccctgtgttttcagttcttcggggtatatacctcagagtagaattgctgggtcctaaggtaactaactcattgtttaccattttgaggaaatacaaaactattttccaaagtggctataccattttacaatttcatgaaagagaaatttataatactaaatgatgcttatattagaaaaaaggaaagatctcaaattaataatctaaattaataatctaagttcctgattcaagcaactagaaaaagaaaagcaaatgaaaccaaaggactggacgcaatggcttatgcctgtaatcccagcacttggggaggctgaggcaggaggattgcttgatcccaggagttcaagaccagcccagacaactagtgggaccctatctctactaaaaaaaaagttaaaaaataaaccaaagaaagcagaagaaacagtgcaagaagagaaatcactgaggccgagcgtggtggctcatgcctgtaatcccagcactttgggaggccgaggtgggaggatcacttgaggtcgggagtttgagactagcctggcctacatggtgaaacactgtctctactaaaaatacaaaaattagctgggcgtggtggcacatgcctgtaatcccagctatttgggaggccgaggcaggagaatagctcgaacccgggagccggagattgcagtgagccgagattgagccactgcattccagcctgggccacagagtgagactccatctca

SEQ ID NO: 1209 - DNA, 691 bp, Homo sapiens
gaaaacagcaaaattacattgttagttgtattatttacagtgaaaacttggaagacttgacaaagcatcagttagtttatcaacagacctaggaagctccctgtcccctcctttcagggtcctttccttggaaatgaaataaacttaaatcagattttacataactttaagcaccagcttgacaatttaaagttttatttcagttttataaaatactcctgctttgaaaggcaaagtgaatgtaaaaatgtgaatgtaattaaacaagtcactggcctggaaactttttattgcaatagtctttatgttttactactatattcacttcttggaatgaatttgcttgtaggtttgaaacaaaatatttgccttttgtcttgaaaaattcccttaaaaaattaattatttttggaactgtacaactacattttcattcgatgttaaatatgcaacttggtccttggatatcatgttacaaagtccaacctgttggataacttgttatagaaaacaataaaaaaccttaaactatcataaaatattactgatgttaacagtcatgtatgtataacacatcactgtatctagattttcctgttattggatgtttaaattaccaatgtacaatcaggttttaaaatgtaatacttaaatttccattcactatgtaaaattaaaagctctaaaagac

SEQ ID NO: 1210 - DNA, 547 bp, Homo sapiens
gagagagagatgatgggggatgaagggtatggaattgtatgctatggctgcctgctgtcgaagttctccaggaatcagctggctggaggaattttggaaggggtgaggcatacactttcttctatgttcctgaaaccacaacattgttaggactcatctgttcatgagaccagaccaatagaaaatgagcacttcgtggataaaaaatacagatggaaacttagtgaaatgtgacctccagtgctggagatggacctaatgggaagtgtttgagtcatgagagaatatcctttatgaatggcttggtgccttccctgtggccatgagttactacaagatctgattgttaaaaaaagattctaggacttcctgtccctctgtcttactcctcttttaccatgtgacatgcctgcttccccttcaccttctgtcatgattgtaagcttcctgaggttcccatcagaagcagagtagttgctggtgtcatgcttgtacagcccatggagctgtgaaccaaataaacttcttttctttataaattacctag

SEQ ID NO: 1211 - DNA, 4395 bp, Homo sapiens
gcgggtgttcggctacgtcactggggcgctacggttcctggagctgggcagtcttctcgtcagagtggggactggtaagagcgacctccccgccaggtcctgtgtgttgccggctgaagaagggatgatgattattccccaccttctaagagacaaagaccaacgagccaccacagccaccagtcccagaacccgccaatgctggggaatggaaaatgagggagttcaactctggccctcacaatccagtggaggagacgaaactcatctgcctctgtccctctgggcacacctcatgccaggtgcatctgtggacaggggccatgctcctgggcttccaaagttggagaaagctgccaggctcagacccacctaagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatcccactcagtacccataggccaggcatggggacctcaacacacctgagccccagacatcacctttcattctggacctaccatgaaagacttctgaatccaggaagagaaactgactgggcaacatgttattcagaaacaggaccttgccctgtcactcaggatggagttcagtggtcctatcatggctcattatagcctcaaactcccaggctcaagcaatcctaccatgtcagccttcccagtagctgggactacagctggatctaccatgaaagacttctgaatccaggaagagagactgactgggcaacatgttattcagggtctccctctgttgtccaaggctggagtgtagtagtgctatcacagctgactgcagcctcaaccttccaggctgaagtgattctcccatctcaacctcccacgtggctgagactacaggtgcttgccaccatgcccaactaatatttggaattttcatataagtggattccagaggggtgacagcaaaacgtgggaccatccagttgcaggaaaacaagcttaacacgcccactgattttacattatgctcctaccacccggcagcctctccaggcccagaactttctccagtcagcctctacagaccaagctcatgactcacaatggcctatttaggcccataccctacctcacggcagtctccgcagatgagcctactgcctcacaacagcctccacaggcacagctccatcattacaatggcctctttagacccagctcctgcctcccagccttctctccaggccctgaactttctgaagtcgacctcaccaggcccagctcatgcttctttgcagcctctccaggcccagctcctgcatcttggtggcccctccaggcccagcctctgcctcccgtcggcctctacagtcccaacatctgcctcatagcagattcttgaggcccagcatctgcctcactgtggaccccccaagccaagctcccaacctttcagcagcttctacacacccagctcctgccacccagtggcctctttaggccaagctcatgcttcacaagggcctttccaggcccaactttcgtctcatggcaaccttccctggccagattcctgcgtgtctcccagcagcctagacaggcccaggtcttgcctcacactggcctctctacatccagctcatgcctcacggtgacctctccaggcacagctcctgtcccagaacgtcatctccgggcccaaaacttactcaagtcagcctctctagtcccaactgctgcctcctggtggcctatgaaggcccaaaatctcctcaagttgacctctcccggcccagctcctgcctcctgtcagcatctacaggcccaacctctgcctcatgggggcttctccgggcccagctcttcctattggctgagtctacaggcacaactgctgcctcacaacagccttttttggcccagttcctgtccagttcatggcggccaatgtaggcccaaaacttcctcaggtcatactctccaggcccaccttctgcttcctggtggcatgaacaggcccagctttgacttgagaacagcctctgcaggccctgctcttgcctcccaggggcttttccaagcccagctcttgcctcatggcagctgccccaggccaaatttcttcctgcctgccagcagcctcaacaggcacagctcctccctcacagtggcccatttaggccccactcatgactgtcgggccatttccaggcctagtgcctgcctcctggctgactctttcttgaagcccaaaacttcctcaaatcagccttttgcctaacttctgtctactgtcggactctacaggccagcctctgcctcacagtggaccctccagacccagatggtgtctcactgtggcatcctcaggcgaagctcctgcctttcggcagcctctacaggcccagctcctgccttgcagtggcctctttaggccaagctcatgccgcatggcgacttttccaggcacagcttttgccttttgcagcctgtccaggcccagaatgtccttaactcggcatctccaggacgagcttatcctcccagtgcgtctacaggcccgtctcctgcctcacaacaacctcttttggcccaactcctgctgagctgctggcagcctctgtaggccacagacttcttaaagtaaagctttccagccaccttcggcctcccagcagcctcagcaatcaaactattccctcactgcggccaccgaaagccaagtttctccctgcctcatggcatcctccgaaaactgagcatttgcctcacggtggcctccccaggccacgaatctgcctgcctcccaggcaggtgctgcctcacaatggtctctttaggcccagctcatgctaaaagatggactctccaggtacagctcttgcctcctggcagcctctgcaggcccaaattctccaaaagttggcctctcctaactcagctcctgcctcatgtcggcctacacaggcccagactcttaccacacagtagaccctccaggcccaccacttgcctgatcatagcctcctaaggccaagctcctgcctttcagcagcctctacaggcccagctcctgcctcgcaattgcctttgtaggccaagatcatgccgcgaagtggcctttcctagcctaacttttgctttttgacgcatactccagtcccaaaacttcctccagtcagccggtccaggccaagctcttcctcccaaaggcttctgcaggccaaaatcatcctgaagtcaccctctgcaggcccagctcctgcctccaagtgctgtgtaggccaagctaatgcctcacagcacactttccaggctgagcgtttccttttgtgcatcctctccaagccctgaacttactccacttggcctctccagaccaagctctccctcccagtggcctctacaggccaaaattgtcctcaggtctgcctctccagggccacctcttagctaccagtggcttctgctggccaaaatcgacctcaagtcagcctcttcacacccagctcttgcctctgagtggcctctccaggagcaaaactttctcaagtcggcctctccaggcccagcctcctgcttcccgagggcatgtacaggcccagcctctgcctcacagcagactctccacacccagctcttccctgtctgcggcctctccagtccaaagctgctgctgccttttggcagcttgtacaggctcagctcctccctcacggtggcctctttcagcccaactcatgcctcttgcaacctgcccaagtgtcagctcctgtctcacactggcctgttgagggccagctcatgcctctcgtggcctcaacaggcccatcccctgcctgtcggcggcctctacaggcccggcctctacctcacagtgggctctccaggcccacctcttcctcaccgtggcctcctggggcaatgctcctccctctcgggagcctctgcgggcccagctcctgcctcccagtggcctctgtagaccaagcccgtgcctcagggcagcctttccaggcctagcgtttgctgctttgcatcctctccaggccctggacttcctccagtcggcctctccaggcccagctcttcctctcggcggcctctgcagggccagactgtcgtcaagtcggcctgtccagggccagctcctgcctcccggcggcctctgcaggcccaagtcgttctcaagtcggcttccccaggcccagctccggcctcttggcggcctctccgggtgcaaaagttcctcgagtcagcctctccaggcccagctcctcctgcctcccagtggcctctttcggcccagcccagctc

SEQ ID NO: 1212 - DNA, 355 bp, Homo sapiens
gctactccagatctgggctgaggtgggagaatcatttgaacccaggaggtggaggttgcagtgagctgaaatcacacgactgtactctagcctgggtgacagggtgagaccctatctcaaaacaaacaaacaaaaaccccaccagcaaccttgctgacaaatccacaggcccccacgtctgccaattgcctgcctgtatgaactgggcacctgggggaggggcgtggcccccaggctactcatcttggctttcacagccaaagggcctgggtggaacctcagcttactgtgtttactgactgggtaatgtggcctctgaagctgtcacctatctataaaatggggattaaaacga

SEQ ID NO: 1213 - DNA, 644 bp, Homo sapiens
gttgtctgtttgagtaatgagtgtagaaacctataatggaggcgtgatggctgatgcaatcattttccactgatgaaggttttgatggccacctgtaatgaacagccccatctgatttaatcactgtgcaatgaccgtgaactgtacagttacctccgtgtgtcacaggaagactcttttgacttaagcacccttccatggtcatgaggtttctggttgcctctgtgtgttagaagcttggagaccaatgccttctgctgtgatcgcgttctccacagttgcctctgggtaggagcctggacactaatagaaaatggatgcactggagctgatttaaacattctttggtggtcacaagatgtatagctgcctctgtatgtttggcgcatggaaaaaaatatgagtttttgtggacatacactctttatttgaaaagtatgaaatataatccaagaaagccagccatggctcagtgataaatatggaattgatatgaaacattatattgattaatcacctttgaggatgattaataaaagagagaaagtgattctatatagagatgcaggactatttcaggctcattcatgatctaggtttttgtgcttcatggttattttattatcatcaataaaaagaaaaaa

SEQ ID NO: 1214 - DNA, 373 bp, Homo sapiens
gagcccacagagcaggagagctgccaggtctgcccatcgaccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtc

SEQ ID NO: 1215 - DNA, 143 bp, Homo sapiens
gtcctcaggccaaaggagcgactccgtttccagtttcggaaggggtttctccagaataccaaacaccagtactcgtccaccgccgccgcgccgccgagaggcaacgtcaaccgctccattgccggtggggaagccaaaggctt

SEQ ID NO: 1216 - DNA, 829 bp, Homo sapiens
acgagtcacggtggctccgcgctggcggcgggttcccccacaaggtcttggggaaaggagcatgcgctggaagctgtgtgctgttggttttgaggatcttcagtaagctgaaagcggagagtcaggggccttgtgtcctaccatggtatttgctaacgtttagagagtgcttccccttgccgagcactggaacccaaagattggatcttctgagaacatcagagaaagactgtccttaccatccacaccacagcaaaactttggagccttgaacattgggttcataatctcacagctgagaaaggtccctccacactcctggaactgtacacctattggaacccttaagccttccaggaggcaccagtcagagcaatcaaatggaatcatctcctggtgaagttacccagctgctaaatctaaagccctgagcaaggtactgtacagtttacaaagaagagtcagatgcagccccattgtactcttaagggacaacaatagaagaaatgacagaagacaatcagagattaatgaccagatgaatgatatataccaggtggtcccaacctgagctcccaggctcccaagggtcttagagagcagtaatggggggagaaggaaggggtgcttatgagctatttgcagtacttcaaaaagactaatccaaagagctcatatttgctagatattagatgcacaggctaattaaaagaaaacatcaggtttctttgctcggggctagaaacaccagttaccccatgctgactggaagatctgattggcagttaccgttgtctttgattaataaaacatgagaaaatgaattaat

SEQ ID NO: 1217 - DNA, 1835 bp, Homo sapiens
ccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaattctgtttcaaattctttgggcattggggtactcagatatcccattgtggaagaattttaagaataaatagaagtttctgttgagaaccatgagcaacatgtttcttacaatgagaattgctatgcattttaaaattgcaaatatatatgaaaattgaagacaagaggaaattgtatttctaacttgattctgatcactcacagaggtggcatattattatagttgggacatcctttgcacccttcataaaaaaggccagctgactgctcagcatcacctgccaaggccactagatttgtgtttacaggggtatctctgtgatgcttgtcacatcactcttgaccacctctgttaataaattccgacagtgcagtggcgatcggagtgtgaacttatgttcccagcatatggaaagctatcttaggttttaaggtagtagaaattgcccaggagtttgacagcaactttgtttcccgggtctaaaatcgtatcccactgaggtgtatgcagtggagcataatacatgcaaatacatgcaaaactccttttgtttcacctaagattcactttctatcttactttcccttcctgcctagtgtgacttttgcccccaagagtgcctggacagcattctagtttctacaaaatggtcctctgtgtaggtgaatgtgtcccaaacctgctatcactttcttgtttcagtgtgactgtcttgttagaggtgaagtttatccagggtaacttgctcactaactattcctttttatggcctggggttaaagggcgcatggctcacactggtgaaaataaggaaggcctggtcttatcttgtattaataatactggctgcattccaccagccagagatttctatctgcgaagacctatgaaacactgaagagaaatgtaggcagaaggaaatggccacatatcacaagttctattatatattcttttgtaaatacatattgtatattacttggatgttttcttatatcatttactgtctttttgagttaatgtcagtttttactctctcaacttactatgtaacattgtaaataacataatgtcctttattatttatatttaagcatctaacatatagagttgttttcatataagtttaagataaatgtcaaaaatatatgttcttttgtttttctttgctttaaaattatgtatcttttccttttcttttttttaagaataatttattgttcaggagaaagaatgtatatgtaactgaaactatctgaagaatgcacattgaaggccgtgaggtactgataaactaaagaatttattattcaaaatactaagcaataagtaattgtgatttatttaaagttttgtccattttccatgaaagacatactgcaataaaaatgctactctgtggaga

SEQ ID NO: 1218 - DNA, 997 bp, Homo sapiens
agatgaaaaccgggcgggatggcagccccggggccagggatgcgggagccgccgggaagacccgcgcgccgctcgactcagagggactcacaccttcccccgacaaagaggcggccccactgtcgaccaagtgcccaaggcattgtgggagtcatgattccaagatgcccgcgacggaaaatggaacttgtcagctccttgtcatgggagcattgtgggcgccacaactcattcagctgcagtgaaaagactgttgcatgtcgctgtgcagcctcttatcgccgaggtctggcttccgctgctgctgcgcggcccctcccccgcccgcccagccccaccaggaagcccagggcggactcgtcgagctcctaatgcacgcggcggcgagaaaaacgctcttcaactttccgccggcgccctcccgcgcttccccgggccacagggtcgcctgtcaaccggacagagcccgcaagagcgggtcatgggcggtcgcccagcggcgccgagagcaggaggaagccggagcccgcgcgggcgccgtggatcccctcggcctcccgttggtatcttccatctcatgcgttcagcattgtaacctcgcggcgggcgtgcagaccggacgccctcccgcttcttctaccgactgctaggcacaccagtgggttcattttgaaagaggcccttgcaccgggctttgcaaggaagccggcaaggttagattgaaggttagaagccaattagactagaatcctgcgatctggtgagactgccgccttaaaatgcaccaaacagtttttgaacctggagggctaacaggcgggaaaaacatctgcaagactgccaccgtgtatttttctcaagtaacaggctatccacagttttggaattccttagtgaaactgtcacacaggcacaaacacatgtcagctttccttctagtttgtaaataatatttgtaatttacaggccactgtattcccaactttgcaccatgtga

SEQ ID NO: 1219 - DNA, 761 bp, Homo sapiens
gggtgattacacagtggttctcaaagtatggacctccaaccagcagcatcagcagcatctggatacttgctagaaatggaaattctctggccctattccaggccttccaagttggaaactttgtgatggggcccagcactctgtgttttaacaagccctctagccttaaggaaaacaactctgaggacttttgtcacggacttgaaattctcatctgtgcttggacaagactctgaaacataccaactgtgtattttcctgcctttggtaaatctggagctattaactgattctaaagaacatttgacttaaaaagactatggaaagcccaaagaataaagggacacttgtcactggattgaaggcatattctaatttaggacaatgtcttgagatctttaacttaactacatttgcaaagacccaatttccaagtaactggaacattctagataatgaagaccccagtggattattattagcaaatgaaaactggatatcaagaagggcaaaatcttcaaccttatcagcagaaagagtttatgtaaaaatataccacatagaataactaaaaaaataagcaagtgataccttatctgagctcaaaatatctgtttctttgcaaatggataaaggatttattatattatagcaccttgaggacagagactttatgtttctaactacccatcccagcatcatctagttcattcctatgctgaacagcccctaacacattgcctaaataaatactaacatta

SEQ ID NO: 1220 - DNA, 699 bp, Homo sapiens
ctggagctgcgctggtttttcctcggagtggagcctggtaaccgcgacttccccgccatgttctgtgtgttgctggctggagaagggtggttgacaaactccgacccagcacagtgtttctgtgggtcaaaactagaaaactatgtccaggctcggccgaggcggaaggatccgttcaggccaggagttaaagagctgcctgggcaacatggcgcgaccccatctctgtagtcccacctcagcttcccagatacttgaaccccaaggttcaaggctgcaatgagctatgatcccatcacagcactccatcctgcgagacggagagacggggtttcaccatgttggccaggctggtctggaactcctgacttgaagtaatctgcccacctcggcttcccaaagtgctgggattacaggcgtgagccactgcgcctggccccttcaggtgggtattgaggcttcactacaatactagttccccgttgctgccgcaataaattaccacacacttagtggcttaaaacagcatagaggtattcctttacatttctgaaggccagaattctaaagtcagtcccactgagtcaaggtgggagcagggtcagtgcctttccaggctctgcgggagaatccgtttcctggccctggaggcggcctgtactcctcagcttgtgctgcccttctcgaatgactcgcgtt

SEQ ID NO: 1221 - DNA, 649 bp, Homo sapiens
ggactatgtttgaggggtgttgtatgaccccgttttccatacccagccaacttgtcatgtgacaagtccacagaaagatgttatatgacaggaatctatgaactagtcttccctgaaatgtacctgactacagctaacatcatatcacatgatgaaagaccgcgttgttttcccctgaggttggcatggggacctattgctcacaggaagaaaaaaacagcgtccttattttgtgacttctggcaactgtctttttccgaggaagccccttcccttctgccctgcctctgagttcaagccgggatgcagctcctagtgttttcaagcgtcttacagatggagatcagccccgtcttcctccaacgtccccaccccgcatcggagtcaggactccacggtgctgtggtcagcacggctgcatggtcctgcgaccctgagccccagtgggctctgactgtggttaccagcgccttaggagacagagtaacagtctggaagcagaaacagagactgtccatttcataaacagccacatccgcaaggtttattcctggatcacaaaccaaccccactgaccaaactcccaagtcactttatattaaacttgttatcaaatcacccacataaatatatataataaatacaaaaa

SEQ ID NO: 1222 - DNA, 760 bp, Homo sapiens
cttcactgtactgctcagacctctccatcctggtggcaagggcttagaccattattcatggtctgactggcctcgaggtggctgtctcgcctttgaaaaagggcagacacagagcatgttcagagcacggagccatactgtgcgatttcttcaaagagagcttaaccacagaatttggattaatgaatgacgtaactgcttcagggcaacacaccctcactgcagctgcttagcccaggaagcagcaaggtcaatacaaggagagccacaggcctggggagatgcatgccttccttcctggccacgtggatctcactacttagcccagatggcctgcgagaaggacaaagccaagcacttcacaacactgtcagttgctgtcctgaagaaggtggccaggagctctagaaggattcaaagccccagggatttttggtttttatgtatacacttctctttacatacttgttcctcaacatccaatcagccttgcagggatgatgtaatagccagaaaaataagtgaacagaagattccgggttctactttatgccaatttttcttaaatatctcagtcactagaaaaagatctatttgaaaatcttgctctgagcagtttctgtcttgggcccagttgtttgaggagcctgttgaatttttaaatttattagtgttcccatgcttcattcattggcatatatgtatattctctatactttataattacaagtaagctcttgataataaaaagtaactgtca

SEQ ID NO: 1223 - DNA, 262 bp, Homo sapiens
atattaactcaaggtaaattataataggattgcagataaattaagcatctttatctttgattacagagatatttagcatatgactatagataatttccccttcatattttcttgggcttctagtatttatgtatcaagaaaattatttccttatgtttgaaatggtgacatttctgaaatgtaccagcagaggatacagggatttttgtttgtttttcattttcttatttactgaagaaataaaggcattttagtttataaa

SEQ ID NO: 1224 - DNA, 216 bp, Homo sapiens; identical to SEQ ID NO: 291

SEQ ID NO: 1225 - DNA, 427 bp, Homo sapiens
gctgttcttatttgctgaaagagaaaagaccacagaattgaataccagtgatttcccgttttcttaactctactgaaaagtcataaaactgcattagcaataattacaactacagttgacccttgaacaacatgggattaaactgtgtgggtccacttacatgcagattttcttccacttctgccaccctgaggcagcaagtcagctcctctgctccctccttctcctcagcctactctccacaaagatgataaagaagacctttatatgatccacttccacttaattaatatgtatccaaatcatgagcagcatcttgtgaccctagaagaaataaatgataccaccttgaacacaaatataatcatcttgaacttttatataaatttctacagcaattctgttattaaaaaaaaaagaccaacaa

SEQ ID NO: 1226 - DNA, 2058 bp, Homo sapiens
atgggatttttctagaaggccacgtgcatatgcaccctccccttccattaccccagtatccgccatcaagtagtaacatgttgtaacagaaagaatcccattaagtcctagttctggtagcccggtacaaattttagattttcccccaaaaatgaaaaaaaattatttaaaaaatttagatttgaaatgcttagaaaacaatcatttatttttttatgtcaaaatgtccaagtaaattaatggattaatttccatgcttctggtgatgtaacaccacttggtggtggcgctgaggaaaccctgggaagtgtttttctcttctgtgtaatgaaagactcactgacaaagccgtcggtatccagaatgactgctcttgaaatgatattttgatgatgatgatcagggaagtagcctatgctgatttatttatcatccccccaccccaaccccacttttgtgtcacaaacatttgaaacacccagtgctcaagaatgctgcttttccaattctgctaatatcctctctccccatctggaaacaaagttactaaacctagttttgaaaaagcaatggaaatgaaagtgtccagtgaacttactggcagttgtgcaagttgaaagcttattccttacatcctgagcctaaaagccttattccttatatccggagcctaaaagtttgctcaaaagtagaaaactttccagacaagatcacatacaaaatggttaacatgaaatgctaatgaagaaacaaggcaagaatgaatacaagagaaatggaatctggggaaaaaagtaggttctctaactggggcagggatcttgcttcttgggggcatatggttggatcccaggtgggccacgaaaatcatcttggatatttgtttacaggctgattcctgagtttccctccaaagattctgagtccacagatctagggtgtggaccgagaatcctcattgtaacaagcaccctctgcccccgggacattttaaggtagatggagaactaaggtgagagtgtgccagctaaatactctttcctttgtccctgtgcctcagtcttttttgtttgttttttttcatgtgacactcagtaggaaagtctagttcaagaaccggaaactgagccgggcatggtggtgcgcacctgtagtcccagctactcaggaggctgaggcaggaggatggcttgagcctgacgcccatgccgctgtgagctatgattgcaccactgccctgagcctggacgacagagcaagttcctgtcttaaaaaaaaaagtaataaaaaagacatttaaaaaaaaattagagctcagtgacctgtgactcactttgccactttgtcattttcttgacttctgtcccaacgccagccctgtaatatggagataaagagtggggaggacagaactctgaaacctaaaaggcaagatttttgctaaaccggagaacgtaaaaatacattcctagaggcaatctaaccagccagataaccagaagtttactcttcaaagccaagaatcagtacccccacctcaccttccattctctcttaggctttgtctatgtctctaaggggagtttttcagttgactgatgaggtcctgactggtagggaaagcctgcagggaaatcctgtggcaaagcacactcttgatcacctacttaacaagaaggtctagcaggacattcttgatccaggtcagcttcttccctgaaaataatacatatttttaatttctgtttgaaaaaactccactgtgaaattactctgcttatattagaaggtatgaagacagtagttatgtactgttcgtttgcatacggtcattttgagatagaaaaattaaatttttttaggaaaagaatttcaagcaactttctacgaaaatacagcttgtggttaaatttcctaatgaaagaggaattattcactgaaaaatttgtctaatctgtgccacctcaaaataagaattgtgcctcttcaatgaatgttgtatatgagaatgttacatttgtaacagcacaggaaactcaataaattataaatgaatta

SEQ ID NO: 1227 - DNA, 3510 bp, Homo sapiens
gtggccttgaaaccttcactgtatttggacagatgcaacagaagcacgtctcccccactgtcaccccatcccacaacaaagtgggaatcccatcatgggtatggctgtgccaggcatggcatcgggtgtgccccatgcagcctacttcttgcatgcacagttggtacatttagctgtatggcatcgggtgtgccccacgcagcctacttcttgcatgcacagttggtacattcagctgtacacttaacagcctgtacaggaaaatgagccttagttgtagccccaaggaaatccaaacccatgcttgtgagatatggagaaaccactggttgcctagagaaagcattaaggtgtatttccagttcccctttcatgttggtgaaagacacctattcacactctaattaatcatgggagataagcatgttaccttctgcaccttgactttgctcgtgagcacctggctttcctcttcctccttctcccctctctccctgtctcagtgtgcatctgtgcagatgtgggccagtccccctgtaaccagtggttacagaatgataccatctgttctaagatgtggtcagctttacttctcaggagtcctgtcctacaattcagagcacccctagatgggatggaaccagtgctttatgatcatgttcctcttctctgtgccctgtccttcggcacccccatgttagtcatgatcctcattgtgcagggctggctggactgagaattgcaactccaggacagcagggagctttgggactaggcacgcaggggttttgtcatccatttgaaccataatttgcatattttcttacggcctccctttgtcttttctaaacaaatgaggcagacacttgaacagtaatgctggagaatgttttttctaggagactttgtaagcaaatctgattttaagatgaaatgtgaatgagaaactaggtgccagggaatttagcactgaactagacagtcaaaacttttttaactttgcaggaagaaataaattttgctctcgtctaaatgttcacaagaagtaatgttgtaaatagttttctaaaaatatttattacttgtgctgtatacaaattcatgttctgagtgatgttggtttgcattgtagtattatagaatatattttgagcagtggacttcctttcataacacagttcacacatggagaaagaacaaaaaccagcaggttgagagctgtttggggcctttgatctgtaatgttacatcaaatctgagctttaactgccccctcttctcatctggttatgttatattatatatatatattatatatatatatatacaggtgtatgataaactggtcagtggtcagtactcagatctgcagagcagatttccagatgttctttctgatgtgttgcccataagcaataagatcctaggtaataacatttattccagggcccacattggcccttgtctcagaggatagggtgggggtagaacagctcttgctaagacctcttgcctttgctggagaggttgctgtacttgaatttttgcttctgtttgtctgcacgctccttcatgtcatagaactctagcaatggatgagaaatctgccagcaccagacacatcaaaattgggcacatagatggaaaattttgcaatttttcatgaatttatagggtttccagaatctagttgaggcaaagctcatttggctatagagtaaatgtaagacttgttacaacagaaatttaagtggccagttcaatgtcctttggctatatttgacctacctttaaaacctagcccatttcatatcagcctcttctgtgcctgggcttgaaatgtctaaagctgccttcgtgtctgggattacaccatgtaggtcagtataaagagggcagtcactcctccatttctcccagcgtgtccagttcagcagatttctaaagctgttaagcagcctctctttttgaccgtcctaaactttgtgaaaataaataccccacacccagataaccattaatagaagtaatgtagttttttaggcttttggaatatgtcttctcttttgtatttatgatggtgtttggaatttttcactagtgtatttttagactgaagtgggtgcattaggataaaactttcccttgctgagcctgaaggcaagcaagagggaagaaattgacctgtattgtatcattggggaggcgactacttcttgtggtggtagggggtggggggaatggggcattgtagattatgtgggggtacaatagaattctggcctgaggctccccaagtcttattaccttgtatgaaaaatccccatattagcctcacttaatctcaatagaagcctgctgtttaccctcagggaacaagtagttttcaaaattgagctcctccaaggtcattggccaatgctgtgtgcaggcattggtcatctttgtaaactcatggcattatttcctcatatgcattatgatactaagaaattcaaccccaacctgtatgaaaagcacagcccagggccctaattgaggctagcatgaatgcctttgaggggccagggggccataggaggcccatgcaatttaactgaagctcaggtgccacgttggatttttattcttattaggccgcaacctttctgaatgagtttagggcaggggctgctgatccggctgtggattcagggagctctaaaatgaatctctaccgttcctttaaaggtctttctggttcctcccagtgttgtcattgctgaggtcgatctcgtagttgttcagttgtgctctttttgctgtcttgtgagtcttagccagtgatccagctgcccaaggacagggcctccagagggcctagcgccctcctggtaccaagcgtgtgctcctggcctgtgtgacagtgtctttcccgaagcagtgaaatgagaaattctgcaagtggccacccggaagatcagtctgtagctcttgggcctggatttctactatgttagtgagtgtaggaatatactgtgtctttaatggatgaaaattcaatgtatgctgtgaatttgttggtttgaaacattgaaatttttcattagacaatgtttacatacctcacctgaagaacctttgagagtgtatatataaaattttaaaatatattaagttgctttaaaacaatatgtatagctataaaagttggagttattttaactttgaatatgtaccaagtctcttaaatattgaaatcttgtagacttcttgtgcttctgtgttttgctttcctatcaggccatgtaggaaactgtgttcttgttattggtagaggggccctcactgaaatccaagcttggaaggatgtcctgtgttgtttcagattctcttgtttggttttgaaggatgcggtgtggagccagaggatgtgtgggaggggtttctctaacactgacttctattccatgagctttttcaaggcgcttattttatggcagcgtattaaacttctttgatattcaagtg

SEQ ID NO: 1228 - DNA, 565 bp, Homo sapiens
ggctgggcccgcctccgggaaggagccttaaagaaccagctgcccggtggtgtccgcgcccagtcccccagagtggtcgtgcagggaggtcctcacatctatgcccttggctcccacattcccgggcccaactgctcacctcccagttgtccctgcctgacaagaggaggcagttcaattgagacttgagataaacctgcaaaagatgagggaccttaaggagccaggcatgctgagacagaaacatgaacggagggcacaggaggcggggcctccacaagaccatgagttggaggtgggagagacaacttaccttatgctccagaccccgtggattctggatcctgtgtatcctcaagactctgtccaagccacaggaggctagtagaggctttgaagggtggcactgcaacccacgcacactgcctgccagccccttcagacagcccagtagacgccctagagaaggggggaagcatccgtgataactggctggccaataaccaaccattcattgtttcctgttccaatcactttccatttcaacatttaatctgcaacaaaa

SEQ ID NO: 1229 - DNA, 1854 bp, Homo sapiens
ggggaggggggtccgacccagcgcggacctcgccggagacaccccgcccgccccggcccggtccgcgggggcatgcgaggcaggggagggggcgcgcccggggctcccaccgacctcgcccgggcgcaagggccggagcccccgggttcccgagcctcggagccgccgcggctgtgctgccgccctgtggccgccgcccgcactgcgcctcgggcccggccgcgctccagcgcgtgcaccccgcactccgccctgccccggacctccgcgggccccgagtcttcctgccagcccctcggccccagggaggcggggcgggcgccggggtagacggcggggccatgtgggctttgctagctcgggagcggggcggggtgggaggctgcggggagccgggccccaatgcccggaggtcaggggcgccctggggcagaggaagcggcaggtaccccttagcgactcgtggcttctgcagcccctagaaggacccccagacgagggtctggaaaagtgaccccttcatagtcctaaacaagcagttggcaatggtgtgccgttctccacgcggtccgatgggaaagggaggccctgagccgcaacgagtaagtagatagtcagcaggaccacgtggacgcgaccaaccacaggtcacacttcggacgggagcaggacccggcgcccatccctcaggaccgccgagagccgggccctctgggccgcaggtgccgctaccttagccatggagccgcagcagaggaggccggcgctggaattgcaggctcgtcctggctgccccgccgcactcctctcacggaagtggctgtgccggaggcgcgagaacagaactctgttcagacgctcgcgtgctcggagaatggagcctggagacctggttcacacccgctatgtgtttaaatggataaaacgctcctcaggtctgtgagcctgcaaacaaggtccccactgccatctgctggccccacagacaagaacccacacaggaatgaagcccaaaatatcccataaactttccaaagagaaatgacaaaactgaaatagtagtggtgtcaaaacacagtgtacttctcagcccaatgaagctgggatgggtggcccagggagccccagacttcatggataggcttttcgttcacatggctcaaaatggcaccccagatccagccatcacatctgcactccagccagcagaaaggaggcagggccctcttcttcaaggatgcctcccaaaagttgtgttgccacagctgctcacatcccattggctagaacgtagtcatacgacccacctcactgcaagggaggctgggaaatgtagtctttaatctgtgaaatgtgcccgcttaaaacggagccatggaggaagaaggactagcgatctggggggtaggggttgggtgggcgaaaggctgtgcctccctcggtggcgtcaacatcctggccatgttgtcacatgcacttgctggcaaaattcccaagccatgcgctcacagtttgtgcagtgatgagtgtggcaaacacagctcagttaaaaataaacatcattttatagattagctgaagaatacaatgtcccacgagactatgtggccatcaggaaattaacttttctgacctaatggcccaggaagcactgcgggcagcgtctcgccccgtgtaacgcagcacccgcagaagtgcccgggatcagcctttgcctcggcgggatcctggttcctggttcttccaagggcatggcgaggtccccgctcccttatcttgaggaaagtaataagtaacccagctctttcaactcccaaggttactttgtcaataaagtgcgccttctcaagtctt

SEQ ID NO: 1230 - DNA, 2952 bp, Homo sapiens
gcctgagccagaggaagggaggaaaacaatagcaaaaaccaggacccttcggacttgccgctgaatggggattttcgtcggatgttgagtttacctggaatgccccggtgttattttgggaaggcagacatcccacggaaacaatgaagtggaaaagaaaacagctaaagcaaaatctagagcccagtttttgccaaaccagccccacgtgggctgggcaggctctggaagcccaagtcaggccgatgaagagcggctgaggccgtggggatctggtttaccaggagggcacatggaggatgcaagaaaaggaagagccgtattcaagtccccacttcagtgatgaggcagaaagaccctgcgcctgaccacgtgggaacagcctgcagtgagcggtgacgccgcctggcttgagctaagtgctgggctccaccattcattggctgagtgaccttagatgagaagagaatgagccatgtgtttcctgaaacatccagtggcctcaccggagaatctgcaagagccggtaaacccagaagcttggccgtccattcctggaagcagacattgtgtcttcgtccaccaagcccctggctctcaacactcactgtggtggcaagaacatggcaccttgaccctacacagttcttccatttttcagaagcaggtgagcacagattgctgggatggagtgagtaaaagatataaactggactgggcacggttgctcgcacctgtaatcccagcactttgggaggccgaagcgggcggatcgcttgagctcaggagttcgagattagtctaggcaacatagtgagaagctatcttaaaaaaaatttaaataaaagttataaaccaaggcttggggtttctgggtgctttgccaggacctgttcttgggcagaactgaatatatactcaattctgaggagggaagaggaaggtcatggctaaaaggtaggctctgaaatcagactcccggagctcaaatcccagcactctctgcttgccacttagacttcaggtaggggagggggatataaatgtttgagcctcagtcccctcctctgtaaaatgggggcagtaaatgtactgcacacagctgcaaggtgtgaatgaggcgatgcacgtaaaacacagtgcctatagtatcacattggggttttttggtgttttttgtttttgtttttgtttttttgacagagggtctcactctgtcacccaggctggagtgcaatggagtgatctcagctcactgcagccttgacctcctgggctcaaccacttttcccacctctgccttcaaagtagctgggactatagccatgtgctaccacgcccagctaatttttgcatttttttgtagagatggggtttcaccatattgcccaggctggtctagaactcctgagctcgagtgatccacccgcctcgacctcccaaagtgctgggattacagacgtgtgccaccatgctcagccccacactcgtctttaagaaaattaaaataaaattgttttaaacacagtgtctggcacagaatagatgctcaataaacaccagctgctacaattagaggggaaatcatcataattgttggattaaaacataataaaagaccccagttgccttgttcaaggcagtattttcagaagcaaagttttaaaagtttaaaaagaggtcagtattttaagtcatgtcagctccacagccacggaagtgctggaaaggcaccaagcctcctctcggtttgcagtgaaacgctcctcttccgtctgagggctatcgttccagcagagatcaacacaatggactctgggatggacattgttctccaacaggcctggccctggcccagctggggtgagcatttcctttgcagcattccaagaggcgacagtcccaaaagataattaaaaatcagctagcggtggtgaccaagagaaaggcactgagccctccgagtgtggagatagggcatcccgggttattaattaagtgtgctcacatttgcatggtgtagaggacaattatcaagctggagctgtcagctttaaatgctgtttgcatttctggatgactttttggcgaagagggtcagggaggctctctaaagtcatttttgggagtctggaggaatagttagcaattcgcacttcacctcgttttaccctgcaactccatggaaattccagaaagtcttggttttaatggtctcttgcataggcccatgacatgggtcatctctctcctacctccttccatgctgaacaaatggaaaggcatgtaacatagtgtggcaaggacttaggagtccagaagctcccagatgtgtgcacctgtggaatccgccaccacaccctccacacaccagcctctgcaaccagacagagagaggagaggtaaggggtgaggatgtgattgatttccatcctcggccctccaaggaggaggctgccaaagaaaacaaaggccactgcaggggggcagctcgtggtgacaacctgcactggggccggagggcagccagcatggcacctggatctgatcaagatgaagttttcatccccatctgcctgttaatgtcttctttaccagttgccaccccctaataaggggtatgccgtagactggaagtcactagggacctgcccagcatcctgttctaggcattgactaatccactctcctacatcctgcctcccatccacatggtccaatcagaggctgccatgcttgcacaatgtgacactgtctctatggacacattaattggtcctgatgtagaacttgacccaagatcagggtcaagttgagagaagacttattttctttccaggtgtttcaataacatgtaaaacttggaattcgatagcagccatcttctgccatgagaattgggaagagagaaagcctatagtgataataaagtcaaattatcctaaacgctaa

SEQ ID NO: 1231 - DNA, 738 bp, Homo sapiens
gtttgtagatggaaggaagaacttgtgtgcttagacctgacgctgggaggagatgctgccacctaggttacttgtaggaccctatacggcaacctcctttgccaggaactatttataaacatcctgcaggaaaatgagtctatatgtcagaatacacatttcccaccttgcccaacagtagaaaaacataagaagagaaaaacattaaaaaatgacaaggaagttaatggaagcaatgtgatggtgtttggaggtggagccttcagaaggtaattaatgcccttgtaagaagaggccagagagcttgcgcaccttcttcctgccatgtgaggagccaagaagccggctgtctgcaacctgcaagaggaccctcactagaagctagccatactggcatcctcatcttggctttccaacttccagaactgtgagaagtatatgtttgtggtttagtcaatggtctatggtaatttttttatagcagtcccagccaagacagtgcctcatttactacataccatttatattattatataggctcctttcagaaacccatgttcaaataagagataagatactgaaacacataacaccttcactagtttttagtatacaaatattgagaaatagtttgttattaactatctcatccaagaaatgcagattcatgttgtttctaattttttatatataattgacaaaatgaagaaacttaacaccatcctagattttagctgc

SEQ ID NO: 1232 - DNA, 2021 bp, Homo sapiens
acattgccagaaaacaggaggaagagcaggtctggagtaaggctgggggactcaagcgccaatgtgaagctgaagagcgtcctggagacagggggcggtgagacggagtctgcccaggccacaccagtggccggggtttggacctgggcctggggagggtcgctgtttgagaggaggacgcagctttataaaatgactccgctgtcgtaaagattaaatgggaccctatatgctgttagcatggtgcctggcacagggcactgtactaggcactggggatacagcagggagcaaaacagtgaaaacccctgtcctcaaggagcttctatgctggattccacagccacacactcaagtctttgttgtcagccctcctctcccttagtctgcaccctcccctgagcctctgcctcagcctcctcccgggctcaggattccctgaatttccctctcctcacacatcctgtctctaagctccagatgcgcttttccagtcacttgcaatggggtgacctgcagacgctcaaacctggcacatctgaatagtaactcacaatgcccaaccccttctcaaacctgctattcccactgggttccctgaggagccactgtccagacccctcttcctccaacatgcagctcttctatcgccatcgccaccatgaatagagcacttagtgcaggcaccatgctaaaagcttttatttattaaatcatggaatcccctgacgtccctaaaaaccattccacttgtttgcagataagaaaaccgaggcggaaatcgttaaacagccttaggttacacagttaggcagagcccggacaaagagcccaggctgtctggcctcagttgtgcttttcctgccgctgtgctgtcctgcctcgggtcccatgggcttgcctcagctgtaccactgacctcaggcccctcctgggccgcatctagctctgccctgggctattgaagagcctgctcactggtatctctaattccctctggcttcaccacagaccctgctgccagggctgcctatgatcccctcccttacaggcgggatcacttccccagcaccaccacacccctgcacccctgcaattttccattgtttacaggcagcctggccctgttccagaccaacttccccagtcccatataacctctccaagacccttcttctccctactcattccccacgtgttacagccaggcaggccgtccaccccaatgctttcctaactcccgtggcttcctcaccccgtctacctttactgagctctgtatcctttaatacccagcctcaaaggccgtctctgctgcaaagccctgcctggttccctgtcagactcctctggctctctctgctgtgcccccacgggtcttcacctctggctgggttgacttcataccacctgggattattgtttgttatctgtgtccatctgtgtcctccagtaacccatgatcttcacaggccagtgccctgtgttagtcatctctgggtccccgtgactgacggggctgggtgcagtgcgagcctcagtactgaaatgaacagggccggcctacgaggtcactccgcgatttggggcaggaaagatctgagtttctttctgcactcccgtcgagtcctgctgtagaaaccacaaatggggaatgatcgttgaatcccagaagactgagcaggaagggccgctgcaggtcatctgtgttaattctttatctttgaaatgttggagtgaggcccagaaatgagaaagacctagcccacgatcactccacagggaggagttgtggttggaattcagacccctggcttctagcccagtgtgctttctgctttgctgaaccattccatctttgctttttctctacacaaaccacctactacaataacaacaattgcttatgctgaaaatcagcccagtctcatagctctggaacctctctttgtccccttccagataaccacaggacactttattttacacttttgtcataatgattttacactctcattttt

SEQ ID NO: 1233 - DNA, 744 bp, Homo sapiens
catttggaggtatgaagagatcttggaaatagaggccatgtgtgttgaaacaagaccgaacaactccaagttcctgaagacttcatttcaccaacccagaacctccttgatcatcacagtgttcaaatggtttccagcaacattcctaccacctactttgctgacacaaaggtgcataaacagaagtcctatgtggtcgaaccattttacattttcaccagcaatgaaggagggttcctgttgctctaccatttggtactgtcagcgttttggatattagccgtcctaatagcctttgcatggatgattgtctgtcctctgttgggccccttctgaagagttggagttggctttatacaattattcccaaatcttctaaactgacagtgagggagagtaatttgaaaggactgctcaactcaacgtcatttgaagatttgcaccacagctgcatttttccaatttcctggcatctattctgctctcctggacttttcaaaaacaattgtaagtggatgaataaatataataactgattccattgatactcttagaccatcctttggactttctgcttttggacattttacagtttaaaatttatttatcatctatcgatgtttcccaaagaaggactcaaagtacacattgtcaaagatctcatggatctaattaaggacagggaacaggtacagaatcatacattgtctctacacagaggggataatttctgaaggaaagaag

SEQ ID NO: 1234 - DNA, 2117 bp, Homo sapiens
aatttaagacacttaccaaatggatgtctcgcaacaattggctccgatttcaggccttcccctacaccatatttattttcggcactgaccctgaaggtatattccatgccctcatgaagtctggttactctaaaggtggttttctggacagctgaggcgcacgtcacccacttgttgttcacagaatccctcttctctaggatatagttggtgatttcagaacctccatcatcctttggaggagcccactttaaggtcatggcttctgctgtgacttcatcaaatttgattggtccagtggggatgccaggcttgccaacaacctttatggagatagttccttccttggtgccagcaacattcttaagtgtgattgtgtattttccagcatcagatttttggcaatcgtacactataagagttgtgttaaccgcagatgactcaacactgactctagtgtcagttgctagaggatcttcccctttcttccaggagactgatggagctggcttgccttttatggggatcttaagccggaagttgctgttttctttagccaagtagcacaaatcaggtagaccctttaagtcaagatcaggagccactgtaaaatagcagagataaattactgttatttttaaggccaggcgattaactttttcaaatagttctagcttttaacggatttttagataagctagtgagtgggacacaagagtgcactttcgatgacaataaaggaaaaatgaagatgtgtgcatagagccttaccaacatcatcccttgccacaacagtgatttcgcttggggttccttctccattttcattctcagcactcactctgaaggtatattccttcccttcagtcaaatcttttgcagagtactgtaggcttaaggatttcataactcgttgccacttattttcttcagtcaggaaatcaactacatatccaataatccgacttccaccatcactgtgaggctttttccagccaatgctacaggatgacttagatacagacctcactttcaggtccacaactggtccaggagtttctaaagcaaaggagaaatgataagtgtaagccccatataacaaaggaaggatataactcaaaatgatgggatgatggttcatttgcttacgggaagctttgacagcatcacgagtttcaccgggatcaccaatgccatactcattttcagcaaacactcggaagaagtaggattttccctcctccaaattagctactctgaagcttgttttggagcactcagttgtcactgtagaccaggatttcctctctgcatcacgtttttgtaccacatagtttatgatggggcttccgccatcaataatgggaggctcccaggtaacataagcagagtctttggatatttccttaacagtcacattgacaggtggcccaggagtatctggataaatagtaggtaaataagaaatgaatgtgtaaaaaatacataagctattttaaaatatatatgattcttttttgaaatagacttaccaagcactttcacaacaatggtatattcctttttaccacagctgttctccagggttaagatatattttcctgcatcatatttgttcacattttcacagcgcaagaaagtgtcaaagtcagttgactttatgtccagtccaatcctgtctcttagattgacatttggtttagaccaagtaatctttggaggtgggcgtccttttactggtacatatagtctcatagtaactccagcacgtaatatgagtgtcttccttaagtccgcatcaagttctccctcaggtggaactgtttaattttgggtgaagaagttaaataaaaatttaatagtcaaatgtatttccagggactggccttgtcactcctaaaatacatttattttctagagctgatttcttgttctttaaaacttccttaatacaatcctcaaaatcatttttctgttctgtactaattgttgatctttccattttccactatgctttaggcttaaccaggttttccccccggaggatctgtacctcctctttcatgagccttatgtactctgaaatgctacatatattaaaaggaaagtagacgatt

SEQ ID NO: 1235 - DNA, 396 bp, Homo sapiens
aaagtcatacttcaatcctccagaatagattacttctgatttgaaaggatacatttcttagggaaatcagtgcattggttacatgaaaaccgtgtgacaaccttggaagtctgaaagagcaggagagaggctaagcacacacatattgtgattttaagagtctcaaggtgagaagaaacatcagaagcagttgagagaccaggacgtgggtcctcaaaggatgaacagaagttcttttggataacattttaaaatgtttcctccagagttatctgcctcattaacaatggtttgagtctcaagagtctctcttcgattttacaaacatgatttgttgctctgctataaatgcatgctgctctagtccttcaataaacccacaacatgttttcacca

SEQ ID NO: 1236 - DNA, 5941 bp, Homo sapiens
gcacattctctatatggcagattcggtgctgtctctggaaatacataaacatagagcgattcctttttctgttgaggcaaaatatggatttggttaatttctattcacgtcatgaatgtggtatgtggaaggtcttctgagagcagaaagggatgtttcacagcacagcccggctgtgtggtgctcagggcaggccctctggaggaggtgagcctgggctcttggcctaatgtttcagctctcactttccagtcctgagctgttgttgccagtccatctttcatgagaccattggagtgatctttctggtcttgtcacttcatggtttaaagtttccctgggcctacacagtgaagtccaaattcagcatggtattacaagacccttatgatccagtcttaaccattggttaggtatcctacccatactgtttatctcttgaatacctctatgctctttgacaagtccagcccctacgtgttcatacctcacttctgtgacacagccttgcttcagggctcccaatctctgtagcctccctgaactgtgcatttgctctgctgcttgatttgtttctgtgactgttccattctcctcgggacacatagcagggaccttgtcttggtccttttttttttggctttaacagaacatagcaaagaacctgacataggtgtagtctgagtttaccactggggttatcacagaggtctgctaagtgaatacaacacagtggggacccagaacctctagaaagggttgaggattacaatccccagatagctacaatcagggaataatgtaacctgtttgcctagggtgctacatggtaatcttgaattagaacaactgagacttccatgggaccttagggtgataaccattaaacctactctttcagtgtttactttgtaaaagcatcacactaaggaggttgtcatttaatcctcacacctaccctgggttattaacactgttgatgaagaaagccttacttggctaagatatggagcaggttagtaagtggtagaatagatactccagtcctgtctccaaaatgcaaatttttttttaattaaaaaaatttctaattttcaatatatttatttttgattttttattttctgtagagttggagtttcgccatgttgtccaggctggtctcgaactcatgggtgcaagccataccccaacctcgaccttccgaagtgttgggaatactggcatgagccatgatgcctggcctcaaaatgcatacccttaaccactatgctctcacatttttagatgtgggatttctgtctacgacgtcgcccccactaagacctagggcttaggtgtcgaggtgggaaagatcttgaggcttttcttctcaaaattaatcagaaacgatgtgaattttatatctctttctgaggttttccccataagctaatcgggattagtagacttaaaggtgaatgaccaactgtatccctggttcactggttaggaagagtacatagtctttgtgtataggctattttcctcggtaaccttgggcaacatgcttgacttctccaagccagtctcctttgtgaaaggtgatatacttacaagacattatattaaatgagaacccaggcaggttacctaccctaccatgacactggaagtattctttgccttaagaaaaggagaattgctggttggttccaggtccggtgggtaccctcatttcccctgggcaattttactgtaaaaatagaccaaggatctcaaggcccagtggcttttgccttctgggatacttttttacctccctgtttagtagtaagggtcacattttaaattgcagctatcacactggagggatcagatcatttagaactttgactgcttaaatattactcttgctaagatcttgagcttgtctcatgttgacagactagtgaagttggttacgttgtctgtctcctcactggagggagagattcagagttgccctgtccaacccagtgctatctctggaaagggttggattgaaatctagtctgccttcattctgaggtataatcatgagggttaggtgaaagggtcccgagtgagaagatggcatgggtcctagggtggggagcccgatgccaagtcagacttcactcggtatgtttattcaaagccccactttcactcgtagcatatcataggtggtctctgcaagttgctgaccctgattcagactgttccataaaagtcagacacttggttttagttcccaaactgattttgatgacattcttgactgcagggcttggagttaaccccactgggcctgagttgtctctctgtaaagttacacatcatttcagactcaaaggcctctagcatgcagggtctggtgtcataataggcaccaatgggaaccattactgtcattgccttttttggctttaatcttcccaattgtaagttcctttcatgtttaaaacaagtttaaaagacagggggacttaggcatgctcaggcagtctagcctttaatgtaagaatttcaaaacataaaggaaaaaaaacttttttttttaagcagtactttgtgagttacaagacagcagcagctccttagtgttgattgccgaggcctttttggtttgaaaactctgcttcctttgtgaatttggtgttaggagttcttattgttattctgcagcctttactattgtcctttatttactgaacacagtgaataccaagcactgtttattagaggttaggagtaggggcaggtgattaaaaaaacaaaaaagctaataatctcctcaagcaatttctggcctaatagaattatagtagacagtgaagtatctaaacccagggaatcagattgaggcaccatgtccatcgccttgagaattaataggctgcatttctgggttctcctttttttttttttttttgcccaactgagtctttctgtggacttacatggaacttcttattctcttaaatcattaagttacttgacaatattcttggatttggagaaactggatgtagggccgtatgaaaaaatcattcgaaatcagatttaggggtataaggttggataggaatgttttagaaagaagaatgtaaggcagataactaatttgtcacatccaaagtataaaactgctactttttccctagaaaagggaagctcattttaggcagcctaaaccagtaagattttcttcctcctccaagtgcagatttttgtacctttcgtttgtcaaaacattctttggccctatgcatgccagagtgatatagaaaggaagttaccacatttttttgagaacaaatcactcctgataaaatttcttagacaattgataatcattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggagaattgcctgaacccgggaggcagaggttgcagtgagctgagatcgtgccattgcactccagcctgggcaacaagagcaaaactcagtctcaaaaaacaaaacaaaaacctgttggtatagtacgaaagaaacgtcttgcagttttctgttgcagagaattaattagaaccaacctgttggattatacacattcacctttcagaatcctttcttctctgtggaaacccacactctcagcagtgtgtgggaacacagtagattcttaaggaatgcttgttgaatgttgcagtctgcatcttcttgaagtaacagaactgttggtagctgtttaaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttctgtgtattaagattagatgttagctgctgaagtttgtggaggtcggacataaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttggtgtgacacatgtatctttgtaattggtttgatttagtgtgctttatttcaataaaaattcagtattataatttacagattggggtggggagtggtatctacttcaaattactgaaatcttcctagtagaattcctttttaaatgtttgaactcccctggtacatcttaaacacgacattgacactgcaagtgcttggatgtcctggcacctcagaacacaactttgtgcaaaaggagtgctgtgcatctgaatagtgcaattcatttccaatgcaagaatgccagtttcttagggcccccggtcaggatattacccacttggtttaagttgtgatttcaaatcccattttctatgggagatacactggtggaacaaatctgcagagggccctgcacctgcgctggtggatcaacggtgtcttctcacctccagggctagctgccttgccttccctcgtggggcttaagtggctgggaagcagatagacagtgtagatgaagtcctgggccactggctgctggactgaggcagtgagatgactgggctggcatttgttctttctctgcctgtgtgtgacctctaactatgtgcctggaaactgaattacatgtaattaatgctgcaaacaggattttcttattgcctaagcatgaacttggtatgaaaataatagttaataatttactatgtaacttggattcttataacctggactgtaagtttgttttagctccagtgggagtttccttttcaaagtatgatgaaaccatcctcatcttttctacccctggactaatcatttaaaatggatacagacactttaaaactgctgagtttatcttgtgttaagcaattaagacttctctgtctaatcatgctacttgttctgcttttgtcaattgatactctcatagcccttttgaaaaagtatgtttttgtagaaattaagttgtatgccctcaggacgtacaacttggttttttttttttgttttttttgtttttttttgttttttttttagttctgaagcatgtttagatttttctgtacttgtataggtctgattgtttatgtggcttagctaaggtttcctaaagcatcttctagtagctgtcattggtttgtaaaataaaatttgggctgtcaaaatgca

SEQ ID NO: 1237 - DNA, 2139 bp, Homo sapiens
atgagcttgcttcccttctaccataactgtaagtttctgaagtcctccccagccatgcagaactataagtaaattaaacctcttttctttataaattacctagtctcaggtatgtctttatagcagtgtgaaaataggctaatacatctggtgaatcaataattaaaatgtagcatagctataaatggaatactactcagtaataaaagaataactcgatacatacaataatattgatgaatctcaaatgcattatgggaagtaaaagaagccaggctccacttatgtgacattctggaaaaaggaagactatacggtcagaaaacagatcagtgtttgccaggacttgggggtggggggtggggagtgattgactacaaaagggcatgaagaaattttgaaggggaggtatggaacaggtctgtatcttgactgcagtggagttattgatacttaccaaactgtacaataaaaagtaaatttttattgtatgaaaattatgcctaaattaaaaactattaataaaatcagcattagcaaaatatatgagtttatacacaagagactactcaaccattgggtaaactaattatttttaaacaaataccattgattttaatctttttatagtttttatacaggcagagaaataatagtgattctgctcacctaaaggaagatagacccaattcaaaggtacagaattttccccaaatagtatcataatttttcctttcagattccaaaggatttgcatgtaaattctatcatgtgatcctcagaaccaccctatgagggtaagcagaacagatgatccatgatattccattttataaatgaggtgcaggttaaatatttagccagtatttcttgataagtatagtccatttatttcaacaaaccttgattgagggccccagtacttgttgagcttttgctgagccacccctgctctagaggagcacatgctctggaaatctctaaggaaactactacaactctaaatagatatggtgtatagtgatactgtgactaaatattcactgcaaatttcctctaaaattatagatatacattactggaataattagtatctcaacatcttcattaactatgaatctactatgtatatatcatcaccatgtgagtattaatttggtacaaataggctgccaactctaaaattatttgatgtagggcaagtacttttatctttttagccataaattttctcatctgtaaaatgagaggagtaggcatgtgatcattaaatcctgggttacggtaggaggcatcaatatgaaatgtttagcttaatatagatacagatgggtaaatatagaaatacttaaaaatgcatgtggattcatgtttaatacattagtatacacacatatatttccaagttctgtcctccgaaggcctagaagcaatgacaagcagaagcaaggagcacacccagcatccagttttttgtttctaatactgttctccaacaaagggaaccagagcccttgagaaaaatgcctaattctaggactggggcaggggatatacaagatgagtctgaaacatcttatagtgccagaaaataaacaagtgctttaaaaagacacaaaaaactgatggtatatcaaagtgacataggagccaactaaaagagatcccaatagctaaagctagaataattcaaaaaataagtaattcagcattggatttaacccaaattataaaataagatccatgagttcatactgatacaagtaaatgattgaagaaacaaataattgggagataattctcatattgaaaaattccaaaaaatttatgtactctaccctcgagaagatggaacataattctccaccccataagcatgagtcgagcctagtaaatgtttttcaaagagcgcagtatggaaaggaggaagaacactacctcaaccagctgatcaaggctaacatctctagtatgtcattagtggcatgtaaccttgatatgatatgatgagaatagcatttgatctttgatctgtttcctccccgaaactcattgccccagcctaatcatgaagaaatatcagacaatctcaaattaagtacaaaataaccagtactcttcagaactatcaaggccacc

SEQ ID NO: 1238 - DNA, 800 bp, Homo sapiens
ttaatgtattttgtttctttttctttttttcccagcacgtccttactctggcactacgaaatgctccagactcgtgtgtatttcttgctccaccatagaatcagccatttctacaaatgtcactggtttcttttatggagaatgacattggaaaccaagatctgactactaagtgtgttctttgctactgggttgtcatttctcttaaggcttccaagctgacagagcaaacgagtatatgacacatctgattttttatttgactgtggaactctgtatctatatacacttgcaattcttatcaagtaaaaatacatcaaagatatcaacaaccacagacgtatacacccgacaagaaccgctgtatattctagtacatcatttattggaccaacaaatacatggcatctggcaaggaattgaaaagtggcttgtctatctggaatacagggaggaaggagttgaaatgagatgggaagagtcatctgtatgcagaggaggtataaagtcatgcaaatggataagatttcaagaagaaagaagaaaaaggtaggctctgagtttggagagttgaatgagcctacagagataatgaagttgttgctggagagcctccataacttctgttgagaaatcggccttaatcttattgatgatgactttcacatgatcctcagatatctgcctctagatcccagatgagcaccagttgcagcagtcaaacgtcatctatctgtatatcaagataaattatgaaaggattatataccaactgtctaaatgacaaagagaagaaaggt

SEQ ID NO: 1239 - DNA, 1021 bp, Homo sapiens
agggatagctggtgtgcgtgcagcggaaggcgctaactgccctggatgtggagacccgcggactggacgtgagaggcgggcaggggcagttggggcagctgcccctacaacactgaagaattggaataggaaagagtgtgggggtaggggacggggactctttgtctgcagttggaatgcgcggaggggcatggtggaatgtgtcgcgtcccgggaccggacgacaggaggcatgttctgcgctagcaccgtgactttgttcccagcgtggggactgtgggagagatggagagagactggtacagaaatggtgagacaaggagagagccataaagaggaagacagagagaaagaagacaaatgcataaagaggttcagagacgtgtgactgtggagatcgaaggcctggttttagggctagcgaacaccttctccctttggttttggtccacagaagactggtgatacagactccttatcagtgtaattgtggggactggtcaccagctcttgcttgagcttttccagaagaaacttcactactgaaatattccaagaggacttgatgctgccacaaagagaagagaatgaataaagttgtcggctttgtaagagccagacaaacagagatacccagcactaatcaactttgtggcaaatccctccacagcctaagaaggatccctagcagcaatcctcaagagcctcagcagattggagagatgcctctttgattctgtcccagagctaaagattggaataactgtccctccccctctaaacccacagtctgccacaagaacattttaaaccttcctccatgatgggcagcagaactccctgactagtcctccagatccttctcaagcacagaatagagagagcatgatggtgagtgaggatactgtccttcctgcaggtcttcagttccaccacactctcctaagggaaggaagaagccaggcctcaatgctgtacctctctctggaggcagcaggcacaagtggaatggaagtgatgg

SEQ ID NO: 1240 - DNA, 553 bp, Homo sapiens
cctgtaatcctggcactttgggaggctgaggtgggcagataacgaggtcaagagatggagaccctcctggcaacatggtgaaaccgtgtctccactaaaaatagaaaaatcagctgggcgtggtggcgcacgcctgtagtgccagctacttgggaggccgaggcaggagaattgcttgaacccaagaggcagaggttgcagtgagccgagattgtgccattgcactccagcttgggcgacagaaaaaaaaaaagagagagaaagtggcacagctgagatgtgaacctagcagtctgggccccagcctgcttttagccacttggccagcattccctgaggtgggagctttcagaaatcctgatgtccagactgtaccctatcccgatgaaaccagaatcgctggggtgggccccaagcaccagccatttcttcaactctccaggtaaagaagagcgaccgggacagcgctgaagggcaccaccttgggctttcgaggcccaacacctcctcagcccccaacatgctccactctctcaaaaaaaaacaacccgcg

SEQ ID NO: 1241 - DNA, 688 bp, Homo sapiens
tgggcgccagtggcttcaagggaagaccttgggacctggatagggttctccctcgcaccagaagtcatcggcctgtggggtctccaggagccacacctctcgaggcaggtcacaggccgagctggaggcctccttgggcctgaccggctccagcacccgagacagactttcaccatgttgcccaagctggtcccacattcctgggctcaagggatccacctgccttggcctctcgaagtgctggtattacaggcatgagccactatgcccaggcaatccttcaggaagaagaccctggcgaaaattaccttgcatatcaagagttggcggatgaacacgaagcaatcaccttgggaaaaggagtgatgaaagtagaaagcactaaagagattctttatagttcttgatgggtagcctgagttgctcttgccatgtttttgtttgttttttttcactcctcaccgtatctttaaatcctatttttaaaaaaagtaatgaagaggtagccaagatgttcttcaacagatgaaaggataaataaatggtggtacatccagataatggaatattaatcagttataaaaaggaatgagctactaagccatgaaaagacatggaggaaacttaatccatgttactaaattaaagaacccaatctaaaaaggctgcatactgtgtaattccaagt

SEQ ID NO: 1242 - DNA, 643 bp, Homo sapiens
atttccagagagaccattaggaacagactgcctgcgctgctgacttaaggccccaacaccaaacacagaagcaacagccttacacagagtgttcagcaagctccaacaattgtgtaagcagcccaagctgacagagatagaaacaacacaaggacccatcagcagacgaatggatgatcaaaacgtgataggaaaaatgaggcctaaagaagttaagaaaataccatggaaatgtcactgctgaactgccatacgtaggatccgaaagaaattggaactgtataatgatgactgcacaagataccaaatcagaagaggttccatttccaagttctgattcataagagcttccaaagtagagccggtacatattgaattttgattcatctggaaggatctcggacatctctaaagaaacaagggactgatctaagccacattctccatctccagctgaatcgtcagagccactgctatggttaagaaagaccattgaagacagacttaggtcactatcagagctggaacttccatcctaaaatacacaaaaggacaaccagtttaaagatgtaaacaattttagtctcagaaataaataataacatagatagcattctattagagcaatacaagaaacttagaa

SEQ ID NO: 1243 - DNA, 2795 bp, Homo sapiens
agattcgacacaaaacccggaaggaccccgccgaaggttttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacagttaagtgaaacaaacaaacaatcacacaatttatgtggtcactgagtgctctaatagtaaggagaaattaagaccagctggctgttagtcttaactctagccaagacaaaactccaattcagctacttacctagtaatgagtctcaggctgaagtctgctctctcccatcctagaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaacaaatttggggagatcagggattctctgggggtggggtggctcccaggcctcagccaattgtcctattggtttcagccataaagacagctcaggctgctaccacgcactgataggagatttgtcaaagatcgaggcatcttcactcagaatccctctgtgattaccaattgtgaacacaaaatatctgatatgggtctcagtcaatttagaaagtttattttgccaaggttaaggacacatccatgacatagcctcaggaggttctgttgacgtgtgcaaggtggttggggcacagcttggttttacacattttagggagacatgagatatcaatcaatatatgttaagacatatatcaggtggtccaaaaaggtgggatgactggaaacagggagggggcttccaggtgataggtagataagagaaaaacagttgcattcttttgagtttctaataagcctttcactgaatacacaatttacaggactaatcacttaagccttagcctggctcagtgaaacaacagggcaaaggaagcaatcagctatgcatttgtctcacgtgagcagagggatgactttgagttctgtctagctatcttgtttaggaatataatgagaggcaggtttgcgtgcagtttccagattgacttttccctttggcttagtgactttgaggtcccaagatttattttcctttaacatttacaaggagaagtgaagaaataagtaaattagagagctagaaggatggaagtttacagttagagagagtgggatgttgaaggtaatactggttgcatatttcttatccaaaatgcttgggaccagaagtgtttcagatttcagatgttttcagattttggaatatttgcattatacaggttcagcacccctaatctgaaaacgtgaaatccaaaattctccaatgattgtttcctttgagcatcacaatggtgctcaaaaggttttggattttagagcatttcaaatttcagattttcagattagggataataaacctatatctcagaaacggtacatttctgaataatgacaaattgtcattatttgccatgagaattgtcattaatgtgggtggagatggggatgattgtaggtcaagagactgaagcaatagggtaggcttgggtgttagtacggcccttcatgggaatgtgttgatgtcatccagggtcacgggaggcttctgagtgggaaggaagctgagagcctatgattacggtcttcactgatgaaggcagacagtaggaggttggcagatggtgggcactgactagactggaagtgccaagaacttcagtggagcaaggttttacccaagacacagaggttgtggtctagagcagcccagggatgaaggatcacccattggagaggactgtggggaaagcagagtcctgggagatgaaccaagcatcagttgaggctggaacagttaaaatgtatacatcaaattctctccaaggacactgtacccttggctgaaaattccctccttagtctacttcccatcccaaattctacccatccacactgtggcatcctaggtctctctagcagctgaacaggcaggcctctgtaacaactgtttcagcgctgactgagtggttaagttaaatattaaaagttgaaagagccagtaaccttatacaaaggctggaatagaacaaaagcccaccacaagtttttgcctaagtctttcctgtgccttgaaccatgacaagaggaggaaggaattcttaaccagacccatttaggattaagtaagtttttattggctgggtacggtggctcacacctataatctcagcactttgggaggctgaggcaggcagatcacctgaggtcaggagtttgagaccagcctcctggccaacatggtgaaactctgtctctactaaaagtaccaaaatgagccaagcatggtggcgggagcctgtagtcccaactactcaggaggctggggcaggagaatcgcttgaacccagaaagcggaggttgcagtgacctgggatcacaccactgcacttcagcctgggcaacagagtgagactccatctc

SEQ ID NO: 1244 - DNA, 448 bp, Homo sapiens
aggcaaagccagaaagccctggcaacccaaaactgaaggatctggggctttcttcctgcaagctctgctcagcgaggggcttgtgctcctacaagctctttgctacataagtcaagccaaacttccatttcccgacatgacatggccaaataagagaaggccaggttaccagagattaaaaataggacgttgctgcagagtcctgggaccggctggcaaatgacacaggaactttgggagcgcatggactcaggccaagcggccgtcctcaccctcggccacctcagggcagggacgaagagtaagcccagcctttgatggtggggattagtcccaaaattctggagttcaccactcctcccgctacactggctttatttcaaatctctgttggtccatgtcaacatcagcgatgggagttgaaagaagtaaaacagtgactcgtgca

SEQ ID NO: 1245 - DNA, 1569 bp, Homo sapiens
gcgatatcccctgggtgggcccgggctgtgaagcagggcggtagttggcgggcgatgctatttatttcactcggattccgacttgggtggtctggggagcaagggatttgtgtgtttgcaaccgggtgtggcggcgagggaggggcccggccacccaggtgggccagcgggatgcctgggaggccggtgggtttggctgaccacttcttcccattcctcagtgagagacttgggccctcccggtcatccgagtctgtcccgaaggtttaactgcgcgcggcgaggggaggccttgtaggtttccaaagggcggagctccagtgggaaaacttgaaacttgtcgtctgcggatatttatttccacttcttgtatggcctgaagaatctaggaggagaaaaagccagataccaaacttacggccaggcagacgggtcgcgggtgttgacagggtcctgagggagtttgaagccttattctcgagccgcctcctcttctctacccacacttgcaccgaggtcaccccggcaccctccgcaccggttcggttttggtctctgcttgtcctctcagtccttggtactttcgtctccctcagccggaggtggcaaactcagacatctacgggcgcccgaggccctcgcagccctgagccccagctttcacttccctgggctgcccctctccgggagcaggcagacgccccgttctcggagcccagcgctcacttagagcgactgaggttggtcgaaggatctttccccacatcccataatcagggccctaggacactcgcaggtccctttaactctgcttctgtcattacactagaacaagtagtgtttctgtttagagtcccatttcacaaattggttagtggaggcacccgtggcctggcagcttgcacagtggctgtccacctcgggggggtgtggacctgagccgtggctcagtgacaaaccaggcacccaactatgcaaggcccctgcctggtgggcatcctaccctctggactgggcccatggaagccactgggcgggcagctggggtgtagttcatgtgaagccccattcccctcacgcttttggggccactgtgaatggggccaggaaacggatttttggtgcagctgcattccctaatagacctagttccctccacgttagtgtagacatggccttgggggctgagcgcagcagccaggctgccagggctgggggcgggtaggaggcacggtagttggtgggtgggaagagggcctgggtggtggcggtcagttagcctggctgggtgaggttggtgaggttgcggggcggggtggtgaggagagcaggggtcccagggaggcattggggtgctgggtaatgacctcggccctgggtttctcctctccctgcgggacaggagcctcagaaagggccaagggcaaggtgggcttggggggctctgggaatctcagctctagccctgtatggccaggatctgctgtctccgtccctcctgggccccagcagctgtcctgcagctgtcagcaggagggcctggctttaataaagagtggacaaactgaa

SEQ ID NO: 1246 - DNA, 622 bp, Homo sapiens
gaaagtgtgcgctacacgccgcctcggccatcctccgggacgtccccacttgtccgcgggaggttgacataatctggtgtcaagaagtgggaccaaagtgagctcaccttgatggatcggtgactcctggaatcacatgaagttcccacattgagcccctttgagctctccaatcctacagctcaccttttctgtcatggtgaatctcctctcaggttcttgaactccctcattttgggctgcccacctgtgaagaagattgaggtggaataagagcaaaacctcaagtggggccatttttgcttcagaatgaaatagaaaaaggccacagctgaactacattttctagcaatcctcagaataagatgtggtcattgactgaattctggacaatggaatggagtagagtgaaatacatcactcctagtgacaaggaggcactcaagcatgagttacaacacaaccgacctggaatacagctgaaaagattgaagcaacaggttcgcaggggaaggcctttacagcttctttcgactctgacatttcaggatcagcacaattctcccctatttactgctgaagcaatcaactgggattatacaaaaaaattatttgtattgaa

SEQ ID NO: 1247 - DNA, 556 bp, Homo sapiens
gatcggagcctggagccggtgtgtgctgggtgccgagaagagacagcgccgccggccgtggggagcggacgcagtgatttgctccccctcgtgcagcaacccccacacccagcaccaggcccccagaactctccttccagctgaactccctgggaacaagtcagttgggctgatcactgaactcacatttctggacctgaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaagccctgatccattctcacctagcggctacaggaagctgtgtctg

SEQ ID NO: 1248 - DNA, 820 bp, Homo sapiens
cccgggcagcctgcggggggcagcgaggcgcaaagaccatgccccaagtgccgagggaaagtcctgagatgcgcgacttgggacgctaggggccaagctccgacgcggggctgggtgcacctggacgcacctcacacgccgcgagctaagcagaaaagggaggcaggctgccccgacaccccactactcaccgctaggtttccgtctggcgccgatccggctgcgtcacgccggccgaacgacaccccgctgagtcgccgccgcagggaaggtaccttcggccccaacgggaaaagccaatttccagtaattcgcgcccgaccaccggggagagatggagtcttgcactgttgcctaggctggagtacagtagtgcattcttggctcactgcaacctccacctcccaggttcaagagattctcctgcctcagcctcccgagtagctgggattacaggcgcctgccaccacgcccagctaattttttgtatttttagtagagacagggtttcaccatgttggccaggctggtctcgaactcctgacctcatgattcacccacctcagcctcccagagtgttgggattacaggcgtgagccaccgtgcccggccaagatgaacattttttaaaaccaatttttcaggtataacataagatttctagccaaaggaaaattttgttgtattaattctaacatttgctgtgatttggtattatgtggtatttcttttgtgctctaaccaaaatcatgctagatttagatgccaataaatgcacaatttgaattgaaaacagtctttttacctcccaaataattta

SEQ ID NO: 1249 - DNA, 4375 bp, Homo sapiens
gtgttgtcccggaagtgccttctctcctcccgggtctgcgcggacgcggcctccttacctcatttgtcctcgcccctccccgtccctctacgcgttttggtccctgtttggtgctttctgtttgcagctacggcagtgagtatgtatgtgacggaccccgagtcacccgcggcctgggacccctgcctaccctccgtctcgccagccgagctgtggaactagcgcgtgccccctcgccgacctcggcgtctccggtccgcccctcacttgtggtggggcgcagctcctggtccctcagctgcgcgccgccccacgcggccgggctgcgggtctagggggtccgcatctccctggctttccaagggctaaggtcgtgattctagggcggctgggcgtccagggcctcggtgggggtggcgtgtctgccctttttatctccccgcaaggcccccagtcttctagggaagccagtcagtgaagcgcggaggtccgggcgcgccgagagagagtccagtctttgaggaccgagtagtcctgggccacctcccgcctctgctgtcagaagcagcagctgccgccgtggaatccaaaatttcgggagctgtgaccctttcctcatgtaaaacgagtagtcttggacgatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcacctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactgtgtgtgtgtgtgtgtgtgtgtgtgtgtgtgtgtgcatacagacacacatatttctgaaatgtaaatattctcttcttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaaccttc

SEQ ID NO: 1250 - DNA, 2201 bp, Homo sapiens
agacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaa

SEQ ID NO: 1251 - DNA, 2131 bp, Homo sapiens
actggcgggactgcgcggcggcgactacagacgtgtcgggggtccggggcctgtcgcggttgccaagcgctcggcgcttggcgctggcgctggccaaggcgtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggtagaaaattatggcatgccgtttagcagaactgaagatgggaagatttatcagcgtgcatttggcggacacagcctcaagtttggaaagggcaggcaggcccatcggtgctgctgtgtggctgatcggaccggccactcaatattgcacaccttatatgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggctacgggcgcacctacttgagctgcacgtctgcccacaccagcaccagcgacggcacggccatgatcaccagggcaggccttccttgccaggacctcgagtttgttcagttccaccccacaggcacatatggtgctggttgtctcattacggaaggatgtcgtggagagggaggcattctcattaacagtcaaggcgaaaggtttatggagcgatacgcccccatcgcgaaggacctggcgtctagagatgtggtgtctcggtggatgactctggagatccgcgaaggaagaggctgtggccctgagaaagatcacgtctacctgcagctgcaccacctacctccagagcagctggccatgcccttgcccggcatttcagagacagccatgatcttcgctggtgtggacgtcacgaaggagccgatccctgtcctccccaccgtgcattataacatggacggcattcccaccagctacgaggggcaggtcctgaggcacgggaatggccaggatcagattgtgcccagcctgtacgcctgtggggaggccgcctgtgcctctgcacatggtgtcaaccgcctcggggcaaactcgctgttggacctggttgtctggtcaggcatgtgccctgagcatcgcagagtcgtgcaggcctggagataaagtccctccaattaaaccaaatgctggggaagaatctgtcacgaatcttgacaaattgagatttgctgatggaagaagcataagaacatcggaactgcgactcagcatgcagaagtcaacgcaaaatcatgctgccgtgttccgtgtgggaagcttgttgcaagaaggttgtgggaaaatcagcaagctctatggagacctgaagcatctgaagacgtttgaccggggaatggtctggaacacggacctggtggagaccctggagctgcagaacctgatgctatgtgcgctgcagaccgtcaatggagcagaggcggggaaggagtcacggggcgcgcacgccggggaagactacaaggtgcagattgatgagtatgatcactccaagcccatccaggggcaacagaagaagccctttgaggtgcactggaggaagcacaccctgtcctatgtggacgtcggcactgggaagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggtagaatgtgttcattaccttctgcgcattataccacaaaaaagctgggaataaaaatgctaacc

SEQ ID NO: 1252 - DNA, 2188 bp, Homo sapiens
ttgcatggcactgatggttctttgcatagagtactgtgtgtaatgagcctataggtccttatgactccctgatctagaaactaaattagagacattgtgtttgggggcaaatagatcacttcgatgcctttagtattgaactcatggagttctgggtgggtggccaggggcattgtccagtatcaaaacaactttaaaaggcagtcctttactggcaaggtacttcctgacttcaaagacaaaacagcaatggagccaatccagaaaaagggttcttgtcgtccaggccttcttgttatactgccagaagactggcagctggtgtttatcttttcccttcaagacttgggagttaacagctttatagataagtgcagtcttgatcataaacccaacagcatttgcaaaaacccatagcattagcctgtccctttctgccttaaaccctggtgctcacttctcttctttactaataaatgttctttgtggcatattattatttttccataatagggcacttctgtctgccttaagaacctgttttggtagatatgctttctcctcaatgattttcttaatggcatctgggaactcatttgctgcctcttggtcatcaggagctgcctcttctgttatcttaacatttttaaagccaaacttctttctaatattatcaagccatcctttgctggcattaaattctctagatttagatccttcaccttccttttgctttaaattgtcatataatgaccgccttttctccaatcatattagagcctataggtacgtctttcttgtagcaatactgcacccacataaaagttgcatttttaatacgagataaaaaggtatatcacaaaaagtgtaaggtttgctggtatagatgcagtaatggcttcataaattttcttaattttttttaacagtggtccttatgctggattcatttatcttgaaggatgggcaactacagctgcagaccagtacacatcaagcaatttaactttttcttgtaatgtcatgactttgctccttgggagcacttccagcgtcactagcgggacttcatatgggtcccttggtattattgcaaggtttatggttgtactaaacatgatgaaaaataactgagaaccatgagagatcactttttactacgatacacaatttactggagagatgaactgcccatgtggagatgataaacatcacatggcattttaagtgaatacagcacttgagctcacagcaacagcaacaggaggtagctctgaaattatggtagtagtgcagtatgtactatagttaatcttatccagttgtaatttagtactgcatctttatgtttgtctcaactgcaaatggctccaatgtatagtctgtgtatgcgttaagttttgataaattttaactttttttttttttgagatggagtcttgctctgttgtccaggctggagtgcagtggcaccatgccggctcactgcaacctctgtcttctgggttcaagtgattctcctgcctcagcctcccaagtagttgggattacaggcatgcatccccatgcccagctaatttttgtatttttaggagaaacagggtttcaccatgttggccaggctgctcttgaactcctgacctcaggtgatccgcctgcctcggcctcctgaagtgttgggattacaggcgtgagccactgcgcccggccaattttaacttttcataatagatttgtatatatttatggtagtaaatgataaaatagactagtgtctacatatattatatgaattcatgacacacctttttcttagtttttcagtatttctaagctacatggtgcatctgcaagttttttaaattgttgcaaatttccaaaaaaattttcaatatatttatcaaaatatgcatataagcggtcctatgcagttcaaacccgtgtttgagaatcaactttatgacttccagtgtcattctccaccatttctgcagtttatcacattttgcttcaggcagatttggtaaatcttcaatgatagttctctaggccattgttttgtaacatgatcaaatgcttaatgggaaatagaatatgtatatgtattctttgtctaccaactaccaaagaaacaaatactcctcagtttgacttgacttagtaaataaacttgtgttgggttaatgga

SEQ ID NO: 1253 - DNA, 502 bp, Homo sapiens
tatgaattgagcagaaggaaacaaagttctgcagataaacaccaatgaaacaaaaaaccacgaataagaaaaatgacagaaaaggagaaccttcccagaatcctcctgccagtgaacggtcaccagagcaagagcatggagtccctgggttttgaactgtgagataaggaagatgatgaaaacctccctagcagccagccaggtactattctagattgtcttgtgatatttacaatctaggagaaggcaggagagagaactaagaacagagagcatgttctgagatgtctgctgtgtttgcagaaactcctggagggcagagccatgcctgccattttcatcattgcattaccaccacccagcacagtgcctggtacaaaagagttgctcaataaataaatcaggatgaatggacaaatacacggataggcactttgaactacagatgagcttaaatactttgtgtttttcttagtcaaacatgtgcaattaagcatgtgat

SEQ ID NO: 1254 - DNA, 3032 bp, Homo sapiens
ctggcctgagctccggactccggggacagcgcgtcctgtcccgagggcctcccgccccccgggaaggccaaggtcatgaggtcaaaccccaacttttgggcttccgcgagagtaaagcccccggatggtcctcggagctgtgacgtcacaaaaagtgcttggggtctggtttcccgcagaatccagcctctgtccacgtgaactctgctctgtcctctgggctcataatgttctgagactcttgctgcctctttcatggattccccttctatttccctgagacgactcacaggtcacagaaagctgcctcccatccttgcggctccatcaaggtgctttggaggcaggtaaagcgcagccaaaaacaatccattgatacacttggtgacattaattgagaaaaaaacaatatggtctggccatggaggcatggtatccgtaacatcccccaaaggagctaaagaagaaatccacaatttaccatgagcatttctcgtctgaagattgccaagcgattcctccaggacattcctcaagatcaatttctgttcatccaccttgtcctgggagggacatcaatgggtttccatgtcctttggcttctggttgagttcactcagtggagaaccctggcaagaggcaggaaaaggggaggaagcagcctgaccggtttgaatttcaccttctgttcaccttggatgagagcagtaatcatcacgatcccagggaacagccaaaggaagagaaaaggcaaaagatttggacaagactcatgaagactaacagctcttggataattgagagaaggcagctgcgtgaacagttttgatgcaatcatgaaggcagggcccagtgcctgtggcatctgcctttttctggaaccaatccatatttccttgtggttttctaaggtgcagagagggcacattgggaactttgcttggggtctttttcacatcttagagggaaggtccctcaacatctgcattggcggagtgtgatcctcatgtccctctgaatgatctggacttgaggtaaccagccccttccaggaagctgtcccatgagtgaagcctcagcagcagcctctgtcagtccctcccccacagaacctttggcttccatttgaccagccttgacatccagtgtccaaacaccgataaaattgattccactaagcgtgggaaagtcctggagcatcgattgtttcctcctctgcacccccgataccctggcattagcactctcccagaatgtaccttgcttgtttgattggaggaggtcaaagccctgatgaagaatgagtggaattccacaggattggagcagtcttgataaatgacagcaggggatggtgtggggaggggaaaggatcagaggaagtgtggataaatgaatggcttaaaaaataatccacctttgcctcccccttttctaccagtctgtctagtgcttcagggtgaaaaaaaaaaaaaaaagcttgcctttctaaacatttggagtttcagaaatgatctatagagcatgtttagtttttcaagttaaaaatattaaaagaaaaaaaatgtttgagggctttactgctttcccgcaaagagctagagccacccaagcaggattgactgtcattggtttgaggtttctgtttgctttgaggctattttttccttagtgctataaactagatcagtccatttttagctgataaccctttccaatttcgctgtgaaatgaggggctggttgggtggtttttttttatgttctttccagcgttgacttttatggtctttgattccaaggtacctcgtcgactctgaagacgagagatgggtaggttctaactccagatgagccactgcaagatggtaccaggatgagatagagagtctctgtactatcttttatatgttctcaaacccagccagggatcagagtgacaatataacatggggaatcatagagatgtttatggtaattctgctatgagtcaactgagatgtcccttatggagataacttcccatactataggcagttggacaaagatgtaaatgccttgtttacaaatgctacccagatctcctaattaggaccacacatgcggagaacccaacagcttttggacttatcggccaatggtcttcttgggaaggtctctcctagtcatgggaattgtctttttattgttcaagcttttgcatagacctggaagaggcatccattgctgttacccctgagtttataatcatgctgcaagtccagtggggaactttggcacaaagcattgaatgagatgggactgcacttatgtagcctgcatttcttgagaataaagatttctgttcatttagtgcagtggttatcatctgggggaaaaccagtgagtagaggccagggatgccactaaaatccctacactgtgcaggaaagctgtcagccctttgtcccacaagagattaactggttccaaaagtcagtagtgctgtggttgagaaaccctgtttaccacctgtaggttccagagagctcggatggtggtggtcattgtgctaagtttcaaattcagtatttaggtttggtttttagcttataggcaacaaattggctgactatggggtgaaaaggaagcacctcctttatcaagattggcttcaaaagatgtctgcctccccttctggtgggtcctgtgtccattcacagtgtgagaaatggaaaggaggtcactaagagacttgcaatggatgtaataactggatgcagaaactctggatctgaagggaatgttcatgactatttcatccctcctgctgccttggagaaccaaacgcaggagccacccaaggtgaaaaccatccatttcttggagaagtgccacggtggggttgcaagtcccaggatcaagttttcgatgtgtctctttttcccgtaaagtggctgaaatctgaagctgaatctgcaagtgtcatggagtcattgaatctcacagtctcaactgataaaagttattaaaggtcgtctggttcagccttct

SEQ ID NO: 1255 - DNA, 803 bp, Homo sapiens
gacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacagtctgtttcatcttcataaaaacgctgctttcagtgcactggatttattttacaacccactaatggattaccctacagtttgaaaaacattgcgttagaccagtttgactgttgtcaagaaccaaaaaaggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgac

SEQ ID NO: 1256 - DNA, 747 bp, Homo sapiens
aaacggaggccttcagccaacagctgggagaagctgagtcccatcagccattcaaaagactgcagccccagccaagagtttgatgtaacctcaggagagaccctgagccagaaccacctagaaaagctgggatacatgaagactgccatcccttgagtcacttgccctgtagctgccactgttggaaaagggcttgcttctgtgtccttgtgcccactttgaaaatccctgggaagtccttggagtcagatgagcaggcctccgccactctgccaaaaagtctgttcagaagtttcacatcactagagaagagagaagaaggacatttgtactgggaggagtcgaccggtcccagtaaggagaaagtagctacagcgtcatgggtgagctgggtcccccaaaaaggaactttaagggaatggactgaatcaagtctgagatgtccccaaagcaagaccaaagaactgaggaagagaagcattcatcagaaaccaaaattcagctacaagtgagcatccagatggaggtattatgaagaggaactgagactgagggcaaaaggtgccagccagaatcctggataggagagcaagaaccaggacctcatttaagagacaacctgcttaaggcagagtaagcacaaatgggcactcaacatcaatgaagtaacagcaaagtcacataataaaagcatggaattaagacaagctgaagattcggatgcaataaaacaaccacccattatta

SEQ ID NO: 1257 - DNA, 899 bp, Homo sapiens
ccacatcaatgtcatacagcttcttcacagcctgtttaatctggtgcttgttggctttaacatccacaatgaacacaagtgtgttgttgtcttctatcttcttcatggcagactcagtggtcagcggaaacttgatgatagcatagtggtcaagcctgggagaggcaaaatggggtcacctggcctgggcccattcttttggagcccagagccaggagagcctaggtgcatcagacaacgaggtaccaatcactttgttcagactttggtcgctttacagtgtcatcatctgcaccctgaaatctaagggcctgaagccccaatcccaggggcagaacgttgtgcattttctttctcttgaagggctcttacaacctcaagtgattaaagaatcatctctgggccaggtgtgctggctcatggctgtattcccagcactttgggaggctgaggcaggctgatcacgagtggcttaagcacaactgtaacacagctttccccatttaaagtcacacttgattctaggtccagcttggtggcgggaggggcaggaagacagtctgtgaactgctttcctatatgaacacaatccactttttctgttaagaaagagtagaagcagcaaaaacccattggtactaactactaccatggctctactcaaatctgtgctccctaaaaagtcagttattaccgatagctcaaatactcaagtgcccaaccttctgcccattcccccccaactgttccttgagcagtatgaaaattcgggaaaatgaatggaaagaagcttctatacaccgcagcaggccataactgccaaatacagataatggaatccccactatcaatcaagaatcaatccacgttctcaccctcaaggattgttcccgatagca

SEQ ID NO: 1258 - DNA, 2400 bp, Homo sapiens
agggcttgccgatcttgttcccctagtaacctctgcgcatggggacaatggagagctaggccaggatgatggccctgtggatggcagtggccacctccttggagcacttaacacccagaccgacgtgaccgttgtagcccgcaatggccacaaacgccttgaacctggttcgctggccggctccggtctgcttctgcaccggcataatcttcaaaacctaggcctcgagagaggccccccaggaaaaaatcaatgatctcagattccgtgatgggcagggagaagagacagatctcctccagggaagtgatcttcatgtgcttgaccaggcagcccagcttgctgacgggcatccactccttatccttggccttgcctccgcgagctccgtggcttcggccccagcctggtccacggcagtgaccccggcctcggatgccactgccgaaacctccacggaagccaccatggttccccatcccagggccccggggcctccgggactccccccgcaacccaatgccggctgcgccggcgtcatccgccatttggtgttttctcggagaagaagctacatgtggaatatattaacgcaacaaattgtgcgtacttgctagacattaggcatgatagcaagtgctagggttacaaagtattgctttttggggaacccatggttgttggggagaaaccagaagatcagtcatcacagtgcggcaagatcagacttgtggtttgttcaggttctgggagccgtcactgcagtgagaatggaccccacaatgtctcataaggggatctgcaaggcagccctaaattccaagcaggacatgtaactcctcaatggacaaatggacactggaccctggttgaaggaacctgttgttcttatggtggagggcagaaacccaagagggctggagccaatccatgaaagaggtttaattgactcagagttccatatggctggggaggccttgcgatcatgcagatggcgaatgaggagcaaaaacacatcttacatggtggcagaactcaggcacgtggccacatctaacagcaagggagtctggaaaacacagttcagctgtgtgaaggatatttataaacatttagcaagatccaaaggaatggaccatagcacagccctgttttctttagacgctgactcctgctgtctgccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcaggttcaagagctgctgggatatagcagttaagagatgaaccctgcagcctgacttcctttgctagaatcctggcactgttacttattccttgtatgtctctagctggaatgagagactggatggcgttgaaatgaaatgctggagccatccatccatgtgcttccagggtggcttcctggctgtgagaacacagtgaccctgtgaggccaacatggactcggttctcctgacataacatggctggaggagctccagctctgggatgttatcttgctgttttacactggtggttcagccagcccatgggaaactgaacttgggctgggagacctggcagcaaatccaaactgaaataagaatcagcacttcgagttcaactgtgaaacaaatgtgggcccaaggcctaaatgcccgaaagacatagggaagggttgaagtggaataaagaaagcttttggtgacactatgggaagggctattgagtatcttctcaggacagtacaaaatgtcagaggcacagcatatttcgaaacctatttttaaagctgctttagattttttaacttgatggatagatatattcattttttaaaaaaagaaatggtgaccctcttaagaggcaaagtacgagcctcaagtgttgtgggatgtatccatcattggttactaagttttccaatggctcagacactcccagaagcgaagactcctgagccaaaggaagatgagagctgaaaggagcatcgagctcatccagtgcaatgcttctcagcttgtgcccactttggattcacttggaaatattttagaaatactgatgcctgggccccattccagaccagttaaatcatactatctgggagagatacccagaaagtggtatgttttaacacctccttagggattctgctgatcaaccaaggttgagaagaatcaaactagactcattttacatatgaagaaatggaaacccagatattgagataaaaaatgttgcccaagtcacgtagctagtgtcaaaacctgactcttaataaatgcccttatgtcacactaa

SEQ ID NO: 1259 - DNA, 311 bp, Homo sapiens
cctgctgccatgatgtgcaattacaggatagaggtgccaggtgaaggtcccactgtggccaaggaaagcctttgtgagacgactacttcagggtgttccccatcagaggagcacacccctgatcttgtattcctcgtcaatccaaggtccatgtgaaatggtcagatggggaattttttcttccacagacatcaggatcttctgagtttcttcatcaaagccagatttgtgcagcctgggaaaatagaaataaagtttttttttttgtttttcatttttacacagtattgcctctctacattctgatgtct

SEQ ID NO: 1260 - DNA, 550 bp, Homo sapiens
actaatcccccacaaccaccccctgctgtggacctcgcggacctcggactcaccaagtgccgagtggcagatgtgctgctgagggtgcgccggggcgcagctgcatgcctcacccagccccgggggccgcagcaacgccagcagccgcagcaacagcacccagcttggcgcgggccgagggctcccaggcatgacactgcagatccgcgactgagcctgtgagctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctg

SEQ ID NO: 1261 - DNA, 470 bp, Homo sapiens
ttgctgctctcttctggagcagtgggatattgggcagttcacttaacctctctgagctccttcctcaagcctttttttcctgactacagcgagcaacagctgtttgagatggtggagcacattcttgctggtgaaaggaagcaaggtcaacagagactcatagaggaaacattcaacaacttgaacagtaagcaagttgcagtttccgtctcagtggactgaggtgatacagcagattttgctgtggaccaagatccagttttcctcataacactcacaggtattaaatgactaatccagatccccagcaccacatcaaggtaggtgacagaagattaacaagttcctaactgttctttaagtgtaatttgttgcaacgttctgaaactgattaatatcccctccccttcttgccctgaaatgaatctggtggtattaaattaaataaaatagttccagtttgtccataa

SEQ ID NO: 1262 - DNA, 623 bp, Homo sapiens
tttgcacttccgtcttccgggcggaggccacccggggcggacgcattgcacgccgggagacaaaatgtctcaagaagccttgagaggcgggattttggaacccgggcgctgacgagcttccgccattggtgtgatcgcggacctagaaacttggtccgtcccatacaggtgtagaagtcggatttggagaatgctgacgggtgtccggtcaaggttaggccccagcctgccgagtgcctgcgattgcaggcacgcgccgccacacctgactggtcttggtggagacggggtttcgctgtgttggccgggccggtctccagcccctgaccgcgagtgatccgccagccttggcctcccgaggtgccaggattgcagacggagtctcgttcactcagtgctcaatggtgcccagactggagtgcagtggcgtgatctcggctcgctacggcctacacctcccagccgcctgccttggcctcccacggtgccgagattgcagcctctgcccggccgccaccccgtctgggaagtgaggagcgtctctgcctggctgcccatcgtctgggatgtgaggagcctctctgcctggctgcccagtctggaaagtgaggagcgtctgcgcc

SEQ ID NO: 1263 - DNA, 459 bp, Homo sapiens
gtaatgagttggccctcagtcatccccgtctagtcttactgagttgcttgttatctgtgctacgagattagaaaggttaataggacccatcctttggaagtaggaaagtggcatagaaggagaagctgagttagagatcactcacccacttgcccatcaactggaactgcaagagatcagagaataaagatatcagttggtccaaggaaaataatgaggaagagagaattggggagacagaattaatgtagactctgagggatcaactcagatctcttgagtttctatttctctttctcaaaatccagtactaacagaactgaacaagctacaggtggttatcaaggaaacttcactgtggtgtgtccaggcttaatgctacctcagggttgcccttcccatccttttcataaaataagctctaataaacagtggaagcacagatacaagttgcttcat

SEQ ID NO: 1264 - DNA, 2339 bp, Homo sapiens
cagaaatgatggtcacaaggggtaggatatcaaggagcagccagtcattcacccaattccaacacacctacatgtcacactgtcacagagtgagagccacagttccagtagttcccctaattgaccaaatctcccttgccaaatcaaaagaaatcattcctagaattctctaatccttctattgatgatgggaactccagacaccaatggctgggggaaaaaaaaagttaactcacaccaagttcctctacttattacagacaaagggccaaatcttggtcttgatctgtgccaatcgacttcaaaagttgtgacgttcttggatcagttctgctagggtgagacccgaatttggatccccaacagttctggagtatttcatcctggcagcctcattaacatcaggctcctgggactgcaaccaactcagggttattcagtccatttgaggttcacacctggaaggtaagtttctttaaaagtcatcgctaaaaagaggttagttgaacaaccactgcttgcagtcaaaattcattttaaaatgtcctagcaataccttttgaagaccacaatatatgaatttaatatttaactttgaaacataagagacaggttatctgatagatttataccagcttacttcggaagcatgtcccaccccatgctagatccagctgcattaaaagtaaaaattaatggcaaactataaattttaagatcatttgcttcacacataaacacagactagctgcatggtggtctcaagagatctcaagtcttgctgacatgcatatagggtacaacttattacaggttcataacatttgcttctcaattcacataaaagagcaaattgctgtggctttgctttttaatttttttttttttttttaagagagagaggagccactcttgcccaggctggagtgcagtggctaactgcagtctctcactcctgggctcaagggatcctccagcctcagcttcctgaatagttgggactacaggcacaagccactgtacacagctgctttgttatcttctacatatataccaaagggataagttaggaacaccagaaactcagtagtaactcactttaaccttgcttctggggctccaattcaagtgatgctcaatttcaaggtacaaggaaaaccatgagaatataaagtcataatgccatttccactcagatgaaaagatttatctatctttagatactcaaaattattcttggcattttagcacttttggtacacatttcctgatgtaggaaatagtaaaatttcagagcctatggcattggctttcaccacctatgcaattttctacacatctgaaaattaccagtttatctaactccttaaatgttcctctcttcaacaacaaaaaacacaaacaaaaattgctggaagaaacaggaagcatccaggtccaaatgacagcataacagactatgaagaaacagggcttaagtgcccatctagaacaagatggtctagattacaataaggaccccatgggacagaacatcaaaacattcaactttcaagtaaatgtcttggaagtaaacatttaaaatttataggacttcctctggcatgtaggtatgatattagaagagtttcctttgacaaaggacaatgacccaagaagtaggtttttttttttttttaaataaaggagagacagtctcactctgttgcccaggctggaatacagtggtgtgatcatagctcactgcagcctcttttaactcctgggctcaagcaatccttccaacctcagcattctgagtagctgggatcacaggtgctccccatcacaccctgctaatttaattttctttgtagagacagggtcttgctatgttgcctaggctggtcttgaactcctgggctcaagtgatcctcccgcctcagcctcccagtgttaggattacaggagtgagccactgcctctgccttcaggtagcaattttattagcaaactataagcctaaagtaatagttaaaattctcactgtgatattcattactaacccctgaacctgtacccttcagcttaccactacagtacttctgtagtagagcgagtatgggttttggtatcagacaggtccaaatttgaattctggttctacctttcatttatcaaatgactttgggcaaagtacttaacctctctgagctttagttcccttctctgtaaaagaataaaatatttcagtcttatcgtgtagatgatatacagagggcacataacaaatgttagatctctcaaatgtttttctgtaacccaaatatgcttacaactgattaaagaatgttctcact

SEQ ID NO: 1265 - DNA, 474 bp, Homo sapiens
cctcagcgcgaccctggagctgggggtgtttttaagtttggggcgaggccggtgaagccgaggcgcgggcggcaaggagcgctggagagcgacggggctcggcctccgcggctgcccaggggcccggggcattccgagaagagaaaaaaagcttgtacttaaatacttcctgcgaagttttgactgagacgctgcaacaattcccgagctgtttcatcgtggcaccttcctggtggcaggtggattagcacattgtctgcaacccaggaggacttggaggaaagtcccagctctgctgattctagctgagtaaccttggcaaaggtcacctcacttctctctgagtcttattttctcatctgtaaaatgaggaggaggaggaggatcatccaaacatcacgggacttcgttaaatcagtgcttcggggcacttagcacagcgcctggcgcaaggtaagcacttgataaatggga

SEQ ID NO: 1266 - DNA, 594 bp, Homo sapiens
tgtgagtttggattacataggtcaaggatcagtaatctatggctcatggaccaaatccagcctcctgcctgtttttgtaaacaaagttttactggaatgcattcaagctgatgtgtttacatattatctatagatgctttcacactacaccagcgtagctgagaagctgtgacacagatcacactaactgcaaaggcgaaaatattcactctcttagagaaaaactttgctttttgtagtatgtttatttaaaaaattgtagtttcctttggagaaaaagtgctttttctctaggtgagcctaagaggactcagacagggtgtttgattaactataggggcttttgttaaaaggtagaaaactatggatagcactaatctacagcattaatgaaccagcaaaactcagaacatcttcagtatcaacataccttagatacggagtctttcctgacttcttgtacagcttcagagtgtgaggctgacccaaactgagatttcggtgtcaaatacctaaaagaaaagtttaccaaagtttcaatgctttcaaagacagatggtatgtacccaacataataaagctatttataccgaa

SEQ ID NO: 1267 - DNA, 905 bp, Homo sapiens
gctctttcagaaccactggcctgtgaggcctcccctagactgcaaggcccttcaggacaagattgtgccttaatcatgttggcatcctagcatggcctggcttgtcacaagaactcgctgcaagctaatagcctgtcaggagtatggaaatatatatctgaggtttgtgattctgcatgggatcaggatttccaggagtgcctgttggagaacactctgctctgtgcttctcatgtcttaatgttggttcttaatgttaattcaaaccagctgtggcagacccagttgttcctagaagttgctatctctgtctttcacattctgcaattttatatgcacatacattctatgaaacttcatgaaatttctatgatatttgtgtttcggagaatgctccttataactctgatttcatgcaaaaagttactgccacataaatggggaggtgatatcaattatgcagtactggattcaaacatcaactctgttacttactagttgggtgagcctggaaaaatctcttaacttttatgtccttcgctttcttgatctgcaaaatgaagatgcaaatgatcttggtttggagtcttctagtggtctacagtatatggatgcaacacttttagggtctgctccagttacagtaccaggttataaggattgtaccatcttgttttaaaaatgatatgaagttaaactctgaagcacttagaacaggtctagcacataataaacttttcgtatgtattagttactacgattaccataaaaatctcaagaaaatattaattctctgcttcggatattggacagaactctaattaaatctgatatatgcctaccgtgggaagctcactttttttctgcattgctagagcaataaatacaatcaaatgttaaaaaaa

SEQ ID NO: 1268 - DNA, 1436 bp, Homo sapiens
agaaaatactttgtgtaaatttgccatatttacactccttctattaaagcatgtttacttgcaccgtgattttatcttttaagtgaaatatttcggagaacagtatagtaaaagtctatgtaccctccctcctagcataaaaattataaagttcaattcattttttcctagtcttccctaacccagagggcaatttagaccctatgttaacagtaacaaatagtatttttttaaaaaaaatctgtcccaaaggctagacaacccacaagggtttccctaattattttggggaattgcgtgagggttgctttcaaacacaaggaatttgcacaaccacatggagtacatggttctctctggctctggctctgtctcccagcagaaatatctgctgccggtagctatggaaggcacctaagggctgctactgccacaggtgccgcctgcagctgacgctcactattgaagctatacttctttgggttgttggagtggtgacagtgctcttattctctctggaggtagaaaaatccttctcctcttgttgagatacagggatcccaaattagtgtgactggtgatcacaacatctcatcaatatttggtgaaacaggcctcacagctgttcatcagacaagtgaattaactgaccgattgttgtacttagaacctttgtccctctccaggactcaagcattatctgagtcccaagctcacttttcccagagaatgggcttcttgaaggggctgctttgtttctcagtacacatacaccattggccaacttgcctgtcaatcctacaggccactctagattctagagcaaacacactttaagtcccagcttggcttactcttctaagggaagaactcatgtccatcagatttatttgatgttattttctgaacaataaaagtgttcaaatagattataggaacattgcctaggataatatggtatagctgtggtttgtgatttatggtatatccatatgatcaggtacaatgtacaattttcaaatgatgattatgaaaattatgtagcaagatagtaacatggtcattacatacttttaagtagaaaaatcaggattcaaaattatgtgtgtattatgattaaaactagtattacttgtgattacaactattattacttatgattttacttacaaaggagtaattagagaacatagccatgttagggtgaggatcataagttatatcataatgaaagaatttatttttcagaatgtttattacacaaagtaataaaatatttactatgtgctaaaaattgttaccaaatattaagtattgcataatctttctgttttgtaaaacactgtccaagcaccagtattaaaggatcttttatctgtctgattactgcaagaacctggaatcaataaaatatggtattttttcttcatctcaaa

SEQ ID NO: 1269 - DNA, 4116 bp, Homo sapiens
caggaatggaaacgaaagtggaactcggcctttccctctttctctcctgcagacgatgggccctactccaaaggaggcaaggacgcaggaggggccgacgtttccctggcgtgccgcagacagagcattccagaggagttccgagggatcactgtggtggagctgatcaagaaagaaggcagcacgctgggcctgactatctcaggtggcaccgacaaggatggaaagcccagggtctccaacctgagacctgggggacttgcagccaggagtgatctgctgaacattggtgactatattcggtctgtgaacgggatccacctgaccaggctccgccacgatgagatcatcaccctgctcaagaatgtgggcgagcgcgtggtgctggaggtggagtatgagctgcccccgcccggtgggtgcccttggacggggaactttctccactgcctcggttgcgggtggacacggctacctccccaccagggcctgggtggcagggatcatgccagatggagtgggtagaacctggagactggccacaagcatccatacctcgcctaggggctgtgcctacaaccgcagtatgctgtcaccaggaggtggtgggactctatagccaatgtcattttacatatttagtctccagatgcttttcctttagcggggagggttttggaagcattagctgaataagtcgttccctgacctaccacgcccacactccactgccctgcactaagtaacggtggtgtagggtttcacctagcttgggattttcaaagctggtctaaagtcttgaagtttgagtaactgtctggaattcagccctggcctgagcctaccagccatggactcaagcctgagttctgccgtcgtctctgtgagcatgggcaggccctttcctctctctcagtggtgggctaagtgggattaggggagaggatccctctaagcctcacttgttcgacctgtaaaatgggcaagggtttaccctccctgtaatctctgtgactgatcacccagtcctcctggaatgagctttgggcacatctaccggcctggagatgcgactgagggactcaaaggagtcctccatttctccccagctcctgagaataaccccaggatcatttcaaagacagtggacgtctccctctacaaggagggcaatagctttggctttgtccttagaggtcagtgaaagaattgcccttggtattggggcagcaagaaagaggctaatactaattccatgtgtgtgctgtttggatttgaatgtaatttatgtgtatctcagttctgactttgaagaacacaggaccgttaaggtaagtattcagtgggaaaatctgccaagcaatgaagtaggcttggttggggagagtgagaggagaaagttgtaccggaaaatgatggtgaaagctgctaccgagactgagaacaaagtctggagcttcctagagatcagggaaaaggggaaataaggtgaggtcacagaagggaggcaagccatttaacagagagaagactttggtcatgttacccaccccttgcaccatctcttgggagggcgaatttattgttggtgtctcataagagggtccatggatagcaaggacaaggtcctcaaacaggttttattgaaggagcctgctcaggggctgtgtgggagcctctggatgggaaggggtgggtggatgattcctgcttcttgtcaaatcctgtccaggaggtgcccatgaagatgggcacaagtcccgcccgcttgtcctgacctacgtgcggcccggtggccctgccgacaggtgagccgaggcagaagaaatccacacactgcactgacctgccccaactcccctgcgaagaaggtggagtggggtcaccatgccccttccccagatgaagagatcgaggccctgagggaacactccctgcccggtgtcattcagggagttgttgatggaaccgggatgtaaccccaaatgagggaaacctcgagccctttcttccccaacatactgctgtctcaggggttggggtgtttggagaggggcagccttggtgtcgttcttccctttcctgctccttggttttcccgtctgtggaatggtccctaagagttgctatgagagatttgggggcacgctgattggccactgctgtagccgtctgtgactcagtctcctgggtcctggctgatcgacccagctcggccccgcctgggcccagcccagaagggccaggaggagagaatgtggggaaagaacatgtccagttcccagcccctgatccctcggcctccccagtgggagattcctggccattttaagagaagcctggaacggccttgtcagaaatctaaatctgtccttgggacagggccctgtgatgagctattcatagaacccccgagaatagctttggccacctgttgggagaggcgttccaggctggggatgcgacccaaaccgaggtgaaccctgctggggcccctcccctggcccctgttgagttctttcccaggcgcgggttgtcatcaggccagaatcaccgctgagaaaccagggtgagggtggagcaatgggaagggaccaggacggctcagagcagcccccaatgccgtgtggcatgggcacagcttgcaccctctctgggccctggtgctgtcctttgtccctgaggcaggagttgggggtgacgcttgaagagcacccccagctcagacatttcagggttctgcactgagtctgtgaattactgcacacccagaggagtggcaggcggcagagccaccccatcctgtcttcatcccccccttgctttatgcagctccccactcctggagtggctcattccttcactcactcatgcgccccttcacccgtcccctcctccccttcctcccccacccattccctgcttcttcatcctccatgtcccgcttcccagcgccctcccagacaggctgtgcccagtgctgctgccgggccaggctggtgactggcccttccctacagggagggctccctgaaggtgggcgacaggctgctcagtgtcgatggaatcccgctgcacggggccagccatgccaccgccctggccaccctgcggcagtgcagccacgaggcactctttcaggtggagtatgatgtggccacccctggtgagttgggggcctgagtgtgtgggttggggcaggaggaggcctgggatggggggaggtggcagtggccatggatctttaccactgcaaaggctgcatgaccttatgaccttgggccagtcacagcttctctgggcagtaaatagtatgtgctaggcattgtttgatgtgctggggatccagcctagaacaacagaattgaggtgtctgttctcatggagctggcattctggtggagagaggacagtatccagaatagataagatatggtgtatgtcagttggcaataagtgctatggaaaaaagaaaagaggcaggggagagagatgggacaggctgggggatgctctctcactaggggagtgagggaatgagcgaggcatggaatgtccagggacagcattccaggagggcggaagagtaagtgcaaaggccctgaggcaggagcatggccagcatggttggtcacagtgaggaggctgccgtggttggcacaggtgagtgaaaggaggtaagggcagagcagggtgaggtggaagccgggaggccataggaagcggcagcagctgtccaagcgagagctaagggactgaaccaggctggtggctaaggaggggagaaggcacgggattcaggaaatatgatgacggtccagctggcctgatctgctgagatttagacatgggtgggcgagggcaggagctaagggtgcggccaaagttttaatttccagccactgggtgtgttaatggaggtgccatttcctgagatggggatgggttgtagtgaactttacagtttagtgctggtataccacaggctcttcataaactcaagcaaattcatttcacccagcaaagccctgggatcacagcccctcagacctgagctcctgcccctcctccactgctatcttatctgtcaaattgatataacatttggtagaagat

SEQ ID NO: 1270 - DNA, 3360 bp, Homo sapiens
tgatactgaagagtagggcattgctataaagatacctgaaaatgtgaaatcagctttggaactgggtaacaggcagaggtttgaacaatttggtgggctcagaagaagacaggaagatgagggaaaatttggaaattctcagagacttgttaaactgttatgaccaaaatgctgttaatgatatggacaatgaggtccagggtaatgagatctcagatgaaagtgaggaacttattgggaactggagcaaaggttacttttgttatgtgttagcaaagaacctggtggcattgtacccctgccctaggaatctatggaactttgaacttgagagtgatgatttggggtatctggcagaagaaatttctaagcaccaatgtgttgaagatgtggcctggctgcttctaacaacctatgctaataatgtatgagcaaagaaaggacataaaactagaacttacgtttaaaggggaagcaaaacataaacgtttgaaaaatttgcaaactagtcatgtggtagagaagaaaagcccattttccggggagcagttcagactggctgcagaaatttgtatagctaaaaggaaggcacatgctgatagccatgacaatgggggaaatgcctccaaggcatttcagagatctttgtggcagcccctcccatcacaggcctggaggcctgggaggacagaatggttttgtgggcctcacttagagcctgactaccctgtgcaggcttgggacactgctccctgcatcccagccattctcgctccagctgtggctcaaaggggcccaggtacagcttgggccactgcttcagaaggtgcaaaccataagccttggtggtttccacatgctgttaagcctgtgggtatgcagagtgcaagagttgaggcttgggaacctccacctggatttcagaggatgtgtggaaaagcctggatgtccagacagtagcctgctgaaggggcagagccctcatggagaacccctaccagggcattgcagaggggaaacgtgggactgtagctcccacacagagtctccactggagtgttgcctagtgaagctgtgagaagagggccaccttcctcaagactctggaatggtagatacactaacagcttgcacctgttgcctggaagagctacaagcactcaacatcagcctttgagagcagctctgggagctgaaccctgcaaagctgtaggggtggaactgcccaagatcttgggagcccatccgttgaatcagtgtgccctggatgtgagacatggagtcaaaggagattgttttggatctttaagatttcaggactgccctactgagtttcagacttgcatggggcctctagcccaattgttttggccaatttctcccttttggaatgggagtatttacccaatgcctatacctccattgtatcttggaagtaactaacttgttttttattttataggctcatagatggaaggggctagctttgtctcagatgagactttggactttagactttcgagttaacgttggaatgagttaagactttggggggctgttgggaaggcatgattggattttgcagtgtgagaaggacatgagatttgggaggggccaagagtggaatgataggattcggatctgtgtccccacccaaatcttatgtcaaaatgtagcactaatgtgggaggtggggcatgggaggtgattggatcatggaggcagtttttcataaatgatttagcactgtccccatgcagtggttctcatgatagtgagtgagttctcatgagatggggttgttttaaagtgtgtagcacctcccccctttctctcttcctcctgctccagccatgagaagatgcctgctctgactttgccttccactgtgaataaaagcttcctgaggcctcctcagaagcagatgctgccatgcttcctgtacagcctgtggaactgtgagccaattaaacttttctttataaattatccagtctctagccaggtgtggtggtgtgtgcctgtagtcccagctacttgggaggctgaggcaggaggattgcttgagctcaggagttcgaggctgcagtgagttataattgcaccactgtacttcagccagggcaacagagcaagaccctgtctcaaaaataaataaataaataataaattacccaatcacaggtatttctttgtagcagtgagagaatggactaatacaccctccataccacaccctactacttcacctccctttccaactactgtagaagatactcactgttatcatttactatcttataagtgcaaaaactaaagtttaaagaggttaagtaattggctcaaggtatcacagctggtaaacagaggcactgagatttgttctcttttggtttgaccctagaaccctctcctaacattttttttttattttgactcttgtttggcagaataagtagcaaggacaccatcatctttgctgaggaaagatgactattattagtagtaggcaagtggagagtcgtcagtgttccatcagcttttcccctgtgtctctcatcccatgaatgaagagcagatgtgaaaattgctgccagccactcacttgtcagatgagaactgacttggctgtgctcattacaaaattaatttttaggcttattacaaaattaataaggcatgtgaaatatagatgtcctcaagatttataaactttaatttagaagtgtctttgattctaatacaaatctatttttacttacagtaagatagcaaagaaaaaagtctctggaaagattctggatatgtctaaggaaaatttgattagatgggccagtgtttcagtaacacacacaagaagcttctgaataacttgtaaaagtgagatgatgtgccccactttgatttaaattccattacatgtatcctcaggaattagcaaaaaaatttttttttcataataaaactcattagatgattttgacttataaagaataacttgtttgagaataaaatttgtctggacacaagtattggttctgtaaaatgaaaggaaatatctaaacttctgtgcaactctccgttaaagataatcctaaggctacttcagatatatttttgttattcaggatatggaatgagcatgaacgtttgcattttaatggtcaaaagaaccattaaggagagaagctcccaaaatataataagacatgactagtttcaactctatgttgcctctgtatgtttggaattccttgtaattccatatgtatttggatgatgtttacctttgctgtatctttgatgaaatgatgtgttaaactaacttcctgcagtaaataaaggaggaaattgtaaagc

SEQ ID NO: 1271 - DNA, 2047 bp, Homo sapiens
ccctttgccgagtctttgtctggccccagccccgcggggccccgggtccctgtgccctcgggggtccctagaaggcgacaatggctcgagtccaggcgccgaggctggcgagcgcctgcttggcgcacagctgcccgttgagcggcggcggctgctccgaggagtccggctgtcggctcaccagccccgagaagccggagccaaagatggagatcaagtttgagatgttggacgcgtccggggacgagtccgggcagaagtcctcgaagcgggcgcgcttgcagggggcgaacggggcgcccccggggggctcggcccccagcccgcccgcatcctcctcgtcgtcttcctcctcctcctggccagggagccggctcaggtgtctctccctccaggaagtggggcttgtgccctttggatacctgcactccccatcaccgcactccccatcgtggcacttcccttgttgcagttttatggagtgtgcgtctggctctccaactagacttgaaccgcttgagtgcataactcgggacttgaccatttgcgtctccctacggccagctcagcctccgcacacagggacctgcagagagtggatgtagccactgccccagcgtccctgggctctgaagagaagccattgcccttcaagagccaccctcatttcctgggcactggttggaaaaaacgaagaaaaagagacacccagctcacctccaagtttgcctgcaggtgaatatcttgttgaaagagaggggactccctgagtcttgctgggttgaggaagctgattggatttccggactcagaggagggctgcagagagggaggaatgggggggatgggcagctggctttctggatgggtgcaggacaatgacattgatggggaagcttggggtggctctgccgttgcccactgcttggctggtgaacttgctacatcttggccagcactatcctcttctggcctgcaccctgccagacacaggcagtaccccaaataccctgtccctgtgccccgaagtctccatgaccttcagatcccaagggacaagtggctccacgaggcagggcctgtccctctggctcacactatggagtccacagaacctagcccggagcctagtgcacagtaggtgctcaatgtattctatttgaatgttgcatgagtgaataaatgcaggaatgtcaggctggaaaacaggtatttgtacacctgttttcatagcagtgttattcacagtagtcaaagggtggaagcatcccacgtgtctgctgatgggtgaacgagtaaacagaatgtgccccagccatacaatggaatgcgattcagccttttttttttgagacggagtctggctctgtcacccaggctggagtgcagtggcacgacctcagcttgctgcaacctctgtctcccgggttcaagtgattctcctgcttcagcctcctgagtagctgggattacaggcatgtaccaccacacctggctaatttttatatttttagcagagacagggtttcaccatgttggccaggggctggtgtcgaactcctgacctcaagtgatcctccctcttcggcctctcaaagtgctgggattacaggcgtgagccacggcgcccggccacgattcacccttaaaaaaggaaggacattctgacacatgctacgacttgggtgaaccttgagtacctgagtgaaataagcccatcaaaaaaggacaaatattagccaggtgctgtggctaatgcctgtaatctcagcactttgggaggccaaggacggaggattgcttgaggattgctcaataccagcctgggccacaaagcaagaccacccatgtgaggtgtttagagtagtcaaattcatagagacagtaggatggggagtgccaggagctggggagaagggggaatggggagttagagtttaatggggacagattttcagttttacaagatgaaaaatgttctggagatgatggtggtgatagaggcacaatgtggatatgcttcatgccactgaactggacctaacca

SEQ ID NO: 1272 - DNA, 692 bp, Homo sapiens
cagaaaccgcgagccgtttcctttctcttcggaaatggcagttttgttgtcctggatgaaggcgagcgccgctgcctccctgaatgctgagcacgctggcttcgcggtgcccggaaggaagcctttgaagaccctgactccagtgtctccagctgagaggctgagcttgccagctccatttctgactgctcatggagcagaatcagtgaccaaggagaaaagggctgagtgaagaaacaagtgtgagtgccaagatgatgccaagggctgtgatttcctggtgggaagaaagaaggaatagaagccaaaggaagggggatgaaaagcaaaaccaagaatcacaaggaatcaagttcggagagaattttggcagagattttgagaggggggctttaagtcagccatggacatactgaagcaagaggaatgaagggaaaaaagaaaaggggggaaaaaaagaagaagaatggggccaaggaggatttaagactaccattataggttacaagttgaattctttttaatattcttcaagcaatgacagtaaagattcaaataacttttaaattacctttgatttctaaaccaagtttcttggaatgtgaaagtcgccaagactgggccctgcagggcctgggttgggctactactgcctatggagattctgagggtattaaccttaataatggcat

SEQ ID NO: 1273 - DNA, 2852 bp, Homo sapiens
acgccccgcgccccgggccgtgcagccagcccttaccttgcagcgcccggctgtctcccgatcgctaaagctacttatcccgggaaagctcgcgcgggacccgggaacgaacccacagacaaaaagtgaaacttcggcagggctggagcggctgctggttggtgcctttccccctccttcctccccaccgtccccaccccctccccttggtctcccgtgcggtgccctgagcgctggaggctgacgtcaggggcctgaattcctgactttgcctgcacgcatttgtccatgtaaggtatgggaaggcgtgtgcccgcgaagccgccgcgcagagctcgcctggcgggggaggggaaacccgcagccggcagtggctttgccaaaaggtgggcgcactgagggcattgcatttcctgggaggaagaggaggagacgcgggaatgcagggagcttgcaaaggaggaagagaaagagggagatgtggagactttgcccctgctagaggaagaggaaggagacgtaggaggaagcggccgcgtcagggggctcctggaaaatggaaaagcctgcgtctactattaaggcgtcaaattagggcactgagcttgagtggaagagatccagccatgaaatccccttccaagattttcctcgtgagccccgccctggattcccagcaagactcaaaacttacaaggtgtcagagctggcaaagaccaacttccaacccgtccgcttggcacgtgaggaaactgaagctctcggaagagaaatgacttgtacagggtcgtcactcagcagatcgaggagcgggcccaggcgctctgcctcccacttgggttcccgcctccaggaagggccctggctcccttttagccctgagccttgaagcaggttagatgcccgcgagctgtgcggaccacccagtgatttctactgctcttggcccagagccagttcctggaaggtcctggttgacagcgagccctgaatatcaatgacaatcagttgcttcagggcaacttcctctgtcctgtgctcaaataaatgaatccctggagtttaacgtttacttctgagccccgcccagaaagcttgctctgtgcttatagcttcaaaaaagtctgcgaacgagatgaactggtttgaatacagacaagcctgtcattggaagttttgagttggatttttctttcccctctgacatctgtaagggtgaacgacgatgagaaccaccacttaactgtgttaggggattatgacgcgcagcagccatggccaggaaagcattccataccctgagacttcctttccttgcacttctctcctattaatatctaaagtaatccctcacgttagcacataatgaaagcagtctctcacccggctattgcatcttcaggtgagttagataggacagagcgtagtcccccctttacacctcagacaaaaacttaagaaacgttactcgcccaacacaaaacaactgactgaccaagcacctgtcttcccctcctcccatccaggtctcctgactaatcccttcatctttccatacctggccctgacctctagcaggacctaattccattcataactgttgagagtacaccatgagctactgattcataaaaactccaaaaagtggttcttctgaggatggactttagtgggattcttttgaccaggaattaaggaaataatgtaaaaacacatgttattggatttattaagcaccttccttgtgcttaataagtgtttgaattcagacatttcaggggtaagactacttaacctctgtgttcctctcaactatctaatgtacacatacaaaaatatgaacatggctgggcgcggtggcttacacctgtaattccagcactttgggacgccgaggcgggcaaatcacctgaggtcaggagctcgagccagcctggccaacatggcaaaaccccatctctaccaaaaatacaaaaaactagctgggcgtggcggcgagcgcctgtaatcccaggtattccggaagctgaggcaggagaattgcctgaacccgggaggcaaaggttttagtgagccgagattgcgccactgcactccagcctgggggacagagcaagactgttgtcaaaaaaaaaaaatatatatatatacaaacacatatatatacacatatatatacatatatacacatatatatacatatatatacacatatatatacatatatatatacacacacacatatatatatacacacatacatatatatatatgaaggcagtaacagagagataaggtcgagaataaccacccattccacagactaataaagaatttatctctttgcaactaacatagtttgaaatgggagatacgggctcttggagagagttttttctggggttctgaaaaggtcagatcctatcaaaacacaatccactcactcaaacatttcagcgtactcacattctgagtactactgtttagtatgaaaagaattccagtgttacatgaagtaaaaatggattatctcaatcctcatggaatataacgggacttgaccagcatttcctttttttttttccttcagtaactcacttataaggaataatagggtcctaatgaggattaagatttaataaggtgtaattagagttgttcatttcttccatcatatacattataagagtactgtgccggatccagaaatgctactaattatgttgaaactgttgtatgggtgtgttggggaagtcactgtgtttctcctcctgaaatgtttatgaattgctcaggtgagcatggtgagcatggtgttagcatgaacatcatataaagttaactacaaaaga

SEQ ID NO: 1274 - DNA, 2051 bp, Homo sapiens
ctataaagagcaagagagtgtcctttcaacctcaagcccttctcatgaatgagtgttaatctcattcatgagagaagggtggagacttcataattaaatcacctcccaaaggtcacaccttttaatgctgttgaattggggattaagtttcaacaaaaatgttgaagggaacatcatcattcaaaccattgaaatcctccatcccagagtgatatatcttgaaaattcacttcatttgagagtcatttgtttcttgataactgttttccagttgctacatacttcattaaattgatgcaaaggaaaatctgttcattgcgctcaaaattttagagaaagacatgagaaatgatgaagaagtggatgattgacagagagttcagctgagtttcagtttggtgagaggatgtctaatatagagggcactccaggagtgggcctagcagccttagctggatgagggggtcccatggaagaggattgcctaacacatgattctgaacttcatccttacagacccgcgaatgtgtttctcaacgacctggggaccatatccgaaatgtcatcatcaatggagatggcacctacctacctctcagtttctgtgggagggtagcagcctaactttggaaggtcttcgtggacaatatgtccatgcagctgtgtcatctcctataataacaccacctcctgctggaatacctcctgaagaacctgcttgaggctgtttaaaatggttaactttttttatttttaatatatatgtagaagcagactctaaaataatgacaaaagtatggtgtagtaaatgcataaaccagaaacatggtcatttattatcagtattaagtattatgtactgtataaaattgtactgctatacttttatactactactaacacagtaggtttgtttacaccagcatcaccacaaacacataagtaatgcattgggctaggacattaagatagcttgtcacctattctatcaatatgtgataaaaatttttcagttccattttaatcttatggaaccactgctgtctatgcggcctgtcgttgacccaaatgtcattatgtagtgcataactgtactaatactaagaaaaactgagtgtttgtattttagagttaagcactgatacgtttacaaataaaataatatctgacgtttgtttcaaaggaatctggataagaggatatggtaagaacatatatgaagtaagattgaccatgggttaataatgtttgaagctaagtggtaaataatctttgtcccaacctttgtgcatagtggttctcaaagatgatccctgcactggcagcaacaggatcatttgagatcttgtttgaaaagcaaactctgaggaaaccacatattttgtaaccaaaactctgcacatgaggcccattagcctgtggtttcacaagccctttaggtaattttgatccaagctaatgtttctgaatcactgctccagtataaataacatagaatattgcatgtatttgtagagacatgacatttgtatatttttaagttatccataatacaacgaaaaataatgaaaacacccaggacaaatgtttcactggaaaaatttgaataaagtttgcagacataattctaatcttaaacacttccaaaagacagaaaaggatctattccccaacccagtctgagagtagaaaatcttagccctggaagtgaacaaagagtatgaaagaactattaaagccagtctcacttatgaacaaaagatccagtaatcttaagaagttaagtaaatctagcattatgtaaaaataataaaaatacatcagaacgaagttgtatttatcctagaaaatgaaagttgatttaacattagaaacactttaaaaagcagggaggattaaaggagtttgtttattcttaatatattctgtttgtttatttcagtgtttttatatgagtatccttaaatttttaaactgtgttaagatgcatgcttatacttgttttacttttctgactggaagataaacctaaataaaggttgtgaaaaaga

SEQ ID NO: 1275 - DNA, 3152 bp, Homo sapiens
agaactggtgagtccctgtagcaggtgacaccaagaaccaatgagccatatttgctcttcacacctcaacaaagatgctgcttccaggagatctgcaagaactctgaactcatagattatgtccaaactgagaagcactggacagtcattttgcttatctgcggtttctcatttctgagaagaatctccatatggacattatcacttttgttataatctcgaggatggttaaggtagctttgatcgccactttcatatctcctgtgataatcagcaccaatggaatgtgcagaaatccatccctattcctaaggactcctgatgtcatctcaccaggtgggacggtttgtcctgctcgagtctgcacgcccagctccaacagcttcgcccaagtttggggacaggcttcacccaacacccagaatctgtgcagttatttggcccctcattgaaaagcctctcacggttacagacaaaattaacttggtcatccctgcagcgccggagggatacttctggactctctgtttggggagtgtacgctcaaaccgtttcaagaagagatttaaacctcttcttggagaagactgaggctggcacaaggctaacaaatcaaataactgcaccgaggcaaagctgccgtctctcccgggctgtaccctgcctgcttctcccatccctgccttctggccgatttgtctttaaggttttagcattatccctctgttgacaaatgaatgcttttctggaagatgaggtatttccagaagcaggcagacactggctggagcgccgtaagagctctgcctccctcgattcgttatgtgaacgggagaggcctggaggttttgcgcgagcattacgttcaaggtgatgataaatggagtctggccggggtggtaataagggaatttctagccagatcctgtctagaccacggtttgttatggagggaaagccacaaaagggggctatagtaccccgttcctcagagaaattgtcctcagggagagccaagcacatttccagtccgaaccttcgtccggcccctcactggggccgctgtaaataacattagcctgtctttcagcaagctctgggaagcttataaaccgaacacggtttttgttgtctgtagttgtgcattaagctcagtactgtcaagtctaattattctcattaaggcctgaaagttttagggattaattaagcagagagccaaagcttatgcagaacagcaatattttccccctgaaggattagcccgtcattctgatggggttttccttgagcgttgcccattactttataagatagcaaagtgtggagctcatataatatggattagaaatcgcctacatttcacatgtgctattcagccatgaaaataagtcctggcccttgtgcctgtaacccggaaggctcactaatgagaaccaggcagtggggctaatgagaaattcaatacgtgccgtctctccttcccgtttcctttcaatttactttctacaggagccaatatgtgtaggaaaagtctgagtggatgctggtattctcctctttacctggtagggatcttagaaattatctgattctagtccttcttgctatagaagtgaaaactgggattcagcaacctgcttaaagggacccagttaatggcaaagctacttgaagagaaggtgacaggaaacttcaggaggtgtagacaatcattaggtacattaggatggtgagggtacttagtcttaggttttggtgtgatggaaaatgccgcagaaatgagaaggtcccacaatgaaaggaggatgctggtgaggacctaatttgcagacgagccccaggaactctggtgccctgcttggcaaaggatttcaaggcttcctggagaaatgggggtagggggagggatcgttaagccctggcaccccagatataaaaaggaaagtcagacgtgggtaatcaccctgtcttcacccagcagctccagttttcagcaaggcagaggggacacttctgccttcagtctcccctacttcacatcaaggcgccgttgcatttgatggctcgggacgcggccttcctgcctcccacactcccaaatccatgccttgtttatctttttagaatggatctctgatgcctgcccaccacgcggctggagtggcgccagcatccccagggcacgtctgtgatgaccgatgaggtccaccacctctaccccagaccctcccatacccaaaggctccctctgcccagtgaagtccccttcgccccagcattcctgcaccaggcacatcccaagggtggccccgtgtcctgcaggtggcaggagagtgcaccctcctcagacaccagtctgatatgtcaccaggagagagcgggcggtcctcagtgtatgctcttttcttgtctctggggagcttgttttggctcctcaagaagaccttggaaaaagcacaggttgtagaggcggcattcgccgggcagaaccatgtcccaagacaactggttagtgaggccaggcgtgacaatcataatcggagcagcaactgtgcaatggcataggcaaagggggccgaaggcgcagcagccaccaccattatagtcagactgggcaccgtttcctaaatgtcacacatccttccagccccttgatctttgcttatgaaaagggtcattccctctacaatcctctagaactctttgtaggtttttgtttgttttccaaacactgtacttgcttctttatctgtctctctatgaaccgtgagtcccagaggacctcgtggtcctcaattatccttgcttctctgtggcctgtgccatggggctgaatgtttgtagcccccagaatccatatgtggaagccctaatccccactgtgctggtattaggaggtggggcctttgggatgtgattagggttagatgagggcatgagggtggggccctcataatgagattagtgaccttatcaagaggatgagacactagatcccttgctccctctctgcctgcaatcaccagtgaaaggccaagtgaggacataatagaagccatcccttcccagaacccagccatgctggcaccctgatctctagcttctcagcctccagaactgtgagaaataaatgtctgttgtctactcca

SEQ ID NO: 1276 - DNA, 739 bp, Homo sapiens
ggaggccccgggcctggtgttccgcacgttctaaaccgcctgtccccgaggaagtcgggcagggtcgggccggactcagcgccgctggcgggagcgccgtccgccccgaggaccctgcgggcccggaagccgagacagggccgcccacgtcagcgcctggcgcgggcccgaacgtaaatggcgctcctccgcgccgcagccgcagccgccccgctcccttcccgctccgccagctgccgccctcccgcgctcgcttctcgccccgcggcctggcccgtgcgcctccgaggctggccaggggcaccgaggccgcgggccccccatcgcccccacccgagccctgatttaccgtccgagagccggcggcacatgggaccccgagaggagaagcgcgcctgccccaaaaccacggcatggagacggaatgatgcagactcctatccgcgagatacctgctgtaatttcgctgtggttcgtgaggacgcgtcctgggctgccctgagaagcctacgtctccccttcgaggcccgggaagacctccaaccccgctgacaatgctgggccctcagccagacctgccctgcgtgccacgttctgttctaagatcgggctgccgagctgtggcctggaggaaacctggcaggtgtcaccagagctttggggagggtgaggccctgtcggggaagcccagtgggagtcatgaaggagggaacacgtgtggagcccttgtagggggagg

SEQ ID NO: 1277 - DNA, 1072 bp, Homo sapiens
gaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtttgcatccaagagaggggaggacaggggcaaaaggatgcagggaggctgctgatttccactgaagagctaatttcctgtgagacattaacagtgatttaagaaaaagattcctgtaactgtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgtgacagagctccttgctgctcaaattttatgccagataaaatattcaccttctcggactccctggcaccaggcatggccatgtaatcctacagcacagctgatgaaagagaagacatcttgctgctatttgacaagcaagaagataaaagctttcctataaagatgatggagcaaaaaaatagaaggggcctagactccctaccttcacacttcctgctataaaagcattgctattataaggttaatctgcagaaacagacttctatgtcatatgcttaaatgcatcaaaattcatacaatatccattaaattggtaaaagtatccattttaaaggattaatctgagggacccacagacacttaacacaatcaaatctcagaaaaaaaatcagttatttcattgtgattttgaggctgatcttttatgatcttttagttatcaaactgttaaatacattttaactttcaaattttatgaataaaggagatgaatcctgttattttctcagtg

SEQ ID NO: 1278 - DNA, 2428 bp, Homo sapiens
caaaagctgattggaagtctattcttccacccttgccagcctgccaggatggtgtcagaaaggccatgtagaaagcagagtttcatccccactgagtggtgagaagattttctcaatggatatcatatgaagagtcagaacttcaccatgtcacccctcaatttggcagtaaagaagtacctgtcccctctcagcagggtagtgtcagaagaagcctactggagagtcaggactttcaccaccactcaattgccacaggccacccccatggtgtcaatagaggatgagtggggagctggaaaccccgcttccacccggcaataatgaggttccctcccctccccgacttgagtgtcaacagatgctgagggggaactgaaagaaaaaaatagattaacccacaattatagttagaaacttctctactcttttctcaacaactgatagagcaactagacagaaaatcagcaaagatataaaagaactcaatgaaagcatcaatcaaaaggatttaattgactttaatagaacatgctacctaataacagcaagatgtacattatttttatacatatccaagatagactatatgctgggccataaaacctcaacaaatttaaaataatcgaagtcatgcaaagtgtattctgcttccacccaccaagtcttacattagcccatttgcacactgctataaagaattacctgagactgggtaatttataaagaaaacaggtttaattgatttacagttccacatggcttggaaggcctcaggaaacttacaatcatggcagaaggcaaagggaaagcaaggcacgttttacatggcagcaggagacaatgaaagggaagagccatgcacttatcaaaaaaccagatcttgtgagaattctgtcatgagaacagcaaggcagaagtccgtccccatgattcaatcacctcccacaaggccactctgccaacacatggggattacaatttgagatgggatgtgggtggggacacagaaccaaactatgtcaagtcttttccataggccttcaccaagtgtccccagaaatactggaagcaaggcaggagagctgcaaatggtccctcatatacacatacacacagagccaggcacaggcattgaatgcctggtagtctgaggatggagaggagaagggaagaaactcttctggcactctgtcttacagtgagtgcaaccagtgggctcctattgttggaagtaggtaaaagagctcaaggagtttccccatattaagtataggtgtgtgggacctgctgagtgaagaatgaaggcaatgcaagagaactgagaaaatgactccagacacacaactccaaagccctcggaaagggaatgcattaaacctacccttaatcatttgaagactctgctgaattaaatcttgctagagtaacaatatggcccaaacctggctcaattcaaaatagtttgactcagtgcccacactagcagtgtgacagaagaagggaaaaacactcctcttggcacaaatattatttatgtaggtctctacatttatcttacacagaatatacagcattccgtcaaaactatacgacatgcaaagaaacaagacccatcatttaaaaaaagaaagagtcaaaagaaccagattcacatatgatccaaatgtcagaataatcagaaaattttttaaaaagaatagtcacaataagacattaaaggatctagcagtgaaagatacagatgagcaaatggaaaatgtcattagtgcaatggaaactgtataaaagatccaagtggaaattctagaactaaaacagataataacaaagtccatcagaattctttccatacacttatcagcagaccagacacagaggaagaaaacaccagtgaacttaaagacatgccaataaaattatccaaactgtaatgcaaagagaaaaaatctgtgaaaaaatacagcatctaaaaatctgaggagcaatatcaaatggtttaacaaaaacataattggagttccaaataaataagagagaaaatggagcaaaaaaattgatgaataatgattgagaattttgctaaattgataaacacatttatctgcagttccaagaagctcattaagccccaagcaggataaatacaaagaaaaccacaccaatatgcatcatagtcaaagtgctaaaagtcaaatataatcttgaaagcagcctgaagaaaaaagtcacactttatactcaagtgaacaacaatcagaatgaagtaagactattcatcagaaacagtggagaacagaagaaaatgaactaacattttcaaattctaatagaaaaaactgtcaacctagatactaaatccagtgaaaatattctttatgaaggaagaaaaaataaagaaattgtcagacgacgaaggctgaaaaaa

SEQ ID NO: 1279 - DNA, 517 bp, Homo sapiens
gccttctcctgtctgccaccacgtgagatgtgcctttcaccttccactatgattgtgaggcctcaccagccatgtggaactagttcaagatttcaacattttaagataatctgaaaaaaattggaatgtgcccccagctgcgctactggtgacttcttcaacagttgagaaactgaactatgtgttcatgaaaatactccatcattaaagtttatgcaatactctctcaacactgtttatcaaaggaaccaatatggaaggaaaaacattgctttgaagggaagatggatggatcccctagtaaactacagcttgaggtgcaatttcctaaagttcaaatgcctgaaaaaggaaacgaaagaaagaaactcaactcttgagacagcttcaatgctagctttgatctcaattatagagttatttatgaaaagtgcatttttacaactaaaaataaattaggatcaaaagcttctagaggctatactatggagtgcttaataaaaagttgagtaaagag

SEQ ID NO: 1280 - DNA, 1628 bp, Homo sapiens
agggcagtgaacctaagccaggagctgcttaggcattaaggcttctatacccagaatcgtgtgctaagctttctctccaagtcagcacaacaaagcaaaccagagcatcgtaccaacaacctgaaaggtcacctgactccttccttctcactcccattctgtacttctgcatacgtgggcaggcaagtgaatggtaagtaagcctgcaaacagcctttctttgtatagggaatgacaggcatttcatcagcaactccaggatggcaggccgttatcctgaaacctatcagaacagctcctgcttggcttccaaaatatcacaattttggaaatgtacaaaggttagttttcacagtccttgaagcctctttccaccctggccatagcccatgtcagcagtaacctatgtctttgttttacatatcatgttgttttactcacctggtgcctccagtgccctatagggtccctgagctgtcctgatactctttcttagatcctgtcaaaacactcacttcaacaaattctgcccttggactctgatgggaggttctgataaagaaaattattgaaaaccgcattatttaaatgtggttatatttcagctggacctggaaataaagacgaaatactgcttcgtgactgtgctttaaggaatttttgcttctaggagatgattgtgagccaggcagaggtgaaggagcaggagcaaatagccaaggcacagttcacagtgctggattttcttgtggatatagctgcattgttgttccttctgccttgtccaactgcttcctggtatccctaccctcaccttttcgttatcttttcatctctctaatcattgagaaaaagagtacaaaaagccagattttgcagttccctattttgtattccaggttgaagagtgctctggctgtagagggtccccacgatctgtcatctagtaactcaccagatacataagatattttgcctgctatgaagccattggagaatcaggtccagctgtgtcctacagatttataccctcactttggatgcactgtgaatcttgaaacaattcattttatacttaaccctttaagtataaagtatatacttcaagtataaagtgtaaggttgcttcatttcatgggcccacccaggatttaaaggtgtattccctgaaagaattggttccttccggtgggttcctggctgacttcaagaatgaagctgcagacacttatggactgggaggaggcccacgagaaaaacaggaagaacaagagaaaggctgaggctctagtggctgctttgcagacttgcagagtccaggatcccccaggaacttccactgattgctacctgttaccagtgttaaagccagggcactttaagaagaattgcccaagccacaagaaaaagccaccttgaccacttttgtggtgaagaccactggagattgcactactgaccaccaagacagagacacaatagcgaatctagaagtggaagtgtgagagatacctgcagctgttaagatgtctgggaatagacacacaaactctctctcccagataagcaacacaaagcagcacagagcaacagagactgaaagtctgcctacctgatcagggaataag

SEQ ID NO: 1281 - DNA, 2465 bp, Homo sapiens
aagtttgcactgggaaactctcccttttaaaaccatcagatctcctgagactttttcgccatcacaagaacagcacaggaaagacttgcccccatgattcaattacctcccaccggctccctcccgcaacaagtgggaattcaagatgaaatttgggtggggacacagccaaaccatatcaaatgttttatgctaactgaaaaaaaaaaaaaaaaaacagattcaaaagtctatatccaatgcgattctatttatgtgacatttgggaaaagtccaaaatttaagaaccaaacacagatcagtggttgcctggtggtggaattagggaaggccttcactaaattcacagggaattttggggggctgatggaactgttctatgtctcaattatagtgatagttatattactgcatacatttgtcaaaactcatagaattgtacactaaaaagtgtgaatttactgcatataaattttgtctaagtgattttgatattaaaatttattacaagataaagctaattatacaagaccaaaatgtttaaaaagcagggtttttaaatatgaccatacaaacgagaaatgtaagggtactaataaagggggcacattttcttactaaatctcgggatatgctatattacataattcttatcgtcactacattttacaaagcaatctcaaacagtatatttttattttcacaatggcacactaatataagctaggatagtttatttaaaatacattctccccttaaatatgacaccaaaagcacaggaaaccaaataaatattagataaactggacttcatcaaaatttaaaacttttgtgcctttagagtaccataaagaaagtgaaagacaacccactgtaggggaaaactatttgcaaaatatacctgataagggacttgtatctaaacacataaagaacttaaaagttcttattattcagtaattttttcaaatccaatttaaaaaatgggcaaagaccttaacagacatttctccaaagaaaatatacaaatgccaataagcacatgaaaagatgttcaacatcattagttattagggaaatgcaaatcaaaaccacaatgaggtaacccttttacacttgcagtatggctataatcaaaaagataatctagcagatgttggtgaggatgtgtagaaattaggagcttcatgcactactggtaggaatgtaaaatggtacaggcaggttggaaaacagtcagcaattcctcaaaaggtcaacataggatttccatatgacccagcaattccattcctggctatataaccaagagaaatagaaacatacgtgcacacaaaaacttgtacatgaatattcaaagtatttaaaattgtcagacagtagaaacaacccaaataacctaaagctacgaactgataaacagataaattaaatgtgttatatccatataacagaatgttacttgccaataaaaagaaataaaatactgataggggctgcaacatgaatgaaccttgaaaatatcttaagtaaaagtcagtcacaaaagaccacatattatatgattccacgtatatgtgatttccagaatagacaaatttattgagacataaaatagaatagtggttgcctagggctgtaagggattgaggggagcagggtcagggtgtggtggctaaagggtatgaagtatcttttagggattatgaaaatggttgtggtgatagttgcacaattctatgaatacaccaaaagccattgaattgcatactttaaaagggtgaattacatctcaataaagttgttaaaaatattctatgtaaggggaaagagttttcagtaaatactaataaaataactgaactgtcaaaatggcatctatacaaatgtgtaaccttaataattttcttgtatctgtggcattaagttaggaaaaataccaaataattaccctttctactgaagacaactgttgctgtaatccatcatactttttgtttgcttcttcgaaaagagttttgtatttttctacttgagactgttgcatattaattgttcgctgctgtctcataaaatcttcttcaaaattttttacttgagactttaaattctgaatttcatcctcctatagttataaagttatagattatgtgaaaaaatatgtaagatttgttatcaaaacaaagcagaaaaaaagacgtttcatatgttctttgatatttatacacgtttcatgaaaaacaaattagtctatttttatcttcaaaaatggaagtcaaatgttttatttgcatttaatagcttacactacatttgtaagactaatatagagaattctaattgtagcaagaatttaagatatttcagctctgtgaaaattcaacatctcagaataaagttcagtacttatatacaatttttgaattcaaaatttaactatgatttatatctaaataaagtaattc

SEQ ID NO: 1282 - DNA, 1741 bp, Homo sapiens
tttccactccagaagacatcagccagtatgcttaggccgtttttagtaattctgttgtacaggaagtgtggtatcagcatttgcttctggtgagggcctcaggaaccttacaatcatggcgaaaggtcttctttctgatccaggagtgaattaacagagtttggcaccttaaagaaacacaatctatttattttaaagcctgctacctggagacttcatctgcattataagatccttggtctgcacgaccccttaccttagcccagatactctcttctactgatttcaggtctttcattaagatctcccaaccaactgccaatcagaaaacctttgaatccacctatgaccaggaaacctcttctttgagttgcatgagggggaactttatgtgttcaaaatgacaataggaaaaaaaagtaaatttttgtcctaaggtaagatgccaatataaaaaggaaatacaggacaaaactggcgccttaagcaaattttagaaaatctgtggaaaactcatcttgtgaaaggaattttgtttgtgatcaagttggctaaaattagaattatttttctaaaaattgagccataggagcactaatgggcatagagactgccaggcccgtacccaccagtgccctgtccccatgacaacattgctgccagtgcaaaactgtgcgggagaccactagacccatccccacccccagcagcagctgccggctgcacagagggtacacagagtttcatgcctaccagcacccacccttgtgctaacaccagccctggagcaaacacatgcacagacactggggggacccctggctggccacactatcctgccaccatcaccactgtgaacacccacacagaagttggcacccctgaacctaccagcacctcactgcagaatgagtgtgcaccctgccatgctacccatactgctggcacatgcaaacaaggatggatcccattgccacttccctacaaagttctgtggctggcaccacccatcagactcttgtgaacactgcttcaggaacaacttggcccttccagcatggcaggttcctaacttccagggaccacagaacaaagccagaggtctgaaatcaacaccccagagttagaacacacagtccaggagttctgagctgagccttggttccctaaaatcctccagaaacaaacccagtcaattgaacccaccttataccacaattaaatctcccagaacataaaatggaattaaagaaaaaaaaacttatctaaaagtcagcaactacaaagattgaaggaatattagcccacaaagatgagaaagaaccagtgcaaaaactctggcaactcaaaaagccatagtgtcttgttacctccaaaggattggactagttcccaaacaggctgagatggccaaaattacagaaatagaattcagattctggacagaaatgaagattattgagatacaggagaaggttgaaatctaatcaaaggaatctaaggattacaataaactgaacaggaacttatagacaaaatggccattagaacaaagaaccaaatttatctggtagagctgtaaaacattctatgagaatttcacaatgcaatcccaagtattaacagcagaaccgaccaagctaaggaaagaatctcagagcttgaagacctctttgaagacctctgaaataactctatcagagtaaaagagaggaaaaacaataaacaagaaggaacaacc

SEQ ID NO: 1283 - DNA, 72 bp, Homo sapiens
actccatgatgaacacaaaatgacaagcatatggctgaactttcaagtgatgtcatcttactactgagaagt

SEQ ID NO: 1284 - DNA, 496 bp, Homo sapiens
gcagagtgaagggccgggaacagtggagggtgcgaggaagacaatgggggaggaccctgaggcggcctctgtgagccgacaggaacacgtggtcgatcagagagagactctatttaaagtcatttccgcagttaattgcttcatgctgatgtagtttctgaaaacttcacaagcacacaaaaatcctagaacatggtgtcttttaggaggttcgtgaacggatggggaggaccctgaaaagcactgtggaatacaggtttctagtaacttcaaaatcacatcatttggactgggtaagaattgctgaaactttaatgaaaagactgactggcttataaaactgctaacccaaatagaataaaaattaattgaataccgaggaaatgcttcaccaggtttgcatacttaatcagcctatactgaaattgtttagatatacaatttgaatgaactccatggtctaagtcaaattacctgtgataacccatcagttatc

SEQ ID NO: 1285 - DNA, 1831 bp, Homo sapiens
acattacaggttttgcaaaagcagaaacttcaacacaggaaaacttttaaagtaaatagactagcgcggcacttacctctctctaatggtgggataaagaccctgccagtttggggccgggataaggttgttgttactgagattctgctggtggtactgctggacgctggtgctgctggagttggctggctttttacgggggaatatatcagcagccatcttcttctttttagtcttcaaggtaattatttcataacaaactggtggcaacttgctgctgttgctactgctgctgctggtatttgctttctttgagcttttcttggacctgttctttaccgtctctggaagcatcaagaagaaggtatggcaactggtgtcagaagtataaggggtttgtgaaaattccacagtaaagaagtggggcaacacctggactacgaggcggatctcctggcttgtcatgttgtttgcttcattcactctaatattcactcacagtaattacctcacacacttacagaatgctcaattgtcatatttctaatctactttaaaagaagagctttcttttaaagtttacaaagatgaaaaccatgaacatatgtagtctgcacccctgtaggggcacactacaggcaagaatgctgaaaggatacttgtggaatgagatggaaggaaggaactgcagtgaggacgctgctcaaaaacagaagaggctctccaggtacttgaaaatagtctatccaaagaaaagtaaaatcaaggctcaggaggtccctttcaaaaaggcctgaatggggctgttccaacaaaggacttcaatcaatcctactgggaatgctggaatggaacaacctcacccaaccattgctgtggctttctccaggtcatttgttggctttaaataacagaagaagaaaataatatgtttcggtcaaagaaaaaggaaagtgtttccaaagatatgttttactttggctagtattagttttttttgtttttttttctgatattcgaaagatagtcaccaagaacatctcctccatcagatcatcaaagtccaaaagcttctctcacatattaaccaaagagtatcttgttctatttgggaaaaacaccttttccaagaacacatgggacgggaagaaagaatccagacaactcccaaatcaccagatattctacatcagtcctgattattagtgaggttccaagtatcacagccaaatttccccaacatccacaactaagttctatacctttagtcactcagtgcttagaaataaacactgctctcctgtccttcaatttactgcctccccgccatcaacaccaaacacctgaattatatcaattatcttagattttaaattgtgctcactgtaaaatgaacaggacaggttgggaaaggcaaggccagaaaaagctttttattttgttgttttgttttgttttgttttgttttgcaaaaccacatagaaaagaccagttacaatttcacattttgacaaacactatacacatatccagaaggtctcaattaattactatttaatgaaatgctatcctttgttttacaatgtatgcgaccagaatgaaatatagttattttgggcaaacaatacaagatctaacattaagaggtctgctatgctgagtgaaatctgagaaatcttgctgtgggaaaacttaaacatacatgaagttacaaagtagcttaacactcaatttctaacataccttctctcgagtagataccaccaaataaaaatgaaaaaaggcacctacatttctaaaataaataacaataatattccctaacaaaaaa

SEQ ID NO: 1286 - DNA, 382 bp, Homo sapiens
ttgagcccagaagtcactggaggagttcaagggtgcccagagtgcaagcaagatccaagaatatccagaactattcctaagccacatcgtgtattattatcaaatggcctgtgaagcagattctcttgctgggacagtttttaagacctctctatactgaattgggacactgcctggaagttgtccaaactctgccttttgaaagaatattgatgactaagaaaacttgccctgaataaactaatgttaggacacaggaaagcaccctcacttcaagtcatgttcattccacaatctcatatttcagatgtcatggttgcaggattggtcgtgttgtgttggagctgagaagaggcagtgcccatcaatcagcagttcctgc

SEQ ID NO: 1287 - DNA, 5079 bp, Homo sapiens
gttcgcttatttaagaaacgacaagatcttaaggccgagggaagtgtctgtctgcctttggggacgggaggaggccgagggtccaggatggggttgggcttgccccacatgcacttgagacccgcacacacgtttaggtgattataacaaaatcaaagcctaaaagtcaactctggtttttttttgttttttttcttttgttttttttatgtttttgagacagggtcttgctctgtcgcccaggctgcagtgcagtggcgaggtcacgactcactgcaacctcggcctcccaggcttaggcaatcctcccacctcagcctgttgggtagctgggacctcaggcatgtgccaccatgcccagctaatttttgtattttgtgtgtctttttgttttttcactgtgagtatacgttagtcatttttcttaacaattgaaactgggaactctggggattcagaattaacagccttggctgtgagcttcttatcgataccagaaaaagtttggaccttgcgttccacgttgttctgctgggctttgtccgaatgaacccttgtgagctgctgtgtccatttcacgcggattctcctgcccacaatttcacctgggaagaccgagtcctcgaggattgcgacgtgcgcagctgtcggagcgtggatcctgggacgcttttgcttattttttgtacaccttttttgagttggtttaggcagaattttcctctaagcaatagacgacatacttaccagtgaactttttctccaattcacgtactagccagacttggatgttctggaattatttcagtggcagaagaagaacaaagattatgataacttccttttttttttttttctttctttctttcttttttttttttttttttgagacagagtgtcgccttgtcgcccaggctggagttcagtggctcagtattggctcactgcaacctctgcctcccaggtgcaaacgattctcctgcctcagactcccaagtagctggcactacagctgtctgccaccacacccagctaattctgttgtattttagtagagacagggtttcaccctgttggccaggctgctctcgaactcctgacctcaagtgatctgcccgccttggcctccctaagtgctgggattacagacgtgagccattgcgcctggcctttttctttttttctttttttgagacggagtcttgctctctcgcccgggctggagtgcagtggtgcgatctcggctcactgcaagctccatctcccgggttctcgccattctcctgcttcagcctcctgagtagttgggactacaggcgcccaccaccacatccggctaattttttgtatttttagtagagactgggtttcattgtgttagccaggatggtctcgatctcctgacctcgttgatccgcccgcctcagcctcccaaagtgctgggattacaggtgttagccaccacagccggccctctttttttttgagatggagtctcgctttgttgcccaggctggagtgcagtggcgcaatcttggctcactgcagcctctgcctcccgggttcaagcgattctcctgcttcggccccctgagtagctgggattacaggcacgtgccaccacacccagctaatttttgtatttttagtagagacggggtttcaccatgttggccacgctggtcttgagctcctgacctcgtgatcttcccgcctcagctccccacagtgctgggattccaggcgtgagctgctgtacctgcccatgataactttctcaccaccaccaacttcagtttccctcgctgctgtaataatcagttccctgagctgggccttgaggtccgagttcatctccagctccagaagaatctaagaaggcaagaacaccagggtcaaccctcagtgcgtgtatgagcacccccagcctcatttttgtgttttctatagagatggggtctcgctgtgttgcccatgctggtcctgaactccttatctcaagtgatcctcctgcctcggcctcctaaagtgctgggattacagccatcagccgccgtgtccggctttaaaaagcaatcctaaaaatcgtaaacaaaatgacacagaggaaccttattgctcatcgagccatgcaagaaaggaaccgtttatttccagcaagtttaaaacatcgatttgacctccagccatggtcgatgagatgttagaaaaccaactctcttgctgacaacaacgagaaaatcttgataccatttagcaaaaagaagtctgtgggggaggcgttggagagtgacggaactgccacggcctgaggcacccggcttccggagcctctggcagcccagagaagtctctgtcttgtcgcccaggctggggtacagtggtgccatctcagctgactgcaacctccgcctccgggttcaagtgattgtcctgcctcagcctcctgagtagctgggattacaggcgcccaccaccatgcctggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcagtgttttaactcaaatgggtgatgaaaaggactcttggaaagtgaaaactttagatgaaattcttcaggaaaagaaacgaaggaaggaacaagaggagaaagcagagataaaacgcttaaaaaatgtaagccatatttttttaagtaagtggttttcttaaaggagatttaatttctttgccctcatttttccattagaacaacgcttcttcggtgaagttcttttgtacttccaaatgtcgcagtctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtggggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaagcctcccacagcttcgcgggcactggccttcctgaacacctctcctggcgtcttaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtgg

SEQ ID NO: 1288 - DNA, 845 bp, Homo sapiens
gtctcagccagcagggttgcccagtgccccttgtcaccccccgagcaacacaagccaggctgcggttactctgggtctgtgcgtctgggatcatagtttttaaatctgccccagggtcctccagtcccagctgtggaaagtcaccctcagagggtgaggcgggcggcgcgcctctgtgtgagtggccccatccttcacagcgagtttgtgtctactgaatcgcagactctgggaggctgaagggttacaggaggtcgtgtgtctcacgtcgccacttcacggttgaggaccccgtgacccgctttgctcagtggctgcgcaagatgagtaatgacctgaaacagggaaaatgtcttggatacatcttgcgtaatgaggagaaaaatgcagccatgttgcagcctgataaaatactctgccagtgtcctgccataaaatgacaggcgaattttcagtagcagattctctaatagttctgtggtcttctaggtgctaaactgtttaagtatctacattttctaagcccgcctaatgcaaatattctcaaaaaacataaacccttcattctttctcaaataggttacattagttatacactctggaggtgacttgacctgtcattgtgaacaattattgctcttggacgacccaggacataggccagccagtacgtaccccagtgtgttggagaatcgcgctcggcttcttcctctgtgctgagtcatgaaagttgccggagcaggtgcagttacacaacctccaggtatgatcctgtttaaggactggatttaggataactacttagaggttaaaagtcacaagggtgtatggatgaggctggagtg

SEQ ID NO: 1289 - DNA, 875 bp, Homo sapiens
ggtggtcatcctggtcacggatgtctctgtggattcagtggatgcagcagctgatgccgccaggtccaacagagtgacagtgttccctgttggaattggagatcgctacgatgcagcccagctacggatcttggccggcccagcaggcgactccaacatggtgaagctccagcaaatcgaagacctccctaccatggtcaccttgggcaattccttcctccacaaactgtgctctcgatttgttaggattcgcatggatgaggatgggaatgagaagaggcccggggacgtctggaccttgccagaccagtgccacaccgtgacttgccagccagatggccagaccttgctgaagagtcatcgggtcaactgtgaccgggggccgaggccttcatgccctaacagccagtcccctgttaaagtggaagacacctgtggctgccgctggacctgcccctattttgttaacctatcgaaaatcaagaatgcaacagctgcatgtgaaagatcaatagaggataaaaagtgttactgtgaacgacttaaaagtaaaatttcaaaaaatgaaaaataatattagcatactacaaaaggtactatctgaaacagacaaaaccaaatcacagagcatcagaatcttgaaaggaaaaaaaaagctctatttatcttacaacaacaagaagaagaaagaataaaggctgaagagttgtatgaaaaagatacagaagagttaaaaataatggaagagcaatataggacacaaactgaagtgaaaaaacaatctaaactgactctcaaatcattggaagtggaattgaagactgtaagaagtaactcaaatcagacttctcatactcatgaaaaagaaagagacc

SEQ ID NO: 1290 - DNA, 2850 bp, Homo sapiens
aggaaaactgaatcaaagtaaaaatctgtaaggctttgtagtttatggggaaaataatcactagatacataaaatatttacttttttttagcctttttttccccccacagaacatatagaggacagggctttgctctgccttctcactttctccccactcacccccaacctccagagtgtgttttccaagtaaaattttaggccatagagaaattcgcaattgataggccaaggtgactgataaaactctagaggtcaggattggtaatagtggagcgaggaccagatggaatttttgtttaatactgtatctgaaattgaggatgggatagataggaaatgacctatcatttcatgaggagatgacttttctgtgataatgggacagagatgagcttagatgaatgaatatatattttagcacttacctttttccataaaacacaaatagacttggtgcaaaattaccagtctcactccatggtatttctgatgagatcggtaaataatagagagagacatacttctttaggagctagctgactttaacatatgctggagtacaattgacttacaactatttggcgttagaaatgatttttctagggcttggtgggggaaaaatactcgtgaaatacctgccttgacttaaacttcaacatattttaaagtcattttattatcccacaactcagaatgtcttcaattaaaggtaagaaaataaggtgatgggctacagtggcttaatcaggtgttcagttaatgaagtagaagaaggatacagattctaataattcacagttgtagaggttctagactgttcttagtatgaagtcctggcagtgtatgtggcagagtgaataatgtttcacgacctggtgagtcatgtgaggactgtgagtaacttttatcttctgtgtgtcccacatagcatataacagtactatgctagtgatttgcttgacagttattgaatgaatgctaagtttcaaatatttatttgatagtcacttgattaccaagtaatcaaataattacttatagtgttttagggagttttcagaagatatttgtgattaaataaatgattatatatgtatattagcatactgtatgcatttgtcagttgggaaagaggggaatatggagaagtggggaactgcattcagtttttattttataggcaactaatatggtcctttggttttattttaaaatgaaactgagccttgagcattttgagctttcatgtcaaatgccttgaatggaagagtaggaatttcatgtaagtagcttacatctgccctgtatgttggagaatgtgattagatatacttgcttttctgcccaaggcactatttttgtatttatattgctttttgcaggtttacttctgttaacaggggtctgtgagaaataaggcttaaaatatcaatacttctcatttttccacagccttccaaggcttccatctttgtgccagtgtgtggctctgggtgccatctaaccgcaaaagcagcagttgggtttggatgagctgtgtgacatttggcctacacgtaggtctactcaccaccctggtcagggaacctggaacaatcctaaaactcacctactctaatgcaggccatattttttaattaaaattgaaattgtcactgagtattggaataagaagggactttggggtggagtgggtgagcagggcattgtcttacagaggaggtgtggggaccggtaagttttaactttcatcctttcaatctctcagtttcagcaaagatcttataaagaattttgttgctttcttaaattcatgaaagaaatgtaagcaattgaggtgtgtaattttcttgcccgtattctctatattaaaaaaaaataagaatatggttctatgaatttcttgtgctatttttgctttccttgaattattaaaatatgttgcatagaactaatattgttttcttttttatttttatacaggaaggagagaaatattgttcatgtaatgtgttacctttttttgtctgtgtgatctacaagagcatggctgaaatgttaccatttttaactagtgttttgactgaagattattatgaaaagttttacttttgttagattcctaattaaaaatgcctatactcttttataggagtttcaacttttgcaatttggtaataacagatttaggtaagtaaaaaatgagaatctcatacagttctgaagatctaagtttggttgagaatttaatgtttcatcaccagtaaattcaattaaagacttttgattcaattaaagactcagttctgcctacacctgcaagaactgagttgatctgtacatcaacatttctgatgtttctttggtagttgctgctggagtcagaagttaggaacaaatctaatggcctttgtaatgtcctctgtcatttcacggaggaatgacttagaggaacaaagctttcctgtgatttctttcttcaacagatggctaatggcacagcattgcagttagaatcttgtttaagatactaggagcacgtcctggactaaaaatttctacataagctttagcaacaaccttatagcttcctttgacttttttgtagagcttacagaatgtatggctgcctaagtaatagtctctgaattaatgggtaaaaaatatattatgagttttttatcctcacgtatggtgctaggctatactggatttgggctaacaaaagcttgttaacttttttttgtctcattgacagaagtattttatatctcatattttacattacataggtgtgtgtgtgtgtatgaaataaaagtttgaaaataaagtgatatactctttttt

SEQ ID NO: 1291 - DNA, 1235 bp, Homo sapiens
ccctagtccttccccgcccctcagggtgccccgcctccagctgccacccactgggatgccgcgcgccctctcacggcccccggtttgctgggagtcttgtcaatcaccgctccccctccccgtgctgctccctcggcacctccgtacttcgtttaccccgcccacccggccccgcctctgggtttctaatttcccattgggcatcagtggctactttcaataggcaaggtcagctgtccatcaaacaccgcccactaagtgagacccaaccctttattaccatttactttattcggccccgcctccgctaggtcctacctcccgaacgtcagggaccagcccccgctaccagccataagtagagccctccgtcaatcaaataacgcccacctgcgctcctcctagcaaagccccggccccagcgattgtcttttcttattggtccaactcgtgatccgaacccccagtcactggctttcttgcgggtcagtcactgagccaatttccaagtccgtcacaccggcttttttcaaatgaacgcgcaaaaggcggggaagtatctggaaagcgattggttcgtcctagaaaacggtcaaacccggagagtctgtacggatcctttccgttctgtgaggaccgtgcccccttgtatttgacctctaagcctcgcgtaaaagaagcgccataagggaccaacgagcagtccagctataggtgtggacgcctggtcccacccggaattgcaggggcttggctactgattggctaagaaagtcctcctaggccctcattggaggatctaaacgcctctcttcggcgtggagacgggaagggacgactcagacgaggacaagaagtgggcaggggagaggcggttgttttgcttcagccgcgggtggggcgcaggcgagagtgggaaactgggaaggccgggctctggggaggtgttgcggggaggggaaaggcccggatgttccctaacaatgaaatcatcgccgacctatcagagccgccgagctgggatacctgcctgacctgtaccccggagggagaagagtgggcgggaaattggggtgtcggaagaacctggaaagcaacgtgagaaagtgggacaggtgttcccttcaggaggattttgtgctattagagattatttttataccagcccttgacatttccgtattttgtttctcagtcggcattgatattaaaactcccagcctagtctcttgaca

SEQ ID NO: 1292 - DNA, 73 bp, Homo sapiens
aaatgatgaaatcacccaaaatagctggaattaccggcagattgtgtagtggtgaacctatggttttctgaag

SEQ ID NO: 1293 - DNA, 898 bp, Homo sapiens
aaagttcttggtgaaggttccgaagatgaaggtggagaaaacaaaaagagacagctgagagaggggtcagaaccaggcaaggggacgaatgagagtgaacctgagacactcaagctttaaggagaggaactgtctccatgaaggccccacatttgagaacactgggtaacagcctaagtggtctcctacggattccttcttttgagcagcttgttcctagcctggcattcaatgaacttgccaccaacagagaagcaggggatgagggccaaagaaaggaggagaagagctctcagaatttccaattagcacatttaagcagtgaaaatgtatcagacctgaccagaatacaatacattgtatgattaggaccacaattccaattagtggcagatacaaaagctcagctctcaatgtgaaaaccaaccagaaagaaaagaaaaaagaaactgtttgcagagaacgagcagagatcttgggaataccatcctccattgagagccagcccctcaaaagctcattcgtagggctgggtaaacacacaccttttgcactctatttttgaaattatgttcaggagtctacagactgttatctgtagaagaagccacttttgaaattttagtttatgtaaagtgttccaaaatgcatgaacagagtaattattttaaaagtctataaatgcatgcatttgctctaaaattttgtaattatcagtagattacaagttctctataggaagagagagctgtctcatattagttttgcacttataccttttttaatagttctgaacttcactcttgtgtattcttttattttaaaagctataatgactaatcctgatcttctgctggaatatgtttaaataggattccattaaaaacaagagctagaa

SEQ ID NO: 1294 - DNA, 492 bp, Homo sapiens
agtcgaagaggctaattccgggcctcttataaaaataagaaagaaaagcctcgtttcctctagatcagagagatggcttctggattcatctttccctgcaatccagcttctcctcctggggccctcataatggagactgggatcatcatccaggcttttgcactgggttaggaatttgggagtcatcctggatccatctgcccctgtcaacctttctctgtcaacagatatttactgggcatctccaacagccaggccctgttcatggtgctgaagaacagcatgtataaaacaaccctgccctcacagggcgatcaccagtgacctgtggtgtggagtctccttttacctctgtctcctccttcccactgtcaccatccttggtcctcctctgtcacctggaatactccacttggtaaccagcatgatcttctaacactagttttacccttgtcagcactttgccgaaaacctcaaataaagacttttttt

SEQ ID NO: 1295 - DNA, 618 bp, Homo sapiens
acagcttccagcatgtgttgtgaaacatttcttctaatttctaaaattgaaacaattactatgatctacaaaatttgaagaacaactatgaatcaataatttactgctataatcaacaaaggataaattaacttcatctgacacatgctgaataatctacataaatatgattgcaagtcatggcaagtattcgtaagtgatttgagaaagtccatgcatgggagcaggacaaagagaaataatctgatcatccctaagaggtttcaaggttttggtatcaggatgatgctggcctcatggagtaagttaaggagtctctccttttcaatcttttgaaatagtttcagtaagaatggtaccctctcttctttatatttctggtagaatttgactgtaaatgtatatttggctggtcctaagttttttgtggttggtaggctttttattactgatttgatttcagaactcattatttgttagttcagggattcaatttctcccttgttcagccttgggaaattgtttgtttctaggaatttattaatttcttctagattttgtcctttgtgtgcatagaggtgttcatagtagactctgagaggtgtatatatatatata

SEQ ID NO: 1296 - DNA, 1216 bp, Homo sapiens
agtcgccaggcaccggccacggcgcacgccaacatccaggataattctcctttccaagcccgggagttccggggcaggcgaaaaaggggggatgggagacccacagtccctttaaccctcccccctggcctgccaaccttttccgaacccccatgtcacacaacttcctcatcatggaaacttccactgggttcggcgctgaggatgccaaactccatttcacaaggaacatgtcaacagctgggcttggggtttgaggaacagagccgctgcgattggaacagagcccggccaccctgttccaccactgtccactccgtagctcccagcctgccgccgcgcggtgcccgaacacgagagggcacctcctcccagatccggggcgcagaagccccgcggaggcaggtagaagattctgaggccctgggcgggaactagtaagccacaatctggaagagtcttttaccaccatgtggaggagaactagagcactcatgttgaactattaccgagaaaagtaatcaacttcttttgtgttaagtcactgaaaggcaagtgttgatttgttgcagtaattggtgctcccttaacacacctgtcagccgggccaaactctatcacagcataaataatcttttccttaaataaatacaggtaaaagaataaagtagacctaaatgcattaatatgaatataggctcaaagcaaaatgttgggctataaatgttcagagtgataattttttaagttgatgtgtaatttagtacagtaaaatagataaaacctaaatgttcagttcaatgaatttttacatgttcatgcccctgtataatcacctcccagaacaacatagaaaatacttcatataaatggaatcatacagtgtgttttctcttgtgtctggtttctttcactcaatgtttttgaggtgaatccacattattgtgtggattagaaagttgttctcttaaaatttctgtttgacattacgttatatgaatatgccacaatttgtttattcattctccaattgatggacatttgggttgtttccaatttgggactatgacaaatgaagcagctatgaacattcttgaacaattatttttgtggtacacgcactcatatctcctgggcatatgcataggagtgaaattgatggtcatatatttatctgagttattctattaaagctcaaaatgatcaatattcaaaa

SEQ ID NO: 1297 - DNA, 3026 bp, Homo sapiens
agtagggggcggagcccgccgcgtgcccggaagcgctcgattccccccgctgccttgatgtggcgcgtgcggagggctaggagcgcgcggctcaggggtgtctcgttggtcgctgggtccttttccccacccagagcctccccggccgccgccgcgagctgcgcgaggcagaacgagagcgagtccgtgagggttggcttcgcagccgccatcttggctcgggcctcagactccgccccgcttctcgccgctgatcccagggagcggaactggaagacagggaaatcgtcgggcaccgcctcgctgacgctgtttagcgccaccgcagtgatgcaagtcggaagttgtagttctcgaccccggaagtctgtccttgcacacgaggcgcggcagtaccttaatcgcagcgcatcctgggacgtgcgggcggtgcatgagggagatgtggtccgcgtcgagcttctcacgcctacctcgggaagcgctggaaactcttccagggccctccaggtgggccagggcctccgaacagcccagaagtccgaccacggagccttcgtgccgtgccccgcccccggcgtgcactcggcggggaccgccttttctcctctaggctcgcttcgctgccccccagcggtggtgcggcccggccttgggacggactccgagaaccccgagccgggccgaaagtgcggggtcctgaccgcgccgcagacggggagccctcgctcggtcagaggaagaagagggttaaacctaccgagaacgttcgctgccgcttcctagagtgacgggcttgtggaattttccgtttccggagctggaccccggtgtcccgagtgtcctccgctctggacgtgctcgtgagctcaggagctggcatctaggaaacggggagttcttcactcgcagcgcagtcggccgcgccagaagaggcgagggagaatccggacggggcggggcggcgggggagcgggacattcgcgtcccggggagcccccaggtcacccctggattgcgaggtggctccgcctgagcagcccttcctggtgtggtcggggcagctgcccgcccggaaaatggtcaggctctagccctggggaggaagaagcctttgccaagagcaaccgtctacaagccccaaaacctgcgagtgccggaaatgtggactgaccacagcctgcctccccggcttcattcaccaccaaggcagcccctctggtgacaagccttaccgttgtccgggttatggcagaagcttccgatgtggctctgatctggttaagcaccactgggtacacaccggtgaaaagccgtactcctgccccgagtgtgaccatcgcttcggccctatgcctgtgcctagtgtggtaagactttcagcgtcagctccaacctgatccagcaccagcgcgctcacaccgctaaaagccttaccgctgaggggactgcggcaagagtctcagccttggctccaccctgttgcagcacctgcgctccacatgggtgagaaggcctctaagtgccttgtttgtagtaagagttttgtgcacagttggaatctgctgcggcaccagcacagtcacaaagtccggaaacctgatgcttggtggtgagtgtggccagaccttcggccacagctcccacctgcccatccactaggcggcccacagcagcacccctgcgtctgcctgcagtgtggcagggccctagcgcaaagctccaacctgggccagcaccagcggacgcactagggcggcagcctctgcaaatagccctggcttcaattttagctgaaacttcagctctgactttggttcggacttcaaggaaatggaaggaaccaggatctctaagcagacccccttctgctcccttagggctgttgattttagagctaatgatgggattcggttggggcgagggggtctccacatctttttgcccaaccctttgctaagtcaaggaaccccagtctgggctgggcatggtggctcatgcctgtaatcccagcactttgggaggccaaggttagcggatcactggaggccaggagttcgagaccagcctggccaacatattgaaaccctgtctctactaaaaaaaaaatgctaggcgtgttggctctcgcctgtaatcccagctactcgggaggctgaggcaggagactcacttgaaccccgggaggcggaggctgcagtgagcgaagatcgtgccactgcactccagcctgggcgacagagagtgtctcaaaaaaataacaaatttaaaaattgtttttaacaaaggagccccagtctggaagaatcagaacactagatctgtgatcactgccttcaaagagcccagtcagctgagagggcttaggtttgttctttgaagttacaaagacagaacgtcgaccagctgaagggagagttttggaatggcgggagctatccagcgtggacccagctgcctgcagatctggcagtagctgacacagtcccttcacaggcctagggagtgatggggttaatcacacctagaacaacagctacctcttcccagaggaatgggaccagaaatcaggcaagcccctgtgaggagttccatggcagcgcgcaggcggggcattcctaacctccagagggaaccatgagggatcctgtgttctggcagatgggccagagaatttgaacttgggaccattgtgtgagccctgggtgtgtgagcccttcaaaagtcctctcagcacgtgagaactatcattatggatgatgctagggtggtgggggccccagaacagacctgtatgttgagttcaggggttgctttgttgcatttctgggcaggggcaagaggcccagggtttgtcatctgccccttcccctgccttatccccttcccttccaagttccccaggctccttttctgccagtctgtcaagagagggaagagtggcgaagagtcctttgtgcctggacattggggactgaacatggcccttttgcctgggcattgcccaaacatatatttctactggc

SEQ ID NO: 1298 - DNA, 516 bp, Homo sapiens
gagatgactatgttgtcaaagacaaatcgtgggtcaagattgaaatgggggacagtctggaatttacgaggatgagatagaatggacagccctgtgacatcaacttggaagaggttggactccagatttggatactcagatcccggaacaggctgattggaaagagaagaatggacaaaagaagtcaaccacacacaggtacatagtcttaccagacttggaagattgggctggatgaatgtattgcacattgggaaactggcgtatcttgaaattggcgagggaagctttggagaaatggcttgagaaagacatgttgaagaggaaaaatacgttaaggcttgccaatcagctgactgcagcagcagcagcagcagcagcagcagcagtgatgcacagatctgatctgcgttggcaatatacttgtaattcggacatgcatctccaggacaccagccttagcaggaaggggagccaatcaaggggaaacaattatgcaaatttaaaatgtaaact

SEQ ID NO: 1299 - DNA, 670 bp, Homo sapiens
aaccactctggaatatgagaagtgctctgagccagggaagaagtacctgctcctcctacaaggcccagcagtatcagcgacagattatgcttttgcaaaactaggtttacaatatcacgaatagtttgcgggcggagaatatttccacagaacaggaaggatgatttcttcagacagacaaagctttgctggagcgtttctgccgtcaacagtcaagtggaggaaagacagtgacagtggataaactgcagaagctgctccaggatctgggagcacagcctcctgaccatgcagggagaggtgtcaggagaggccccgcaagacacccagaggagacccttcagttgtaaaggctgaggaggaacttccatctgggcttttctgaggatgagtgaactagctcatctagcaaccgggaattggtaagaactcacaacaaatgaacgggaggtgagctgggactcaattctgccttatagagtagcccctgtgcagaactcatggacccaggtgaaaacagcctccctgctcacatggcctcccctctccctaaccttgccccggccctgaaatctgggtggcataaatggtgcagtgtacaaacaaaaagggagccctgtggagggtagacggaggaactggaccctccccagcccccagccctgctcct

SEQ ID NO: 1300 - DNA, 538 bp, Homo sapiens
agacagtgtaaatgtgtgaaggcctgacacttacacatacattgcttttttctctatgtaaggtggcagttgctggagtaccagggcaccaagtggaggatgtggtagacagcctctaagatgcgccccctgccaatgatctctgcctccagggaggagctagaaggcagagagaaagccactcaggacttcccatcccagaagataaaggtgaggaaagcagcagcagcagccacaggccagtattccagagcagctttgggttcctgtcaagacctgctttgagaaggaggtggctgtggggctggagggctgggcctgttcctgagctggctgctggcagcacagcaatgaggcaacattgagaactgcgacacgaggcccagtcctgctactaaaccaactgtgtggacttgcatagtcacttcacccctcgggcctccatttctccactttggaaagcagtgttgggacgatgttaagggtttgcaaccttccaacatgaagacttatttttaaaagcaaaacatttcaaaga

SEQ ID NO: 1301 - DNA, 417 bp, Homo sapiens
ccatcctgctttccttttctttcttttcaacaaatattgatggagcacctcctcggtgccaggcgctgctgcagcctctaggaaatcaaccgtggaaacacacggaccctgccctcccggcgccagtgttctggtggtcaggaggtgaagaaaaccagcaagaaccagcacaggaatccgacggtggcagcgccgagagaaacaagcttggaggggaaggagagctacagaggctgcatggatgtgatggttggagtggaagctgacattgtgggccaggagaccctgggagtacaggccaagatgaaaagagcctcaatccagagcgttctgtgaagcagtcaccacggccaccctgggccatcagcttctggacttttacaacatagaaattaaatttccattgaatttgttgga

SEQ ID NO: 1302 - DNA, 1262 bp, Homo sapiens
actaaatctggatccctttgcttcttccctgctggctactcttcatatagatgctcttggagcctgtgcattccatgatgcatgtcagaactctcaccttgttcagcctggtgtgccttaacctcaggagtaaagggaatcatgtcggaaacacgtcgttaaagtagaatggtacaaacattggcttcttagtgccattagcacttttaccaggaaatgcaaaagatgcaaccacataatgttttcactttgttttatgctgttcttcaatcgctctttttgtttatttgtttgtttgctttcattaaccaaactcaggggaatgtcatgatgtcaccaaggccaatgggtagagaaataaaaaccagccatccataattgaatctgtaaagtcagtgaacttagccttttcaggttcaaaattacacaaacacaaggattttcttatctttcacctttcaaaggttttctttttattttgccacctgttttccaaataagaagtgggaagcctcttagataaattgtgataaaaatgtctctttgtttggcgtgagctatcaaattagctttgtgtgtccactgagccatcaaattaggctttggctgctggaggcctaggttctagctttggtcacctatcagaatcttactgttacgctgggcatggtggcatgtgcctacacggctcacacctgtaatcccagctctttgggaggctggggtgggaggatcactggagcccaggagttcaagacaagtctgggcaagatagcgagaccctcatctctttgaaaaatatatatatatacttttttttttaaaggagagaaaatgcttaggttgcaaatggagagtattgaacgtggtgatgtaaaaaacttctgcaaaacttgttctgtagctcctgggtcaggtctatgccattttttcttatatctgctcacacagtacagaaatgactaaaattttgggtctgggctgttatatcactttgtgttaagttatttgtagtagctaatgtgctaacttatatatgtgttctttctgttttttggattttaccttttgttttggcataacttatctatatttttgtttacattattttaaaaatatcagtaactgtaataatataaaattgaagttgtattgttgacaatacctctagtttttaaggtcatctgtcacataatttaagtgcaccagttcctaatgtataaagttctctctctctctctctcaataaacaatgcagaaaa

SEQ ID NO: 1303 - DNA, 664 bp, Homo sapiens
agaactgcttcttgctgccgccatatgaagaaggacgtgttcgcttccccttcctccatgattgtaagtttcctgagacctcgccagccatgctgaactgttataaacatcttgagagcaaggactaaatcttacttatctttattaagaactaacagtggaacacacagaaaatccatggatatactgtcagactgtcaccaaatatacattcaacatttttcttacttgtgagactgattttgagaaaatttgctatcacagaatcactaaactttagagcaggtaaagactcctgcaatgattttatttacttgctatattttaccaataagaaaaccgaggcatagagaagttgagactttctacacaccagtgcctagtcttcatgatgcttatgcccaaccctgagtcctttcctctatataatcctgcctcattacatttctgaaagacggagaagttttataacaacaagatgaaagactttggaagtttacagaggctatcaggctatcttctcatagacccatcatttgtccagcagaaagagactaaaaaggcttataagaatatcaagaccccaatgttgtacttatggtttgactttatatctctgactaattacagaatttgattattaaaaaaggttttttatatcaaa

SEQ ID NO: 1304 - DNA, 805 bp, Homo sapiens
cagggctccagagggctgaactatccacacatatgggctcgtggaggcagctcggggcagcggctcctgcagtgggagcatcgctgagcactgtccctgggagaggacgaccccaggctccacagccaagctgccctgaggctaagtgtcccggggcccagggagccccagcagcagccccgcacggtcaggcctgggccacggtgctgctcagtggtccctgcgcggtcagcacctgaatggctgctcgcctggcttggcgtgccttctcctcccgggccttcctcctggctgcctctttctgctggtgcaggtccaagagggtcccctcgcctgaccgctgccgctgctcctgccaaagaagccggtgccatgtggcgtttacatctggaagacggaatccagacccagaccagaggtttccccacaacgccctggagtcccctagagttcgtggaatctcagggccagcagggaaagtgaaaccccaccaggaccttgaacctgccatttctctgctctacagaggatgagccctacgtcgcaggtggccaacagttctggcgtgggggagacagctctgcccccacagaacgtcctcctgagactctccagcctgggatggacccagcaggcgtttcctgacacccaggccctgaggaccgccagtgaggaccaccctgactgtccgcggggacccagggtcaagaaggatgctgcacccagagacggggcccacgagcaatcctaggctttgattccacctgtcccagaaactcaaacccctgggattctgggccagacc

SEQ ID NO: 1305 - DNA, 443 bp, Homo sapiens
gttttgttttgttttttttaattttggacagctaatctctgtagtgaggaacccagaactttcggtaatgtaagggatattagtctggttgtcagaaaaatgggctggagtatttgtgctgtgtccctgaccataattcctgctcagttgcttagctccctggcaactatgtctgagggctaaacaggagttggtgtgatcttccagaaaaagaacaggcttcttgtcttgcagaggcaggaagtcagaaaacaagagtgtgtgtgtgtgtgtcagggggtggggggtgtcaggcctccttcccttcagtttgggacttaaaacttccaccaataacgtgagtatgtgcacccatgcagcagcctgtccgaggactcacaactggagacacctccctgcttggcgctgcccagaaaactatgtagatggccaagaaaccgact

SEQ ID NO: 1306 - DNA, 537 bp, Homo sapiens
agtataaaaaacagagcagagtgtttttggggttcctcagttgcagtgagatgtgaggcacttgcagagactcagtccaccaccctgggcagctttcaccaccctgggcagcttttccgagacgtagggactggcttgccgtaattcatagcttctgctgtcccttgctacatacctcctgtttggtcacaaactaggattgcagcatctgcttgtaggctcaaaataaagggatggagaaaaatcgaccaagcaaatggaaaacagaaaagagcaacttgcttcctgaaaattcacgctccagctccctgccacctccacatctcccagtcagcctcttgttggcacactgaatcactctggggccatatgtttcaggcttcgtattaagtgtcaaagatcccatgacaagacagctcccctgcttgctgggaggacgtggtgaggacagggtacatctgaaacctctggtgtgtctggcagagttgcaaacgactagattccatccaagatcaaatgaatcagaatctgtggtga

SEQ ID NO: 1307 - DNA, 656 bp, Homo sapiens
gtaggtaacaggtaccagctactgtcagcagggaggaaggtatgtggtgaccacgagtccagacctgagggtcctgaccctctaatgcggcctctcaccagtgttcgcagaaacccacccgctgattcaatacggggaccaggaacctgccatgacagtcacgactcagtctgcctgcacctacatgattaaaaagctttattgctcacacaaagcctgtttggtggtctcttcatatggatgcgcataacatttggtgccgaagaccccggacagggtgactccttcgggagattggtcccctctcctcaccctcactccatgagaagatccacctacgacctcaggtcctcagaccagcccaaggaacatctcaccaatttcaaaccgggcttccctcttgtctggaggaaaaagaaaaaagagaaccagacttagacacaacttcttgtgggcacatattcagaaggcatctcactggagagggtttagttctccttagcagaagataagatttcaagatttcagctaagactcatctctctgcaaatctttcttttgagagcatcttcaccaggaggagattccatctcaagagaccactttcactgctcatatgtaagaagcaactcttcatctgttcaagtttgatcatg

SEQ ID NO: 1308 - DNA, 289 bp, Homo sapiens
attcaattctcataattctcctgacaacattctctccaagcctcagttctctccttcaaaatcattatgattattcccatttttcagataaggagcctgagtcccagagagcagaaatgacttcataacttcacatggccactaggaggcagagcccagacttgaacctaagctcagttccaagtgccacctaacacttgaactctgatcctggggaaccaagacacaatagggaggccataaaaactgtggaatgaatcagtgaacaaataaatcctatttctaaaga

SEQ ID NO: 1309 - DNA, 600 bp, Homo sapiens
gattatgggttttctaattacataagtcagaagtagaaaaagggacacaaactaagaagggtgctgagcgctcgtcacctggagggacttgtgcctctctcagtggtagtagaggggctacttcttcctgccacggtcatgattgagaggcaacgggtggcgagtctacaggggacgtcgtcgagcagacatgggataactttaagggagaagacagacaaggggaggggctcctgtgatgggatcagtcagatgcctgcctggccgctccccctgaggggacttgggctcctcttaacattggcaggctggtataaacttccggctcagatcaagctatgcctgatgctgccttaagccttatgaggtcgccacggaaccgcagaaactcctggagggcagagctgtgtctgccatcttcatcattgcattaccaccaccaagcacagtgcctggcacaaaagagttgctcaataaataaatcaggatgaatggataaatacatggataggcactttgagctacagatgagtttaaatactttgtgtttttcttagtcaaacatgtgcaattaagcatgtgataaatgatatgatgacc

SEQ ID NO: 1310 - DNA, 1313 bp, Homo sapiens
agtccaggtaatggagcagagactggagcagagacaagttgttcccactgagctctcctcagattacagattgggagtggcaaatcaaaggcattgcagcctctttcatcactgccgattgctgatgccaaccatgtgccaagtgcttaatacgtcaccttaaatcttctcatccaccctcagagtagctgcagcatcaacccagtgccctgactttcaagacgactatgaaaacaccccaactgctgctaaattaccagcaacaaggatctgacattcttattcaaaagaaagaacaccgaaattgaccttaccctgacaatatgatggctgaaggatttatgatcacttataacatttgaaattgaggcggaacctgaagaataagactctggtgaaaggtcctatttatgcttttgatgtctttcacttggacatttaccacatgcctattggtaggtttgttacataggtcagttaaggtgatacaagaataaataaaacactatccctatcctttaatatcatttatttatggggtcaatcacagattttcatttttcaaaatctttgataaatgtcagaattatgttttttaatatttttacagaattattacaatatatggtagaggatggaaggcaaggtagtatgaaacggaaaagatattttgaattaaggtatttggacctggattaatatttttgctttggtctttattagctgagtgaccttgagaaagttcttctactaaaaaagaacaaagataataattacttcatgaaattgctgtaaaaaacacataacaagtatatccagactcaacagtgtatgctcaaaaatgcagatcctttttcccttacctgcaaataaagtcttacagtaatacagtgggggtaaaggtttaaactggtggattcaagaagggctatagaaagaggtagcatcttaataggggaaggagaggatccaagaaatcagatccattttctacaaaaagaaatgggaagacagataattcaagaagaaaagtttacatgattaaagacccgaagttagaaatagtgatgtgtctcaatagtaagttaggaattggggtggacacaattgttggaagaaggatggtttcagcaaaggcccaagttaggtgacaatttcaagtgtttgtgaagatatatgaacaaaattataaagtagttagggtataagaaatagggaggagggaatgaattaacatttatggagtgtcttgcatgttccaagcactgtactacttgccttataaacctttcttcaataaacgcctacaacaa

SEQ ID NO: 1311 - DNA, 515 bp, Homo sapiens
cggggtcggggcgtccctgggtccagcagggagtggcctcccggaagacgccggcgagggaggcccaagtgcctgctccgagaaatctcagcgaggcctccttgggagaaaagtgcaaggcggtgacgtccagtctgtaaaatgtgaaaaacgcccaggccgaaaccacccagaacccgttcctgcagggaggagggtgggtgggaccaacaggggatcagtcactgcgccaaggcagggactagggccatggtggacaacgggggtctacctcagtgttccccagacacagacgggttcctactgtctggccccacttatgtgaagttctagaacaagccccacattttctggtgacagcaaacaggtggcattatttatagatgtaggggcaggtatttatgggagggggcacagagaagagcatgagctgggggtggaggggggcatccactgattctgagatcctatatttctttgagaaaacaactgaataaaacatagcaaaataataa

SEQ ID NO: 1312 - DNA, 742 bp, Homo sapiens
aagccaagtgggaagatccttgctggtttctccctctgaggaagaaggaaaatgccatgactcccactatggcctctcttggaaccatattttgaggttcatctcaaagatctctctttgcataatgtgtgtgtggacctgcctacagatacattgggtggaagccctaggagcctcaagcaagtctgaagattggccctgagaaccactgttctcattatcagcaaggattttatccagagacctctaggaatacattcactaaaatgtgactgtggtcctgtggttgtatgaactctggctcttctcgtgaattacatttcactggagtcaggtgttttctgtaaacatcgttaaaccacgagaccaactgcattgaacattttttgcactacattgttttatttcttgctcgtcttttccttgcagagctggggctggggtgaggtgtgtggtgtacctagcactcaaaatgtaaggattctcagagtcatacaggtgcacggtcagcacctgagagtgagccaccctttaacattttgccttctaggtgcttcacttgccttgcccaagcactagccctagattaaataatatgtttctattagttttttaaaattataatattaacaataactagcacttattgagcactcccttatgtgccagcaaatgtgacttacatgtatctgcttatttttccttacatgaaaccctctgaagtagatacaatgggtatcat

SEQ ID NO: 1313 - DNA, 547 bp, Homo sapiens
ctccccagagcgtgcaaggtagaactctgcagtacaaacctttacagctgctgggcataggagaccttctagtagaggacaggaggcttgggttctagttacagttctgccacagtgtcaccttaggtgacacaggcccaggcttcgctgctgggcctgttacttcatctgcacaatggaaactcaattctatttaaattactttctaaagggcctcagtctgcagagacacagaagcaaatgattgtatgaagctcctgactgtatgaagttctcagtcaaacaaaatagtacctcttctgcccatctcagaggtggataaggataaagtgaaataatggaaagcacaaggaacagtaaaaggcaaatgtcaagaagctgtttgcaaagttaccaagatgtaaaattagattttacttattaataatcatgtcacttgtcattctgtttataatggtcaattcactgctgatattcaagtggaccgtttaaactgtatttttgctcagctatccctccaaataaatatctcaaaatcttgactgtt

SEQ ID NO: 1314 - DNA, 727 bp, Homo sapiens
cagaaagaaggaacagaaggagctcttgcttgagtaaggcactggtcatgcctcaattagaacccatcaactcatcctttggaccacccaaacctgtcagaagagtgtctccgtctccatttttgactttccagagaggtctgaagccacctccacacagtgaggtggcagacttgtggacaggtcctgaagccataccaggagctgaccagccccagaaaatgaggacatggctgcagggatagaaagccaaactgtgggtcaaggggacttcagcctgtccatctgggggcacgcttaaaggtctatgatggggccaaaaagaaaggtgcaggctaaggacagaaggacagctcagcctgaacagccccatcctgcagcccaccccagccctgagcctctggaactctatcactgcatcctggggcacctgccccccaagcccccaccccaggaagagtatctatgctgtcagaggctgcagacggtgccagcagaaggtggagaggaagcttggggcctttggtgggtgggacgcatcaacacacacagccgcagcagctgcacatagatcaacaggccatccgtgcctcgaacacctacatcaacggccaaggccttggccaccctgcccagctccgtgcaccgctagttgccttggtggatcacagccgctccacgctccacaggaagaatcccaaacccggtgaccggctgccccagcatt

SEQ ID NO: 1315 - DNA, 348 bp, Homo sapiens
ctaaatgtgttctgaagataacatagatgaaacttccatcaacactgccaatcgaaaaaaaaaaagcacatgccaacataatacaatttttcctcagaaggattttggtaatttgagaaacctgaattccaagttcctttctccttttcaagttacaaaatgcttcccaaccaacatgcacagcactgcaaacatatattaaagcatcacaaaacaaaaactgtaattaaaattgaaactctgtgactcatgttcattatgtcaaatatacagatggctggtgttgaacatagctcaaatcgttttctaaccataatcatgtataataaaagattaatatggagtgaa

SEQ ID NO: 1316 - DNA, 505 bp, Homo sapiens
cacaaccagattgcaatcaacactgttgcacaatgaacttctctgcacacatgtgagtctctgagggtactggaagatcataaggttatgttgctattcaactctggaaaacagtttaaaacacctagaaaagtggaggttcttgaaattcccacagtcctggaagaaccagaatcctaggagcatggaagacttaattcattcaacagtaaccacctctttttagcctaagactttggcagccgaacaacagaacaggaattatgtcagcttttctgcttagcatgagctctgccccagaaccaatgacataaaatacgtatgtttgctttccctgccacaaagttgcgacacattatcaaagctttacaaagtcactctatcttaggacacccctagacaacttgtttccatcttacttctgggacaaaaatatttactgtatcctgctttcattgtctttgtgaatattacattaaatgttgacatgtgcttggcaattcaa

SEQ ID NO: 1317 - DNA, 733 bp, Homo sapiens
ggtaaaatatgggtgaaacaataggagtttagaaaatgcttaataataagggtaattcttattatacatcttgtaatgttactctcccaaagtaaaatctggtaatagaaagtaggatttaatactttgagcatttaatactttgagaaggcttatggtatgctcattaaaaatgaatcaatgaaatatttatttaaacacttttatttaaaacatgttatacccttgaatggcgtgccccctgttgacattttcaaacagacattccaaatcatttccaagtacagtcatccctctgtatcagcccggagattggttctagtatccccttggataccaaaattcacacatactatttttcctctgcttttaagaattgaagtttgattgtaaaactgttttaatttgaataaaatgatactgaggtagacaagttctctggtaggaatcttcttttattctctttctccattcaaagccacttctagtgaggttttctctgatctcaggttatattaccttgatagcatatgataaagggtccttaacgtagtctgtgagataactatttttgaagtaggcatatttattccttagttttgttttgcatataaaaaaattagaatcacgtgatataattttataagtttgttttcccctgtaacatatatattatgtattttaaatgttattaacattttaaaataaaatacataataaggtaaacttttta

SEQ ID NO: 1318 - DNA, 2917 bp, Homo sapiens
tactgatctatttctgtgccaataccacctactgtaactttaaaataggtttttgtttataccaagtaagaataagttaccattatttttccattaatttttttttttttttttgagacaaggtctcactctgtcactctgttgcccaggctggagtgcagtggcatgatctcagctcactgtaacctctgcctccctgcttcaagctattctcccacctcatcctcccgagtaactgggactacagatgcgtgccaccacacctgactaatctttatatttttagtagagaggggggtttcaccgtgttggccaggctagtctcgagctcgtgacctcacgtgatcctcccgtctccgcctcccaaagtgctggaattactggcatgagccaccgaggctggcctgagtattctagtttataacttacaaggtcattcatatgtatatgttgttgtgcttgtctagctattttatattttgttattctgaactcttggcctctatctcagctccagcccctgaaagtgcaggagtgcttttgctctgccagtcggccttttttgggaaatcatatcaagatggcttttccagcacaattacttcctagagtgtctgcttgatgcatggaaactcatagatttttggcatgccaaacagagggttttcctgccgtcactgctggctccagccacagacttcagttttcttacctgttagagcctttgtcctctgactggtggaaatggagcttgcttctttttgttttgcctgccactagtctggcagcctccacctcttgacccttgggtttcttatccttggaatcagatacgaggccctgtgtcttctgttgctgtagaggacacaagtcatattctctgagtggagatctctctgaagctcctctttccaggcttgtactgagggacctctggaccctctaccacgtggtgtcaaagctgccaagagctgtcatatgctgggtctgtaaattgactttctcacctctgaccagatgcattcacttgagcggcacagagatttgggggagtgaaagggcactgtttctttgggtccgtgggcttgtgtcccatcccctagccttggggttagcaggattcagaatttatgagtgtggtctgcaaaagtctacctctaccagatgggggagaacctagtgtgtggacctgaagggttagctctgtgctttagtccctgggagtggccatcttgagtcttggtgggcttggcaagtaaggagacattgaccagattcaaagcttccagaggtggtgagaactccagggccgagtaatggagagtacaaaggtccttcttggcccccatgacccttccaagccaagaacttggcagtagctgtgagaagcagagatagggagaggaggtgaggggcacctatagctcttagccatgagttatgactccctccatccaagggagacccaaggacatgaaaggggactcagttccaaggatcagagggaacttgggttgttttgggataatgactgtggcttgggatgtcacggagatgaacaccagaattggtgtgcaacagatgagctccagtacccctgatagtttgcatgggttttgctctgctgatgatggtcagggacagcagtgaggccctctacaatgccgccttctgcctaaacacaggcagtgcccacaaaaggggagctgtcattatggagcctaggaatggatagtcagagagcagcggctgggcagtgcaactcctgcattggacaaggtcctggctagagaatgtcaatgtccacactgcatgtagccctatcgaggagatgatgtagggggctgtcagccttggagactctagcctaagtaccccaccaccactctggctggcttccaagggcacaaatcagctttctgaatctgacttggcttcctgtgatctgcattcatgaacattcttactagagttctcatggaaaatgaatacacaactatttggtctgaatgtgtctgagtttggtgtctccaaaacaattctctggattagatggagaatgaagaaacttcacaaaggcaaaaggacaggtccccatctcgacccccagagaccacttctcagagtctctatctgttcgtctctggtgttagccacgttcctttactttccctcatttctgtggccactcctgtggcttcctctctttcaacctgcaggctgctgctgccctgcctcagacccttgtaggcttctgtagagatgctactcagatgggggtggagctagatgcagagctgaaacccacctaggagatctagcttggagagcttgtgaatcttaggagagctaggcatagaatgactaaagtttgtcaccgcatgagataaaataaatgaaaagccacttctggagggaatgaggcagtctgcctttattggagagatacatattgttgaacagctctgggcagttgattgtgtgcctgggagagctaaccatgtttactctacacttgacctgtgatggtctgtattgattgtatcacacgcttagctttctaaggctaaccaggtcatcgtcctcagtccctgcctgcaactaggttgccaactggcccttgatttcccacccaacttgttcagtttgccctcaatcctggggcctcactaatttcccaaaaagatatggttggtaccacctgtagtttgctgttgcatgttaacctgacttttgggaaactcaaataaacacttttcaaacgcattgaccatttttactctatgacttctgctttgcatgatcgctagcttggtcacccatcatgctgctttctggtgagctgaaaggaaaataaatggtctaaattgagcaacaagaaagtaaacttttaagcaggtactttccaagtgaaatg

SEQ ID NO: 1319 - DNA, 1541 bp, Homo sapiens
atcaacattcttcccccacgtcttgacgctgggttccggcctagggttctggctttcctcctgggctagtgaacgcggcgaagtcctcctctttctaatctccagagccgcagttccatcctctgggtcagcggcttaccctgactgggctgcggtatctgccttccttcccccaacaaggcgacaggtagtcggggctggggccggaactgactgagtgggccgcaactgactgagtgggccgcggctcccgcctgaggaggctaggaaggactgaacagcagccgacttcccaggctctaaaaatcgtgcctctgagttagagctacctcaaaagcaagaccaagcatgagaaatggagtcttttggccagtattggggtgttcggaattcaagcgtatgagagagtggacggtagcgttgagaattttcatttgaagatctcgtcttaaccaccccaagtgtagtcagaggcggcgttttccctgcgagagtgccctggaacaaagcaaggatagcgtgggttagacatacctgaaatgaaagcgtcttactttatctaggtacatatttgcgtcagtaaggcgcaacgccatttctctcttggaattcagaagtgaaatatggtgactgggacgcctgtacattgctttgacttaaaaattgaagtccattattctgaccgaaagttaatctgatgattaattggttaaacatactatcgttgctaattagcataattattatttacaataaagtgagctaaatagctacaactaaaatatatttaaattactgtgatattgtgatgctaaagatgtgttgaaattaatatcttgaatttctcaaccctgcctaaatgcctctgagagtaattagtataattaaaagtcactagagaaagtgaatgactctaataacaggataacaaattcttttcaagtcagatggtttccagttctttgctttcaacaaaattaatggtggcccatgaattgtcagctgatgaaggaacactatttggtttttggcatgcaactcggaaagaaaccaaacgattgattgacatgcttacaacaaaactactagcattctcacctatttatgtaaaaccatttctcagcacttgtatctgtgaaaacaacagaattgaaaatgaaccctgttaatctaccagtaggaactattcatccagataaatgaattaattggtgggtcagccccatctatctcactaagagatgtgttcccaatagaatttcaccttttataactgtgtgttatcaatatttgcaatcgtgtcattttgatccattatatactaaagatgattgtgatgattactcacttcagaagaattccagcgtagagccataaagttacacgaaattttttaaggtttactacatatgtcatatttttattgcgaagaagtgatcaagaaaaggttgttcaaacatcaaagtactatatttgaataacattttttgttagagtacaatctaaatatgttagagataataaaagaacaatgttgaaga

SEQ ID NO: 1320 - DNA, 623 bp, Homo sapiens
gcctgccgacccgggtccgggggcccagttggcgcccggaccagctctccggtctgcgtcctgtagatgggaaaactgaggcctgagagggcgcgagggcggggacgaggccgaggactcgggttcgaatctcgaggacgccagtagcccgctctgaggccgcgtggggctggtggaggagccaccggtcgggcccccaagaccggctgacgtgggcctcgcctcgggcgactcccgccgggctagtggctggccgtgtggtgaccttgggcgagttacttcgcacagccacccaggggcctcttctccaacacgatagcactgcacccggagggccttcagacctgagctgaaatctacaccaccggctctctgactatcaggctttggactatactttgggctttcctgggtctcttacctggcagacagcagattttggaacttttcagcctccataatcatttcccagaagaaccacaaagcataaatttccccaaaaggggaattttgttgatggctttagtctattccctcctaaaagaccagctacaaccaaatgaagtgaacataacctcaagggtgtattgtcttcataataaaagatgaagcttagaactgga

SEQ ID NO: 1321 - DNA, 746 bp, Homo sapiens
tattttggaaaaccagtgaaatagtggattggctactggttctgtgctaatagtgtttataagtggaatgggactttttttaatatgaagtcacccaaggaatttgctttttctggaggctgaggcaggagaactgctcgaacccgggaggcggaggttacagtcagccaaagatcgcgccattgcacttcagcctgggtgacagagcaagactcacacacacacacacacacacacacacacacaaaaggagtgaaaaggattgaaagcaacaaaatagtatgtagtcatcttctcaaaggaaccaaagtaatgggctgattatcttcagcttcctgaagaagctgaatgtttgtatgtaggaagtcccatgtgttatcttggcaggaagtagaaaatatgagtaatttggggacgcagaatctttcgtcacttccctccatcgcgtctcatgtccaggatcttcccaggagtcgtaggaaatgtagcatccatgcagttagtcgtttacctcctaggaaacctttgtgctcttaggagacagtggcttcccattgtggttaagtgtaaccctgtttggctgacccctggatagagcttcataccctcagcactgcatagtcacctttgacttgtggttagaaagatcagccatatagtccatcatgatgatatgttatgatggtttatacaagaaactgggactttttatctcagccaaaacgctactcttgctttaggattag

SEQ ID NO: 1322 - DNA, 935 bp, Homo sapiens
gtaattatccagttgatatttatcttgttccagtcacctttagaaagctgtttggcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttctttctccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaaca

SEQ ID NO: 1323 - DNA, 399 bp, Homo sapiens
cctgtctgtcaaccccacacacgctttcccagtttcattttagacgtctcctgaaagctgagcatttgttatcttaaagcctcttaccagtttggatagatatggatcttccaaaattaatgagctccttaatatcgacactgtttatcaacataaaggatcaatttaggaagattataaaaactgaagtttccggaacaataaatgggagaattaatcttctgaatcaaggacgtatccctgaatctggggagctctctatcaaaatatacatgctggaaccctaccaaaggaataataaatctggaatgaggctctgactgtctaattaggaaaagactccttcctggaattctgcacatctccctacaccttagtgacggttaaataaataattat

SEQ ID NO: 1324 - DNA, 463 bp, Homo sapiens
gtttagaaatattgtttccatattacaagtttaaggaaaagtttatctgccaaaataataacatggatttctagagcaccccataccataaggaggagccagaatattttccagctgaattccagtcttactcattttccttgaatgatactgaaatctaaattatccttgaacacaaacaatgacaaagaaatacaaatgttcatgcagtgtaattttcaacaatcaaattggccaatctgattctaattctaagctttgctgaggatgccaagcagaagccacgtgagcacactgctgaacacccaggatctttccatgtatggcagccttcatgtgagttctcttctcaccatacaatgttgtggatacagaagggaaggaattggatttggatgagtactgagcaccgatcacaggacagagcctcaaagttgctttttggaataaatttcttatagta

SEQ ID NO: 1325 - DNA, 380 bp, Homo sapiens
gatacctcacttgaggttgacaggagtggccagcagttagtgcctatggtcatgtaatacactaagtcaatacctgtggagtgaaatccggtctctataaaaaatacaaaaaaaatggcgtgagccaccgtgcccagcatggtatttatgattctaagtgccatttcaaaaatctgtttgctcttttttattctctggtccactaaagagtaatctttactgtgggctttatttcatatttttatttgtcctaatactaagtggtagcttctcatttctctgtttcttgattttggagagcaagtctatgcttatctatagaaataatcagtttgtaaacttatgttctccttgaagagtttttgaattttcatgtggca

SEQ ID NO: 1326 - DNA, 2549 bp, Homo sapiens
taaagaaggccaaggctcaggggttaagtgacttactggaggttatcagagaggaagttgccaaacccaggctaggaactgaatggttggtttaaatccacccctctggcaggagactggggaatacacatgagccgtgcagacagcagagggcagtcctgggggtgggggcgccagagggtttccggtacttttcagggcaattgaagttccggtcactactcccccccagagcaataagccacatccggcgacgtgtggcaccccaccctggctgctacagatggggctggatgcagaagagaactccagctggtccttagggacacggcggccttggcgctgaaggccactcgctcccaccttgtcctcacggtccagttttcccaggaatcccttagatgctaagatggggattcctggaaatactgttcttgaggtcatggtttcacagctggatttgcctccttcccaccccacagttgccccccaatggggcctcggctggctcacaggatgagggttcaagaagaaggctgtccctggaggtaagagggcttatgaaccatgttccaaacctttgcgttgcttttctttccatcgtgtctatttcataacatccctgtgaggctggatgtgggaacttcagcactgccgtactcttgggaaatttgtccaaggccacccggctgagcagcggttgaaccaggacaccatcaggcatgcgtttcttgtctccaccacaccctcaacccacttcccaacgcgccttgcgacaggggctgcggtattgcatccacatgactgataaactagtaaacacacatgaattcattttaaaagtgtattcaatcagttaggtaaactaaaaaccttaagtcttcgttcgatttggaatgcagccagagaacaaatggaaaatttttcaaggtagagaagatgaaaactcagaacgccctcttgtggcatctctacccaccctaggaacactatggctcttcccctacacatggtgattgctaaccttgctacaagacgttggacacacacacacacacacacacacacacacacacactgaggttccttttgccccctcacttttgagccagtgactactgaaaccctctccattgttgcaccaccagcaatgcccccatcacttcctctcatttacttccacaggctggttcatcctcaaagccctccttacgtagatctgtgggatcagtgaggctcagagaggtaaagtggccagcccaaggtcgcccagacagcaaaaggcagggccagcgctgatttcaagtccaatggcctatggcaatttcttagccaaaagcaaaatctacaaaaataaaaagtcaggcacagtggtgagtgcctacagtcccagctactgaggaggccgacgggggaggaccacttgagcttgggagttcctggctgcagagagctatgattgtgcctgtgaatagccaatgcactccagcctgagcaagatagggagaccctgtctctaaaaaatacctaaataattttaaaagtcagcctctctgactgcctatagagaatgctaactaactgaatgacagaagacctaatgtaatccaggtgcaaaatcagaactttccggccgggcgcggtggctcacacctgtaatcccaacactttgggaggcccaggcgggtggatcacgaggtcaggagttcaagaccggcctgcccaacatggcaaaaccccgtctctactaaaaatacaaaaaattagctgggcatggtggtggccacctataatctcagctactcaggaggctgaggcaggagaattgcttggacccgggaggcagaggttgcagtgagctgagatcgcgccactgcactccagcgtgggggacaaaagcgaaactctgtctcaaaaaaaaaaaaattagaactttccccgtactcttgctagggcttttcatggagatgtagaaatggtagtaagtgccaaggccccagaaccctcatgtttgggtccgactcccacattgccagagactaggcagctcacacaggtgtcccaagctgtctttctcacaggccgcattgaaggcatttatgaaatgagaccccctcttcctcatccgtagtgacagggctggcctgaccgtggagaaatcagatttgatcatgatagcttccactccgtgactggtcacgatctgccaggcgctgtgctaaacactttcataggccttgtccccctccatcctgataacaccccagtgaagcaggccctgctcttcactccactccacaaagccaaggctgagagaggttaacagacttacctaaggtcacacagctaagaagtcgtgaagctgggatcgaatcaagtctgtgtttatgggtttaactatcatgttgtggccccaaccccatttgacctagcctggctggtgggccttcttgcagtagcttcccctggagaagaggaaaagcaaaccttcattgagacccaagcggtctctcctgtgctctgtgacaataataaagttccagcccttg

SEQ ID NO: 1327 - DNA, 2571 bp, Homo sapiens
agttcccgaccacgcctttccctccacacctccctgcaagctgagggagccggctccggcctctgccagcccaggaacgggctcccacagtgcagcagcaggctgaagggctcttcaagcgtggccagagtgggcgccgaggccgaggaggcgccgagagcaagcgaggctgccagcacgctgtcacctctcgctgcctcagactctggagtagctgggattacagtcacgcgccaccacgcccggctaatttttgtacttttaatagagacgcggtttcgccatgttggccaggcttgtctcaatctcctgacctcgtgatctgcctacctcggcctcccaaagtgctgggattacaggcgtgagccaccgcgcctggccgatctgatggttttataaggggcttttcgccgcttcacttagcactcctctgtcctgccgccatgtaaaggacgtgtttgcttccacttctgctttgattgtaactttctgtaaaaaattacagcagtgcagaaggtctactggattatggcctccagttccatccatgttgctgcagaagctataattttattcttttgaatgttctttctggctgtaagtctctgatgttggcaagtgacagacccctatggccaatgaatcacaacttaaatgagtaccaagttcccagctgatatgtgaaaaggagctcagtgagaggaatcaatgattttatatcaatcatatggaaagaggtaaaagtgcatgcttcatgttatgttactttcttttgcttgagaatgctaaatttgtaaaactatataatatgacatacttgtgactgaattgtaagagattttatctaatattgctttagaatacagaagtaattgtttcaaaggataaaggatggaagattctgataaagcttgcttactttttgggggaaggcgtggggggaaatgtctcagtgcccaaggtcagtggccttcctgactgaagactttcccagagtagaggataagagtgggaacaggaagagcagtttaaagtcatcttcacaacattctggtgagtgactgattgcttcagcagcaaacaggcacatggtaaaaatattggtaatgtgaatttagtgttgttactgtcatttttttctttattaactatgattttgcttacagatagcagtcagagtagtagtatattgataataatgaacctcttagggttgctggtttggtgtttcaaagtttttcagttatccatattaaacttttaaagatatcttgtgtgaaaattcatttcaaattacatagaattaagatactatgttatttaggatagacaaattaagtgtgtttgtcatgattctataaattgatcttatttgctatcaaatattttaattcatgaatgtagtgtgataaaatttgttaaaaataataggcacacatattttcattgtatttaaattgcaatctggcctattcaaaattaacatagattgattttgaccaaagaggtctagaaagcaagaccttttgtaagagaagtggaaaacagagtcatttcttagtttcattccactaaccaagatgaagctgggtcacagattgctgtagacatttttaagtaactccgtggatccctctccttccacccacttttctctgctatattcacagataattctctacatatttatcgtttgggagggaaaatgactctccaagagttaacttcaattacacattggtgggcagtaactgtgctgagtgccagtcagaactgtatgtcaaaaatgccaccttctctcttattaatgctgacttagcaaaaacagagggaatttagggcaagtcagaattcttgtttcattgtcctattttcagtaagagaaggaatttaggacaacttagaattttttctcctgccctattttattgcacgtatgtttattcatattcagcaaaaagaatcccaattttagcctttgttgtcttcatgtccaaaaagtattttcccaattaatttaatttttttattttaaaattaatatatctggctaaagacattagaaaaattatatcaactgaacaaaatttttaaatgactcatagttccaccggcaaaggaataaactcggctttgagtaaactcttgaaatgttcctttgaaatatgcttaacctttaatgttcgtttgattgattgtgattctaatacatatataagtttgcttctttattattcatttttatatcacaaactcttttcattattataaattttatggtaataatatgttagataatttccaacctatggtaggaatgtccctagtttatttgacctttatgtggtaaacattcattgtcttttaaagtcttgtgtattacaatgatacgttatttctaatttttatctcccctccatttgtattaatttagcagaaaataaacttccagaaataaaatcaatttgtcaaattttaggaatatttataggctgaaatgtagagcatattgggatgcatatattggttggaatttagagagaagtaaaaataaaataaaaatgattctga

SEQ ID NO: 1328 - DNA, 837 bp, Homo sapiens
aaaccccattttggggttgtcagtgtcctcacttagtcattgatgtgacatgcttacctcatactcaatttgagttttgcagaactcccacacattgtgtgcccacagggattctgtgcttatggggcaacaagaatgctatgtgtgagtggaacaagtaaagaatggcagcagctatgcatgttatctgtatttcctctgttcatgcacatgctccattgtcccatcagccttcatttacaaaacaaaagttcaaagataaaattattaggaatttcattacggtgacaacagagcattaaatgaagtgccaggcctcaagcaccaagcccttcccagcatgggttgtatgcagctgtccagatcacatgcccatgaagctggccatggggaaaaaacttgatcctttattgtggtagaagcatagggcatgttggagatgcagtagacatgctggcatggctggttatagcaaggagtacataacatagctaacatgtattagacatgtattatgttttacgtactgtcctaaatatttcatacatcttttaaagtttgccagaggaccctgtgaaacagtattattatgtacttcattttccagatgttaaaaattaggaagatcaaataatctgctcaagctcaggcctgggtactgggtgacagagggtatactcttaaccagctcatcatgctacctgcatgcaacacaaggagttattggataggcacatgaggctggaaaaggtagaagattctgaggccctgggcgggaactagtaagccacaatctggaagagtcttttaccaccatgtggaggagaactagagcac

SEQ ID NO: 1329 - DNA, 1001 bp, Homo sapiens
cttctcctggccatggttgtgaggcctccccagctatgtggaactatgttgagaaggaacaacatgatctaagtctttagaaaccaagagccacgactagctgaggacacaagaattttcacaaaacaaagtagagtgattccatagatcactattatagctgcattaccagtcctaggacagaatatggatgctgaaaaatgattctttcaaagtgctgagttgttgcctcacgcccagttgtctggcatctcttcactgaaactattacagttagatctcatctctatgggtggaagatttttctctgttgcccaggctagagtgcagtggtgcgatctcagctcactgcgacctcctccaccagggttcaggggattctcatgcctcagcctccagagtagctgggattatgatcatgtgccaccacacctggcttatttttgtaattatagtagtgatggtgttttgccatgttggcccagctggtctcgaactcctgaactcaagtgatccaccctcctcggcctcccaaagtgctgggattataggcatgagccaccgtgcccagctgttttttactcactttttgtctcacagtcattaggcattcatttctgccattatgttgaaattgtcaatattaccaaagacctagttgccccaaacaatcaacacctctatgtttatattaattgataattctatatttttcactattaacctaccatagtatccactcctataaacttcccttttcattgtttttttgtaaatacagatcaactttgctatcctcttacatctgtgcctgcttctttgtctatctcctttgagatctttctttttactgagagcaaaatttgtcctagtttcccaatgtttctctccaaaccttttttttttttttttttgagacagagccttgctttgtcgcccaggctgtagtgcagtggcacaatcttggctcactgcgacgacctctgctccccagttttttt

SEQ ID NO: 1330 - DNA, 531 bp, Homo sapiens
acagcaaatatcttccactgagatcgtgtggttttaatcatacaaggagagtggcagaagaacagaaagattgaaaccaaggacagagaacacctgaaattgcttcagggtcatatgtcacagcgctgggcatttcatttgggtatctatcatcattcccattctgcaatgaggaaatgctgtcagagtgattaagtaatttgcccatggtctcacatagaagcctgtcttctccagggaacacagcactcagaatcgtctcggcccctgcataagcctgcatgagcctgggctctggggacccatcctggtgcatcattcgttggctctgtgacaatgggcacatcgtttaacctctcttggcttcattctccttactggaatgatggagagagttttgcctatttcagaggcttgctcttctatacgtgagcctataagtaacttgtcttaagaatttccactccttctgtactctgatttaaatttgaaggcatcaaaacaaaaacaatcaagatttcagattccaaa

SEQ ID NO: 1331 - DNA, 867 bp, Homo sapiens
aagccgccaccgccgccgctgctgcatggcactaggctcccggcggggcaggttccgcagccggcaccgctctggctaggcgcacggaggcgccttgcttagtctgacccttatttggccaggcgtaaaacttgtcctgcctaaaagcctactgagacctcctaactggtctaatccgcgggagacgccaaaggcggcggccgtttgtgcgcacaggatttttcttggagctgtagcagtctaggaagccagggtggaacttttgctaagctcccgttgtaagcccagagctgtaataactgctgagacacaaccagcagtatacaggctccagttggaaatcgagaactttccagggctgtcacccaggctggagtgcagtggtgccatcacagctcactgcagcctcgacctcctaggctaaagtgatcctcccaactcagcctcccgtagctgggactacaggaatgtgccacgcccaggtctatccagctgaagtcaaaaatgcccctctcaggctgcccccagtgactccagtttcctagcagagcctaaccaggttaagaaatttgtccatgggtgcctgaaccgaaagtcatatttctttttaccacaatgtgctgccttagaggaacaattgcatacaatgggatcaagtgcattgtaggctctatttataacatgcatatgagaaagagagcccattgagatctgcctcaagctgaagatgaaaagggggcctctggagtcgcttgatcgagcagagtctgatagagttatcaggcttttgcagatagaatgcctaccaccgtaggatacattgtcataatcagtgtttaggcaaaacacctggacttctgcaaggac

SEQ ID NO: 1332 - DNA, 328 bp, Homo sapiens
tcacccaggtgcaagcccagaggcagtctataccccaactcaactggctggtcctcaatgctgcctgcttccgtgcccaacttagaactacacatctgctgcctcttggtaacatgtcattataagtctgaagattgccatttgaaatgctctttgagggatgcgaagtcaaccctggatccaaagtagctttgatgtttgtcaggaaaatgctggaattctatacactacagtttctacagagcatgaagaactccaacttcagacaacctgcaaaaaaagtcagagagcaattaaatataaaaataaattcctttgataaaacaaa

SEQ ID NO: 1333 - DNA, 1432 bp, Homo sapiens
gcatgcgcggtctgcctcccgcggcgggccgggtctccagggaggacctgagttttcttcacccatggtcagggaagcgccatcgccctggctttgaggctggggcctccggggaggttccggtaggggctttgaagaggccgctgtttttgcaaggccgagacggcgggccctgcgcaggccgccctattccgcgccctcagggcgtcagtatccgcctgaggccggataccccctctgggcccggatgcccccgctggccccggagcatcctcggcgctgccctcccagagccccgcagaggctgaggtggcgcgggggcggccccggctccgcgagaagcggcggcagcgagggctggaggacccgggctacggggctccggggcgtctggcctggttgggactgagcccatccagggactgggactctgggattctggtgtaggtggatccggggcaggctcaggaccaagtccctctccttccaccaaggagcgcccagaggccggcgggagctccaggttcacctcctcctcctccaggaaatctcacttccaactggatgtctggatgaactactgaaagctgctgagtgtcctgcagcagcttgactaccacacaaatgaatccactcaaatgttggcaagtggagcagagtcccaggacaggtacagaaacacccccagttcaaggatcttcacacctggatttaggcctactcctgcaactaccccagaacctggaatttatatgttcaacatggagccatcccagccatgacaacagagaatgtaccactctcacggggtaatatcgagttccagaaggcaaggattaacattcagaaaaataggaaaaacaacctgcagagttactatgaattattatattgtggctacttacaccaagatgaagataatttattagttcaggaagaacctgcattctgaaggcaaatggaagttccagctacagatgggcagacacatgccccctcaattcctgatggacctccttgtgcctcatggacctaaggggcctccctcaatgtttcaagatgccaccaaggcagggatcagctagtgcattcctgagaacatccaggatgaattgaggctctggaaaaatgcaagagtttccacataatcccaaaaaaccctacaggtgaactggatgccacagaaagaggagtggtctttgtcacaacaaaatcaacaaaattatttcgaagtcaattaggaaactcagaaatcactcttgctgccattaagaggaagaacagcagcctgtgaatggcatccctggccttcccgagactccacagatatttctatgtggcttcagacaccagaaatctctgtgattttcagaaaggcagggacagctcatgcaagcccatccctctgcagaatgtgtcccagcagatcagt

SEQ ID NO: 1334 - DNA, 548 bp, Homo sapiens
tagccacagggttctttagaggccactttcttcaagtctctaattttgcatatgagaaacactaagactcagcagataaggatggaggcgactcaacatcacactgagacaggtcatctgggacccatggtttctaacttctagaccgaatctctttctttcgaatgtccagatcatctctccttcttctaaaaaccaaagaggcctctgcatgcctctccctggatatgagccctgcatttctgaatgccttgaaagaaaaaccagcaagttgggagggccgtgtctccttatcatcttccaggaattcaaaaccgtgatttccagtttccaaatgcaactcaagctccatcaccctgtacatcttgcacggtttctccagcatatcctgatcgccacctccagacccttctgatagattcattacctgaatctatttgatcctgaactcctgctctcccttggctcaacctcatcacagccagaaaggatgagagctctttaatgaagtgcatacatgtcagtttcccaggacacaaaccaaagta

SEQ ID NO: 1335 - DNA, 697 bp, Homo sapiens
aaccactctggaatatgagaagtgctctgagccagggaagaagtacctgctcctcctacaaggcccagcagtatcagcgacagattatgcttttgcaaaactaggtttacaatatcacgaatagtttgcgggcggagaatatttccacagaacaggaaggatgatttcttcagacagacaaagctttgctggagcgtttctgccgtcaacagtcaagtggaggaaagacagtgacagtggataaactgcagaagctgctccaggatctgggagcacagcctcctgaccatgcagggagaggtgtcaggagaggccccgcaagacacccagaggagacccttcagttgtaaaggctgaggaggaacttccatctgggcttttctgaggatgagtgaactagctcatctagcaaccgggaattggtgtgcaacactggccaagtcctaaacctctctaagcctcagtttcatctcctatgagtggtactgggattctgatgaggttttaatgagtgaagaataagtacaatgcctggcacatggttctgcctttgtcacccacgctggagtacagtggctcgatcatgggccactgcaacctctgcctccagggctcaagctattctcccacctcagcctcctgagtagctgagactacaggcatgtgccaccacgcccagctaatttttgcatttttt

SEQ ID NO: 1336 - DNA, 439 bp, Homo sapiens
ttccccctcgacggacgtgcgctcgcctctgctgcctccacccgcggctgccttatgtaacctgcgaggaaagccccgcgcccgcgttcgttggggcaagcgggatgggctccctcccgcccttaagtctgtcctgtcggggctgacccgcaagaaagcactctttcacagccgctgagggaatcctctccacagcccaggaaggctggaatcagtgatttccttatatgatggacaaggagactgaggctcagagaggtggagcgtatgtcccaaagtcccaagctgcactgagctcctagatgctgtgacccaccctgcacgcctgacacatggaccgacttgaatgcccaggagtggacctgcctgggggccataagggatacatacaactaaatgcagcagagataatcctaataaaagtttttaatgtactgga

SEQ ID NO: 1337 - DNA, 519 bp, Homo sapiens
aggttgggggctggggacatgccaggccaggacctgcaacagaaaccgccgccccacctttcctttctgtgccccaccccatcctgcctaaaaagttgctttccatgagggcttggtgctgagtgtggcccccacagggatgtctgtgtggtcacagagtacctgtgggagggcaattctgaccccaaggtaggaagcagtgatccggtaattccaggcaccaaggcagataaaaagaccaagccacagcctcctcaagaagtttgaagtctgcattgaactcattaatttccagcttttggccgggcgtggtggctcatgactataattccagcactttaggaggccaagatggggcccatgagtgaggaggacaagagagaaaggagaagtttgggtgtaaatcccagagattgttcatcatgtgagaggagccgtgcatgcatttcatgccatactcacaccatggatggagaaaaaaaatcaagcttcactttctgagaatggccctgggggcac

SEQ ID NO: 1338 - DNA, 3047 bp, Homo sapiens
actcctcggcgcaccgccccgcgaccgagctccgccctcatctgcgcggcccctcaccttcccgccgggcctcctcgaggaactggccgccgtcagtcagggcgcagatggccgcagaagcgcgccgcagacactcgccgcgccagccacttacccccagaggagaggggtctctcccgccacctcagcctctctggtagtggaagaagccgccggtccagatccctcctgcctgtgggaccgctgtttccctggcaaccagatgcgcgatgcttccggtctcgcgatagcggaaagggctgtaccatccggaaatgggaccggggccggcggctgttggagccctgcgagctgggacggccggcgtgtgtccttccgtcttcgctgccgacggtgggggttgggagcgatttttcgtctttaggttggattcggaacgcggacgtctggatgcttgtgtatctctgtccctcatattgctgtgatgccttacaggtcagttatcctctccgagcacagtttcctcctccgtaaaatgggaacaataataattcccttcttacaagacttgtgcagctcaaaaagaccatgtatgtgaagctctagtaaatttggggtgctatggaaattttaaaaatatgagttttgcacagattcggctacagtccaaaaagagttataattgctttttgcaccttctttcatttcgtagtttctctaattctcagtgcacgaaaattatttccctacgtccacaaactgattttcctcacctccattgccatcatttctcctgctttccagtctgaacagcacattaccgtttacagggcattttcacattcatggcccctttgtcctcattgttttaactaggtacgatgtggttttttttcagcgaagcaaatagtcgtaggctgagttgccgaaagaacacagctgcagtctaggcgagtgctgggtataaaaacctggctataaatgccatccctatgctcctgaatcctgcatcttatcaccagcccagacttccctgaactccagactcctttacctaactgcctatttggcatatccacttagatgtgtaagcatctcaaacttaacacgggaaaaaacaacttctccagagtcccccacccactttctatccatctcagcaaatggtaatttcagcctgccatgcctagaccaaaaaccttggagtcatcctcaattcttcttcctctctcactctacaatctatttgtcctatcagctcaacattcaaaatatattcagaatccaaacattcgtcacaacttcagtgcttccattcaggttcatactgacatcatctctaaatgataaggctttctgttggctctctgacctccactcctacctactgctttcccctggtaaacctggttccagcctcactgtcctcattgttagtgtttctgtgcagggatttcttcccagcatttctcagggaatttatgtggctttccaaatctcaaaagaaaaaaagttgcaaactgaagaaaatgggagaaagtatcctaatcctcctatgagaattaaaacttagcagccgacctagagatgttactgaagaaattcaccaatgtcaagttgaaaaccagcacaggaaatgctgagttcgaggttgaggtgaacattttcaggaaccaggtcaggagcacttgggagagacatggccacaatctcatcagtcagtcttgtttgtagttggtgccatgaaagcctatgttcctggccctgtgtgccgctggcagtgagtcattcttgcaaataaaatataaataggttgatactcattgtatactttatacaaattctatgagcagtgttcaaaaaagtaacgggttttggattcaaagtaaatccttaaattgacagtttccaacccatgattctgggtagtacagttaaccctgctaggagatctattatttgaatactcctcaataatgttctctgtgttttccagcatttgaatatttgctataaaccccacttcttgtaaacacttctaaatttaatagttctcattttttaaacaaaggcttcagatacttgtaataatgagtaaagaatatgaagaaggtagagaatattttaagaataagattttgagaacagctggtaattctgatttcctgtttctgcatcccaaagatcagtatctgtcaggaatttggaaacacttgttgttcctccagtccaaatacacacacacacacaccagcctgaaatacagtttcccagctatccacctggtttgctcctctctttcctcaggcgtccgcttcctcaggagggcctttcccaaccaccctgtataaaataattatccccatctccacactccctaccctctgtcccctcaaccctgctttatttttttatgaagaagagagatgacattatttggattttgatattaaacagctaggttatcttaggtaaatacataagcttttgtgggccacagtttcttcatttgaaaaatgaagttggactagttttgcagtgcttaactgcacagagcattagaatcacctggggagacttcataaactacacaaccaggggtgtacctgagatcaaatgaatctaggccttctcaactttaatgtgcagacaaatcaccgaggaatcttgttaaaaatgctgattcaaaaaaaaaaatgttgattcagtatcaggtgagacctgagactaacaggctcctagatgatgccaatgctccccgtccaccgaccgctgtttacctagcggcaagacgagatcattgccaagtgcctgcacggttctcatacaccataaacgaaggccattctttccagtttttaatttggtgactaatagtgtccactaagaaaacaataccttcccaatttctcggggggggaaggggctgaactaagaaaaagcggacctatgattactgctgttttcatttttttaactgttgtttttaaaatgcaacataagatgcatataaagcaagtgaaaataaaattcgggttccacgtaaa

SEQ ID NO: 1339 - DNA, 345 bp, Homo sapiens
tgaggatgaggaacatggtgttgcagttcaaaccagttccagccaaaatggactctagtcacaaacaaatagtaataacaatccaaacttgtggctgaatagagttctgaagttttgagaaagagaaattttagagacacagacaaagggaaataaggccatgtggtggaggcagagattggagttatgcagccacaagccaaagaaggccaagaattgccaacaactaccggaagctagaagtgacaaggaagcattcttccctagagcccttggagagatcgtggccctgcaacatcttaaagttaggacttccagcttccagaaatgtgagagaataaattt

SEQ ID NO: 1340 - DNA, 388 bp, Homo sapiens
atttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctgtaagtggagtttttctgtttgcttagagatcagtgaatattgtgtccttggtcttatctgtgatgatcttatcccgaacctgaacttctgttga

SEQ ID NO: 1341 - DNA, 790 bp, Homo sapiens
ggccgaggcccgtcctgccccgcgcggcgggagtggttggagccggagggcggatctgtgcctggccgagggtgtccgtcggcgtcactcaccgtcctcggcccgcctctgcgtccactaggagcggcctgaaagaggcccgcacgcgggctcgagccgcgtggaatgcacctagagctgcattccatgtattccttggcttttcgtcctttcctccatcatcaagtaactggatctgtgagcatgatgaactttgttttcctgagcttgtcctgtgtctcctcttctggccacacctgactgagcagaacataaaagcgacagaacaccaggagggctgctgcttggggaaattgtgtgagaagagtcctgggggactaggggcagggcaagcactgctctccctctcctggaggctggggagagcatcaaggagactaccaggtaggaggaaccatgggcagggcctccctcatcaggatgctttccccacaacagagggatttaagcccctggtgggtgagtcctggattaaccaagacctgagccttttggggggtgcagaggacagaggacactgtgaggtgagtttctcctgggtggattccccaggggcctctgaggctggtttcaggccctgccctttggctgccccactggaagctctgagcatctacccttcagggacgctttccctggtctgaccttggcaagggcaaataagaggtactccatggagggtcaccaaggtctggggcgtaaacggtgcccatctgcacagtagcatgag

SEQ ID NO: 1342 - DNA, 976 bp, Homo sapiens
tcagacgtccgtgtgtccagccatcaaaagtgacctgaaaagcagcattgacagtgaccaggtgctcaggaagtttatgcttgtaagacccaatgactccccaccaagaatcctaccagtttccttggaacctttgctcatgaccattcaagatgagcattacacactggcgaaagagatctgcatctggggccttcaactgagcaacccagagattgccagacttgctttgcttctggaattgaaggggcacaccacctgcccgtttaccaccctagaaatcattgattgcaagatggatctgtggtctctagagcgacttgggaaggctctgcggttcagtagtttgcattctcttgtcctcgattactgcaaatttggaaatgaagaacttgagagcattttctcaggcctggagaacaaccaaaggcttcaaggcctcagtctgcgttactgtggtctgggacctcagagcgggctaaggctgggttcggtcatcagccagagtgccatttgcgagctgttccttgatggcaattacttggaatgttccggagcactggctcttctcaggcccatagcaggctttgcggagacacagggggaagaccagccagccccaggctcaccagacactggaaatccccctcagcggctccaagccaaacagagaggaagttcaactatgaaccagattacaaaatcgtctgaagctgtaacagtgaaaactacttcagggaagaaaaagagaaaaaaaggaatcaagaagaaaattgaaggtctgatggaaagtggtccttggttagtgaagttgcattaggcagataatggcatagatggaaaaggaagagaaggagaaaatggtttattggaattcattcaaactttaacatgcctgatcaaatactctgcctacttaagggaaattgaccttggaaacaatgttctgggagaaatggctgctgctaacatactt

SEQ ID NO: 1343 - DNA, 334 bp, Homo sapiens
agattaaaaggagcccaagccccatctcatcctagcacaccctcctccactgtcctggcagtagcagtccctgcactaggtcagacaatcccctttggggtacaggaaacaaagcaggaggagtttgaggtccctacactgcagcagaagaagaggaaggagtggggcctgaattgaccataaaggatgtaggggccacgttgttccactgtaatgtcaaggagggggtggccattgtttgtcccagcctggggctccccctctggtttcctatttgtagttactagaatgaaaaaaaaacatgatagataaataaataatccactggcagaga

SEQ ID NO: 1344 - DNA, 2737 bp, Homo sapiens
acccacgcggcgcagctcccaaagttgcagacagcccggcgaaccgcgcaatgcgcttcttctgcctgcagcagagaaaaggaaagaaaactccgcaggggctccgttggcttctccacgagtgacaaccatgttttcccagatagaagaccggagccctgctcctttgcgatccgccgagggctgcagagagcatcctcatccatttgggcacccctgcccaggaagagcccggccatccctttccggactggatccttaagaggtgaattttcttccgtggattccgatttgctccgtctgaccagcctaggcaatccagcatcgcgtggtaccagtgccgctgggcacactggcttcacgccggctccgcctcaccagcaagcgcattcccaggtggtcaggctcaggatggaccatgagctttcaaaaaggaaaaaggtggaaatcctcaactatgctgccatctgaataagtgtttctttgtagatgcacagagtcaaggaaaattacatccctgcattatgtaatgtaccaacaacgcacttacccactgttttaatctaggttattcttgaaagcagagcctgagacaaaggtagacacattctatttatgagtctaacacccaggagcaggaatgagagataggggagtgaactggggaaaagggaaactaagtccgagcaaaaccagatactgctcttatcaagtggtccacccctattaatggctacataatgcagaactttctcaggattcttcttaaactttatctcagaactgtctgcctcagggagaaaggagaagtatttctccatcagcagccacctcctgtgtgttgagggctgctcctttggggcattaacccactgcctccaccaccccaaccctctgggctgcaaagagctagctgacagtccagctggtaccttagcatcacacattgctgcatcagagaggtcttaagacaggaagctagagtcttggtgcatgctcgaagtgagacggtgtcagcacagagcagggtaaaatcttcccgttaactcttcaccagagctatgactggaatcagaggttgaaaagatgtgagactgtacccaagaagcatcttataagcctacgtaatatactgttagactcatcgaaatctatttcctcccttctttataatcaaaacttcagtgtccagaataaagttggcagaagggttaaattggaaagttaaatgtactagaaggtgtacatttataagttttgaccttgagtcgtgttcaaggagaaagtgacattggaacttggaaaatttaaaaatgattctacttgaaaaatttgaccattgcatagaaatattagctatcgtctaatcttttgtaatcttagaaacaatcgtgaattgtttggtgaaaaatgaaaaaataaccatttcttatgtctccgtgacctttatagaccaatgtcaccaacttttcctaaggtaattgtttcctactgtcaaatagctctagtgatataaatcttaacaatcaatgaagggaaaactggtggaaacataggaggaaaaatactgggataattttcatcacaaagtattggcattaacattggttagaataggggagaaactgcatgacttgacaactggacattcctgtatgttgtatgaggccctgtcttaacagaaatagtgatgtcatcatcatcctctcttatttggtcttgaattgccaccaatcggataaaacctttgaattatttaactcaatatatgttaagtttctactatgtgctgtgtattggtactataaatatgaataagacataagatattacattcaaaaacatcagaatacatgttcttttaaagtataccccaaaacatttaccatgtgttctggggcgcatgttaggctggatcacaaatcaagtctcaagaatttcaaaagattgaaatcatatagagtatgaattaaaccagaaatcaagtacataaaggtaacaaaaaatttccaaaatgcattaatttaaggaacatacacctcatgacccatgagccaaaaaataaatcacggcaaaattgcaaaaatattttgaaatgaattttaaagaaaatacttagcatattaaatacttagcatattaaagctctaagtacatatgttagaaattttaccgaaaggttggctatcagtgtttccagaagccagggaaaaagtttatacaatttgatcgctgaggcagggaaacaaagtgagacctccgatcgccctgcctttctgaggtgagcactctggatcccatcgcaggagatcagagtcttgctgagttgaggagaggaagattggagttgatactgagatagcttgaattttcaggacaaagtatcaacaaggaggaaggtagacaaaaaaatccagaaatctatgtagagaccccattgtgtacattgcggaacactaagcctaacaattctcaaaattagcgtgagattgggaaatatctaatttccatccagccacagtggagagtcctgactgaaaaccaggcattcgctaaagatcccagaaaggttgtgtgttacatacgtagggctaaactatcctgactaaaaactacactacacttgctcctcacccccacaaaaagcttaaaaacaagcctcaatagtataaagctgatctgtaagtaactaaactacctgcagaacaaagtccaaatttattagttccagtactcc

SEQ ID NO: 1345 - DNA, 489 bp, Homo sapiens
gtttccaaggaagactaagaaaactgcaaaattaaagtgcactgcaacatgaaatgctgctggtggccaggcgagatcgtggtgtcaaaaaggcaagatggaatctcacgctatcacccaggatggagcgcaggggtgtgatcatagcttactgcagcctccacatcctgggctcaagagattcttccatctcaacctcccagattactgggattataggtatgaaccactgcatctggcctggagagacattttttaaagagaaaaatcaattgctgagggctttggatatactacatatgctattatctgtaaatggatgattttctgtgttatacatattattttagaatcaaaataagtctggccaataactgcactcaattctcttgcctcataaatgtaacatgtccaaaactgaacttttgttttctgccacaaaaacctgttccttcttcagcacatgacattgctattcacccagacatc

SEQ ID NO: 1346 - DNA, 708 bp, Homo sapiens
agcgttgcggctcgaggcaaagctggtcctgtgcctgctgtccattgccgctaaggcctgctgctgccattcaggcgtgtctctctctctctctctctttcatgccgctctctccaccccatcttgggacggccagctctaagaattcctgctacgacactgaattcaaccaggaggtgatgccacactcaatcagaaactatgctactgctgaagaggtatattgagccctgcctggttaacctccagtgaggttattagagaattgggagaggctcaaatcagcatcctgcacctagttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggattatgaagtattaattcttccactgatatctcaaaaggtgatctggacaaaggaacaggtatctcagattcccagttctcaatcttccttcctccttacaagatacaagcaaccttcaaccttccca

SEQ ID NO: 1347 - DNA, 356 bp, Homo sapiens
cccaactccagctgcctcacagccctacacatccaaggcttgctttaaatctcctaagtcctgaagaaaatgaagacagaaagaacagcacctactttcaaggaaaaggaggccacgcccctcagcggcttcaggagcccagacctttgggggcccaccttccgcagctttccattggccccacggtggaagcccgtaggttcaggccctccgaacacagctcgctttccacaccagcggggccgtaccagagcaagaccatgtctcacaaaataataataatacttaaaaaatggtaaattttatgttatgtatattttccacactataaataaatatttgtgcatgtatatata

SEQ ID NO: 1348 - DNA, 528 bp, Homo sapiens
aggtaagtgctgatgctgctgctttgagggccacacaccttgaggagtaggaagagtactcatactggaagagtattcagcacggactggaatcctgcatacatatctgagctctgtgttctgtagagatggggtttcaccatgttgcccaggctggtctcaaactcctgagctcaggccatctgcccgcctcggcctcccaaagtgctaggattacagaaggtgcctgcttccccttcaccttccaccatgattgtaagtttcctgaggcctccccagacatgtggaactgtgagtcaattaaatctcttttctttataaattacccagtctcaggtagtatctttatagcggtataaaaacagactaatacaaacaggtagctctaaattgtgagtttttcttaactcctttgatcttctgtgatagcgatttttcacatttcacacttccctaatgccaaaaatccacctccagcagctgttttgcctctttcttatcctgccccttggaagaatgtcatcatta

SEQ ID NO: 1349 - DNA, 544 bp, Homo sapiens
cctgagttgggtcgatgatgagaaccttatattatcctgaagagaggtgatgacttaaaaatcatgctcaataggattacgctgaggcccagtctaggtgagagttttggaagaggatgctgggatcctgaggtcccctggtagagccaattgtattttgggctggagacctggaagccctgaagggcatctgggaggcccaaccctgtctctgtgctcctccatgaggcagccctggctccccatgtaggcttggtgatggccttcctgttccctgggggtggggcacatgggtagctcctccctgacccccattctctcctgtgtctttcagtgagctcttccccacaggtgggccccctggcattgactagcatcgtgagctcttctgcccagcagcctccctggcagtgaccagcatagatgctgaccctggaggaagaattgcactgggcccactggccccgggaaaatgtccctcagccaggtgcttagcccctggtaatctgaagctcaggcccttcctgatgccctggtctcctgc

SEQ ID NO: 1350 - DNA, 623 bp, Homo sapiens
acgtggaacctggttctagggtgtccacaatctccacagaggcggcattgggtcaccgctggaggatgcagcaggagggaggacccgtgaggagcgccccctgtaggaccggaaccctggagggttcgcggcaagggtctccggggcataggaaacgggcatcccccaagggtagtctgagttccgcccagccccattcctggatgctcacgccgtctcccctaaactcccactgcgctcaccgggagcccatctcatcatcaccacagcccgtggctaatgggccaaaacagaagaagaaaagcaactggcggagtacaacgcgcctgcgcattatcagactcagggacaggctggaacctcgccccgtaagtaggccatttaatgacgcgcaaactgggaaggcctatgactgttgaagaggataatcagaagccaacccctacgggtccccggtagctcgccgtgatcgtatagtggttagtactctgcgttgtggccgcagcaacctcggttcgaatccgagtcacggcattgtgggaacaatggcacggcaaggggctcggtatttttttccccttttttgtaacattttatataaatcgtaattcactttcttgaaa

SEQ ID NO: 1351 - DNA, 461 bp, Homo sapiens
agataatgtttatcgatgagaaaacagaaatttgaagaggcaaagcaagttgcccaaggccaagggagaaggtcagcgtgaactgctaccgccatgttgaagttcatcttctcttcactgcgagaagctgcctggacaccagggtggaggagctgtcagggccctcactgtggaaggaaggtccacagaaaacatcctggggtcctgagctgaagtgtgatgggaggagtcctctgtatctcagtctgatcctggtctccctctcggccatggtctcacactagtgctgctgggaaaccatccctcacatccagtcctggcatcgggcagtgactctggtccaactgttgtccaactcaagggtttagctgcttagattttcctaaaacttgaatttcattttcctctagccatggaatacagattaatcctttacaattaaaatccaagttcagatttta

SEQ ID NO: 1352 - DNA, 826 bp, Homo sapiens
aaaggtggaggcggaagtgactgatcaattcaggggcgtggggttcgtttaggttttgccctgtgtatgacctcgtttggagccatgaaaccagcctcaagctttattctaggaaggtaattctgaagatacctatcttcttgagagtgaaattttatggaatcctagatttctcatacctaggaataacaatgagcaaagcagaccttggtggccagaggggagccctcaggtagagctgcagatgctggcagtttgtgttagaaggttccggggctaaacagatgcctagaattagccaccaaaaggtaaattgtagactccactcttcaagaagcagcagaaggattaggaattcaaacagtgctattttacggtggcttttctacaatataaagatggaaatgggaagaagatgttcattgcaaattaaggaagctcttccacgagttcacgaatggaaataacatcaagagtttttcatcttcttagtgtgcaaggttaaaatgaataatgaaaggaaagggagagcgtctctctttacaatgctggaacagatgtcttgagtctgcctcctgatgacttaatttatgtcatgtgctcagccctaaaccaatccctgtggcagaagtgaagtggctgtgaaaagaactgggggtagtattgagaagaaaagtagaaaatgacaggtcaaaatataacaaatgtccgctaccaaaaataatgttttcctgtcaatttttaagcatgtgtgtatggtttcaatgtattattaaaagtatgtgtgtgtatacatatacatataagaatctaatgtattctatat

SEQ ID NO: 1353 - DNA, 722 bp, Homo sapiens
gggttccgcttgactctgcattctcctacttccctgcctgcttactctctgccatcatagttttttgcttcaaccttcaaatgtagccattctttttctaaagcggtacttattctctttattagttaaaattattaattttatgcacttactgttctagctccaattttgcatttccagttccctgctgggaataaattaaattggcagaagctcagtctaagtgcctgcaacagaatttgtcccatatccatacaacttgctcctccacaacaaatgggagaatcatcctcttacctccaggttgtacaggaaacagctggggaggcctcaggaaacttacaatcatggcacaaggtgaagaggaaggagttacgttttgcacggccagagaagtaggaagagcgtaaagtgggaggtgctacacatttttggacaactagatctcgtgagaactcaatatcacaagaacagcaaggggaaaatccacgcccatgatccagtcacctcccaccaggtccctcttccaacactggggattaaaattcaacatgagattcaagaggagacacaaatccaaaccatatcaaggtctctgctgaatatgctgttattcacttaacattcatgacaagtctaccagcatcataaaagtcacgacgactcacaagaaaatcaaatttacatttttgccactaccatgttcattgagaagggtaaaa

SEQ ID NO: 1354 - DNA, 2105 bp, Homo sapiens
ttcaagagcagcctggccaacatggtgaaaccctgtctctactaaaaatacaaaagttagcctgttgtggtggcgcgcacctgtaatcccagctactcgggtggctgaggcaggagaatcgcttgaacccaggaggcggagggtgcagtgagccgggatcacgccactgcacttcagcctgggtgacagagtgtgactccatctcaagaaaaacgagggagattagaaacctatgatcaggcattggctgaaacaaatggtaaattcttttggcagccttgagcttccccaggcagggacccaaaggggcctgggttatccctgagacagggccttgagctgctagaaactatgctagtgtttgttcaagtctctccgtgtccggggtgagcaaaattgtttgtgctgaaaatcaatgatttgcagctctcaagattccagtgggcagtctgggtgggcctgagtttctgctttttttttttctttatgtacagggtcttgctctgtcacctaggctagagtgtaattagtggccccagtcatggctcactgcagctgcaaactggctgcaagctgttctggctcagcctaccaagttactgggcttacaggtggatgccaccgtacccaacagattttatttttgtagggatgggggtctccctgtattgcccaggctggtctcaaactcctggcctcccaaagtgtttagattacaggtgtaagccaccacacgtggccagcctctgcatttctaacaggttccaggtgatcttgatgttctgctggtccatgggtcacactttgagaagcatggttctaaaggactatacagattaaagtcattaatctctgtgggctttggacttgaagtttcagcagcctttgacaagcatttgcaggtttcctttttatttatttgataaactgagaatccacatgcaaagaaatgcaagaaaattcaaagaacgtaagaaaatgtccttgctgtaaagctggtggttctcaatctcggatacacagtagaatcacctggtgcgggggttgggggcggggtgcagtgtaaaaattattaaatcagaatctctggggtaggccccaagcaacttttttttttttttttttagatagaatcttgcttgtcacctaggctagagtgcagtaatgcaatcatggctcactgctgccttaacttctgggctcaagtgatatcctcccacctcagcctccctagtagctgggactacaggcgtggactaccacacccaacaaatttttaaattttttgtagaggcaagctcttatactatcttgcacaggctggtctcgaactcctgggctcaagcagtcatcctgcctcagccttccaaagctcagggattacagacatgagccacagcaccaggccaacaatatttcttaaagctcctggagtgattccaatatgcagccaaggttgaaaaccaccctttaaaaggctcggcatccagtgtggaagaccagcacactcacgtcaggagaccttacctggagccaggatgcccctgatcatctctgataactttaaaaggaaggcctcagaagcagccccagaagcaaaagtttctctctgaccttctcctgccctcttgtttctggcttttcattctcccccaaggctacccatagaaactagaatccctcttccccaaggcaggtcatcagaaaccagaaccggttttacccaaagccagccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgctttttctcctgtt

SEQ ID NO: 1355 - DNA, 1163 bp, Homo sapiens
ctctttttgcctgctgccattccagtaggatgtgacttgcttctcctggccatggttgtgaggcctccccagctatgtggaactatgttgagaaggaacaacatgatctaagtctttagaaaccaagagccacgactagctgaggacacaagaattttcacaaaacaaagtagagtgattccatagatcactattatagctgcattaccagtcctaggacagaatatggatgctgaaaaatgattctttcaaagtgctgagttgttgcctcacgcccagttgtctggcatctcttcactgaaactattacagttagatctcatctctatgggtggaaggttgttgttctcaactcagcaggaaatgtcttatgaagaaaatggcccctgctccttaggtagcaggccataggcaaatactgaccctcttgccttctgaagctaagctccagcttcagtatgcacttgcttacctccttcccctgtccacactgcttttacttgctccctgtctcctgagagcattcattaataaattgcacacatttgaatccctatctcaggtattgctcatagagagtccaacttaagaaaaactgcaatccttatttatattctgtttcattaagagatgtaattgtgaaagaactgaacatataaaaaaatcagctttatcatgttttttatccttgtcacgccatgtcacctgagcaacacagtctgaatactaaattgtgagtgtgagtgcatatatgtgatggtaggtttttgtcctgttttcaatcattcataaaaccaaacatgtgtcccttaattatgctctactacatccacaacttattttattcataaaaatattgtggggtagatattatcactgttttcttgatggggaaatttaatataaaaaagttaaatattccctccaagggcataacatttttaattggtatagtcatgattcaaatttatatcttctaactataaggccagtgtgaatggtactccactacagtagactatccttagtggcttctactttttgccttgtattccgtcatgcttgtagtacctactttctttttctgaaaatttctcctccttctactccaaaaatattgttccctatgaaaactgatattttgcattgtatctccaaactcc

SEQ ID NO: 1356 - DNA, 596 bp, Homo sapiens
gaaaatatatgggctgaatgtctttctatttgctctttaaagaccttgcacaaataatgatgatgactgggatttttttttcatggaaaaaaaaaaaacagaaatggtgagggtacctggagaggccaaggtgaaggcattacttcttaatttattgatactgagttgcatccaccccagggagctggtgctgcctatcctccgaggaccaaaacagctggaggctaaagcagctaatagcagaggcacctgtggctatagaggctgtttgaaccctgggctctggcagtaagcactgcactgatctggaaggaaaagacatggggcaggactgagactctgctgggaaagcatcaatgatttagttaagaagaactaaaacagcgaattccataatgggaggttttgcctatgactttcttctagggtgtaagttggttccgcatcataatgtaattatatatttttcacttttttaattgacagataacattttatgtttttatcatgtacaacatgatgttttgaagtacatatacaaaatgcaaaggttaaatctagctcatcaacaaatgaactcacacagttatcacttt

SEQ ID NO: 1357 - DNA, 494 bp, Homo sapiens
aaagtaacattttaatgtggagcttagtaatcgcctagaatgaatggcgatatacagtttactgcaccctccaatgcgcaaaagaggcaggatggcaaaattcatgactatcttaagcaagccaggagactgctaaaaagccaccccggcttttcctcctccaccagctgaggcacccggtctcccggtttccacacgcgttcagagacacaaactcacccgccgctgaggaaacggtactgccttcgcgaccttctgggatccaggttacgagtgcgctccactggttcgagatttctgcccgtcgctcgccagggagactgagtgcccaagcgcctactcgcacaggccgcaaatacagccgcgctgcgcggcgagctgatggaggtcttcctcttgcccggcgtgcactgcggccgggggcggggagcgcggaaccatagagaagaacgtatatagatcgtctccgctgttggctctgactcaccaagccg

SEQ ID NO: 1358 - DNA, 427 bp, Homo sapiens
ttgccctcaaggacatgcataaaaagctaacggggcatggcaacatacagaaaaatgaagcaagcaggaaaagagcagatctacccactgggtctggagacctggatggcagtggaggctcagccagcaagccaagacacattgttcaagatagttaagacagttctacctataattcagacagccaggcatctatggtgtaggagtgaggcaatgtagaaggagagaatcaaggaagaagtttagagtcagatcatcccagcttactaataagcaagaagtcagcccatctgcccattaccctgcaacagtccccacggcatcctctctgtccttaaataaatagatccaaggcaagatgaatgaatgggttcagggaaagataaatatctccagaaaaatgcaataaagagaaattttgagccaa

SEQ ID NO: 1359 - DNA, 443 bp, Homo sapiens
ggtgaatggattgtgtatgggcgtgagagtaaaactttacaaggtcgagagtcatacaaaagccaaagccgcattaaagccagtcccagccaggcttaaggagagctggaatggagaggattctcatctaacatctgggttgcagttgtatgttaacatggacttcctaggaagtaacatatcaaacaaaagggaaagtgatcaaccagcagcaggtaccagccacagttaactgcacctgctaggagctctgaaagactttttttttttttaaacgaataaagaaattctcatttcactctcctccacactggactcgctgaagaaagagctactctctgatgaagttggtggtgctgtggaagaggaccgccgcctcctggacgaggaccgggaccgctcagcattgtctgactgacaggaaaggacccagataagatcct

SEQ ID NO: 1360 - DNA, 7276 bp, Homo sapiens
ggagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcagatatcatctcttcttttgatcactgttcctgattgtgacattgtgcaagtgttaaattgtgtgccttttgttcctgaagaaagagatgtctcctactctttgtgttggataggtcctgggatctttgaaatgctaagattcttggataccacagtatcataaaattcctctaaatgcattggtgctagcaatcccctactctgtctggcctctggatctagcttgaagttctggattcatttccttcttccttgtacctcagcctgagccttctgtcacccaaagggctccagctggtttttcactcaggcctcactttatcttccaagatgaggaaactgaggtccagagaagttgaagttttcccaaggtcacacagcagagctggaactagagcttgcatttcctgacttccagattagtgttatttttacttcaaactattacttcttggtgagttattgtgggaaaaatcctgtatattgaagatgtctctacacagtatcgtttcctgtttaaattacagataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttatgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatagtttaccataattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagatttttcaccttgtaagtttggatcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgtttacacaataa

SEQ ID NO: 1361 - DNA, 521 bp, Homo sapiens
acttagttggaattcaccatgaactgcatctcgaggatcaagtttaggctccccagtccattgtgacatccagcaaagtggagccgggcgcccccagcatcccgtctgtctgacgctaaatggcgaggctctccaacccacttagctccaagctcaaccttctgcaaaagttcaaccttctgcaccactggggatatcgtgcagctcagacatggtcttgctctgttgcccaggctggagtgcagtggcatgatcatagcttactgcagcctcaaattcctgggctcaagtgatcctcccacctcagcctccagcatagctgagactacagacacatgccaccacacccaggtgtctgcatccgggctcttttttgtagttctggtctatgtacaagacaggaataatagagttggagaagaccctgagacgagcaactgaaacggtgaaggggacggaaagcaaggcgggatataagctatatataaaatgataactcttcatattaaaactggctaaag

SEQ ID NO: 1362 - DNA, 3563 bp, Homo sapiens
gctaaattgtgtttccccccaccgaaattcatgcgttgaatcctaatccccagtacctcaaaatgtgactgtatttggaggtagaaactttaaaaggtgattaagttaaaatgaggtcattagggtgggccctaatccaatctgactggtgtctttatgagaagaggagattaggccacatggagaaaccagggatgcctgcacacagagaaaagaccttttgaggatgtagtgagaagataccatctgcaaggcaaggaaaagggcctcagaagaaaccaaactcacaagaaagccaacaccttgatcttagacttccagcctccagaattgtgagaaaacacatttctgtttaagccacccaatctgtggtgttttgtggtggcagccctagcaaactaatacaggtagctactgtgaatgggaacttcccgtattatatattacatctctaaccagttatttgttttgtaggaaatatgatgattttgtagtttattttcctggattttctggatggaaaaatgtttttatctgcaaatgatcacagttttgctgcccactttctagtcattttgccttttgtttttttttcttttcttttttttttttttttttgagacaagagtctcgctctgtcacccaggctggagtgcagtggtgtgatctcggctcactgcaacctccatctcctgggttcaagcgattcttctgcctcagcctcctgagtagctgggactacaggcacatgccaccatgcccggctaatttttgtatttttagtagagatggggtttcaccatgttggccaggatggtctcgatctcctgacctcgtgatccacatgcctcggcctcacaaagtgctgggattacaggcatgagccaccactcctggccttttatttctttttaaatccttgctcatatatctttgagtatatctgtgaatatttctatcagacaaattcataaaagttattactagtttgtaatgttcctttttctaaagaatgggcatgcagttttattaaatatcttttagtgtccattgagatgaccatttttttccctttattctgtttttttatatgtattacattagcccatctccaatattaaactagctttgtgtttctgggataaaaactcctttgacatttgacgtgtgctgacactgacattctttgagtaaataaaataaaaaacaggagtataccagtgtacaccaacataccctgctgctttattcgggttactgactatactttctgtctgaaattgtctgctgtgtcctcagtagatgactctatttagtaactacaaaccctgagtcaggctttcagaatgcccttctttttatttattagtagagatgagatcttgctatgttgccagcgctggtctcgaactcctgggctcaagtaatcctctctcctcagcctcccaaagtgctgggattacaggcatgagccactgttcctggccagagtgaccttctaatggtgcttccatggacctctcctttgctcctattttctttctcttgcttttggagctgctcctttagaggtgagaccacccttcaagtgggtgaaatcagctgtgagtctctcattgcttctgtgtacttcccacagcctagtaaattttctctttgctcctcaagccctggaacatttgggcctccacccacctgtcttactctctgcggagagtcttgcttcatatttagagtcagattaagaccagtggaaatgaactgccttacattttctctgtttcagcatatcttcctctgtcacctattttctccaggtttggataaaaggtagtctctcctgataattctcaacacctgatggacacctattccaggagaacactctgcatcctgaagctcattctgtcctaaatggatcccatatctcctctcaacgcagagacaaaaacaaacattccttaggcctaggaccatcacttcccttgtgtctgttcatggaccacaataccttgcctgcttcaatggctgcaagtgtttatcatctctgtcttgtctgggccctgcatacaagtgacctgccctcatatccaacactccagtttagactccagtaacctcttactggtgggttctaataaccttttaataacttccctctatcttgccccttgctttatattgagatcatattcattgtttcccctccatcttgctgcctggatcatgaatgatgtctataccacagggaccaggatgccatctagggacaatggagcaatgagctgggaggaacctggatcctgaacattgtgtggagtacagctgtcataaggctgaggttgcattgtgtgtgtgtgtgtgtgtgtgtgagtgagtgtgtgtgtgtgtgtgttgtttactttaacctgagcttatgagagctctgggtaatgtaaatagaatagctcctttaggaagtgtcttagtcattttgggctgctataacaaaaatgctgtatactggtggcttaaataactatttatcataattttggaggctgggaagtccaagatccagacactggcagatctggcatcaggtgggggcctgcttcctggcttatagacagttgccttcttgctgtatcttcacatagctgatggagagatcattttgctcttatgtcttcttataagggcactcatcccatttgtgaaggctccaccctcatgacctgattacctccccaaagcactacctgctagtaccatcacattggggattaggcttcaacctatacattttatgaggaaatgaacaatcagtccatatcagggagaaataaatatatgtaactataatcacaagttaagtagttaaaataaaaaatatcaatatcttattctgtgtgtggccctgccaatttactaaaagctatcataaaggacactgatcataaaacttagccaatcattttagcctgcacaaattctatacggtatttgaaataatcaaccaaacaataattcttcaaactttgtttcgttttgttttgttttgagacagtttcgctctgtcgcccaggctggagtgcagtggcacaatctcggttcactgcaacctctgcctcccgggttcaagcagttctcttgcctcagcctcccaagtaactggtactacagtttgtcctcggctgttacagagaattgatacaaaaaatgatcatgtgaagaatttgcatcttctgcagaactaccggtatcagtcagcagtaggagattgccagacacggtggctcacgcctataatcctagcactttgggaggctgaggtgtgtggatcacttgagcccaggagttcaagaccagcctgagcaacatggtgaaaccccatctctgcaaaaaatacaaaaattagccaggcgtggtggtgtgtacctgtggtcccagctgctgggaaggctgaggtgggaggaacatttgagcccagaagttgagccgtgatcacgccactgcactccagcctggatgacacagcaagaccttgtctcaaaaaataaaataaaataaattttaaaaaa

SEQ ID NO: 1363 - DNA, 566 bp, Homo sapiens
gctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgtgagtaataaagctatttatttcacctgggtgcaggcgggctgagtccaaaaaggagtcagcaaagggagttaggggtgggcagttttataggatttgggtaggtagtggaaaattacagtcaaagggggttgtgttcttgcgggcaggggtgggggtcacaaggtgctcagtgggggtgcttctgagccaggagatggaatttcacaaggtaatgtcatcagtcaaggcaggaactggccattttcacttcttttgtgattcttctgttgcttcagaccatctggatatatacgtgcaggcttgggctcagaggcctgacacaa

SEQ ID NO: 1364 - DNA, 580 bp, Homo sapiens
acatagcactcctgtctcccgtttgacttcatatagtgaaaattgtctaaaagataaggcaggagctctggttgacaccccccctgcccccgcctcatagatctctctctagaagcattggaagaggccgtctcaaaaaagaaaaataaaatagaagcattggaggaaagatgtggtttgtagtgaaacaaattggaagtcaagctcagcctcaaccacttacttgcttctgaccttggcattaggaagaggccgggtgccgtggctcacacctgtagtgccagcgctttggaaggctaagatgggcagactgcttgaactcaggagtttgagaccagcctgggcaatgtgtcaagaccccatctctacaagaaattttaaaattagccaggcattgtggaatcctgctttgtgtagttcagtgcctgctgccaagtcagagctgtgacctcaatgaaagtggcccagccacagcaaacctcagtttccataacagtcctgggatccaatgtggctttcacactacatgtcacttcactctgttatctctgacagaaaaccaactcaaactggcttaagc

SEQ ID NO: 1365 - DNA, 481 bp, Homo sapiens
gaggatcatgtctgcatcttaaaagatccctttctgtagacaatggactgaagggggtgaccagtcaggaggcagttgctgcattgcaagatgaaatgctggaagtggtagggattgatgcagacctccttctgcttggaaccaaaaggaaactcacagcattccagtggttttagttcatggtggctctgaagatcgggccagcgccacacacggcagtaaatgacatgaggcagtcccttccggtgggagacttgcagcctgccatccagagagcggggaatggtgacacagttactcggttgccctgggcagctcaaggccttttccagttcctccatggcacctttctttttcttcagttttttcaccaaagcatcaacagctttctctgcccatttttcttcttcatcgccctgtttccacccaagaagtctcttcacagctggacttgtaaaggaaaataaacttgtcacattca

SEQ ID NO: 1366 - DNA, 2308 bp, Homo sapiens
agaactgcagatagtacagcttccacaggagcaagggatgtctgagcacaagtggctgagttccgagtgactttatgaagcactttctaccttcctctccggcatgaaaacagggattctgcacctgcatcatggacagtctggcaaaagcctctgctctgcctccggggacaagaaactagagcaaataaccgttttgaaattagatcctggcaaaattaccaacaatcaatgatggaaactgaagggagattgatttaaatcttcaatgacagttgtacagaagttgaagaaacacgtcatctttccaaagaagagtgagtagcttggttggtggtaccctaaaattagggcatgattaaggtacgtcatttcttttagttcaatcaaagtgctttgctgtttccatttcagagaatttcttattctttttttcaatttctctctcttcctcttcttcctctcattagtagatgtcttttataattgatgtcatttactgtcctttcatcaaatgtatgccacatcacttaggcgaaccagcagacagggcaccaaaatacacattagaggagactggcttccatgagacgcttcgactgtctcatcggggcacttgtaataagcatcttggtgccactgaatgcaatgctgtattcaaataatagctttcatcttcactctttttaaatataaaagtaaaccttgaagccctttgaaggacctaaccaaacaacatacctatgaaaatagatcagtaaggctttgagaaacattcttaagtaaaatctgtaaagcatctttgcattttttttcaagaaagacctccaggtaaatgatggcttttaataagacacatgacaatctcaattacaagaatcattagtgtgtgtcctgtgcgccattttatgttcccagcaggatatatcttttctcgtctagggtttccagggctgtctactgttctctatgtgtaaaacgtatttaagtgttcccccaatgctgcactaatgttgaaacaaaacaaaacaaaaacgaagaaacctttgtcaagtggtcagacagactggaactagaggattataggtaagagagataaaatgaagggttgaaagctataatttctatttatgtggtggcaaccaaatcagctgttggagtcaggcaatttaaagatgtggctactggagctcagagtctgggaagaagacacttctgcgtctgacagtgaatcaggctcccagttttgaagatgtgctgtaggtagttctcgctgaatccatttcccagttggtttctattccccgccccattcctgtgtccccacactttccacttgattttacctctttgacaattctatattttactttccttcctctcattccccttttcccaccccctttttttactgtagttcttggcctctgactactgttccatgctggatgtccccagaaaatagagtatgtttagaaaggagacagtgcatctcagaagggcctccccagtccactagtccattttttaatgtgttgtgctctatgggtgtcaggaatatttgtagatgaagtaatttgtggcatgaattttgatagaagcaggatcaccaacaaaatgataaatgtaggtacctgtctaccttgcataatattcactatgatcttgagaatttcaatgtataatttgtctttattcttatttttcattagaattaacagaatctcagagctggtagaaagtatagaaactgtatatacaactctcatattcagatgaagaaaatgatgcacaaaaaatcaactgtcctaagccattcagcttgtctataagtgctgttggcttaattatagttttgcatatatttaggcaaagaaaatactttctcagaaactggttaggactgtttgagaagaaatataatcatcaaaatatatacacagtaaaatgtaaccgtccatcattcaacataggcaagaatatatattgaattgcctgagtgtattattcgtatagcaaaacttacttgaatttctaataaatcttctgacctctgtatatgtataaaatatataaaccaaccaaattctgtacataaatatatttttggataccagtacaatccctatttcacttttgtgtattccagttatttattactcacagttctgtagttttaaccagaacaaagggattacccagaagaaaagaaggtaagctatttcatcagttttggtggaaatcagaagtttttttttctattattagctttgtattcttaaaaaagaaaaaagaaggagaaaaaaaa

SEQ ID NO: 1367 - DNA, 555 bp, Homo sapiens
atggtataaattgggtttcatggattggtttcaattctgaatgcttttctggagccaaagctcacctcagcactcttgggctgcatgctgtaatcctgggggatgggggattagtcctgtggctttgctctctggccccttgagattaagcacctgctgtgctggaggtgctgaggtgttcccagttcacttgcaacaacactctggcaggggctgctggcaaaattgctccagtggggcagtgggagtctccacacacatgtgcaccaatggaggaggctgcagaaagacttcaattattttatttgatgtgccactggacagacttgtaaatggaagctcaaggaattcagtgagttgtctctggaaaagagcagagcagatgaacacaacagatgaagctattaatgcagctttaccttactgacccagagcccttcgagtctgagtttcctctggaccaagtggttatcttctctatacagactggggattctatctcccaagcatgcaattaactgccccttttgaatattctattccaagactcattgc

SEQ ID NO: 1368 - DNA, 407 bp, Homo sapiens
aacgtctcaactgtaaactctgggcacgcggctagcgccacgtcctctccagccctaacattctgtgattctaaacttgtctgatttgtctcatatgttgcaaggctcgtagcaaaaagaaaaaaatactccataactatttaacaggaattagctgaagcacagctctagagagagagacacacacacacgtttcaaataacccgaacactagaacctagtgaattttatacctttactaaactttagcgattatttgtttctttcgtaacaaaggttattgattagatttagtgctgaaaaaaaccaacaacgtgcgcttcggtcatttgtcttatggaggaaacataaatctataaatcttcctcctgtctctaagaaataaaactctcttcatttccaaagta

SEQ ID NO: 1369 - DNA, 628 bp, Homo sapiens
aaagtgcagagactatccacctcagctatagcacagggctcagcactgtatttccagttatggaatacagttatttcatatatgttatattattcttaattctgtccctagttcctgctactgaggaagtccatactcagcaggacagtctcctggtctgccatgaattcaaacacaatctgtaaagacagtgaaggaagctacatctgtgcatgggggctttagagaattattggcttgaagcaataagaggaacatctgggctgagtagtcctcgaagactctcatgtgattcaaaagtccttttcttccttattatttcctatcttgctctcaagcatctcctctggcagcagcaactggaactaaaagtgatttctctataacagcgagcaagtttctcatggcctttgctattaactctttcatgcctgctgacctgcaaaagaatcaggagggctggtgctggagcagatggcgcactgatccctggatcctcattcctgatataagactagttctagataattcaatacaagaaagaagatttgcttgggaaggtagatggggcaaagcattaccttgtgtaaaactgctgctaaaatatattcctagtgagaaaggtcaa

SEQ ID NO: 1370 - DNA, 1962 bp, Homo sapiens
caaaatggtggcgccgaggcggaggccggcgcacctgggggcgccacacgccctacgggatccccgcagaccgccgccagctggacgcgagccccgggtccaggcggcccgcactggtctgcgccaggcccagcccgcaggggccgcccacagccggtggcccgcgtcgccgctcggtgtccgcgggtctggtgctggcgggggcgcggggcccggcgcggccgtctcggcctcacccagcggtccgcgccggggagagggagcgcactcacctcagacgcgccccgggagccgctggaagagcccgggaaaggaggcggagccgcgcgaatgaatggagccggcggctgctcgctggcgacctccggccggtcccaggccgcacagctcgcggctgccagggcgagtgcggctgcctcccgctcgccccggacgcccggctcctcgtcgcgggtcggccgcggcccaccgtgccctccgacgacgtgacgcactagcgccgcagcgcctccagccttcgcttccgctccgcgcccgcgcccaccgcgaatccccccgcccgccagcgcggagcggcccctcctcggagcctgggacgccgccctgcctccctccagccccggctttcaggcgccggcccggcaggtgcgggcttggccagcccgggggcgtcacgcggcccccgcctcgccacccgcgccccctctctccgccccggccgccgtcacccggcagcgcgacgcccagctcagggcaatggcctggtattaaagagtgaccttggcttagatataaaaatagatgcggttaagccgcgggggctgcaacgctgattttgcgtattcctttaatgccgaccttcgcaggattctgttcgcatagcccggtggagttctccagccccgcgtaggccctcctgaaatttacccagagtgggcgcggccatcccggcctcgggacaggggtgcagagggcacgggcgaggaccgccggcctccgccccaccactttcatcctaaacctactgccacttaggtgcatgcaagttagaatcgtgggctgctttcacagtctacagaagtcctagagcccggactttcatctggagatgtcagggaaataccacattcctgcgctgaccttttctctttcaccgtttaaccggtacagaataaccctgacccagaaagacaacagggttccatccggctttcctcccgtgcctctcccagctctattctaccgtcttatggcctctggcgcctttgctaattacacactcctactgaaaattagccctccagcatttaaaacatgataaattgtctttaaggtaatgcgtattgtagtctaaatatatttaataactgtattgagaaacaatattgtatctaagtattaatgtcaagactttcttttactcatcatccaagaaccgtagtattatgttcagctcatccagaaaagttgaaaattgcttctttcattcctgggaaatatttagcaatcacaataccaactttcacgaatttactaatgattagcaaaattagcaagatcaaaaaatacttcaaagaatgcttgttgatatagatatatttgaccctgatttttaaaaaaagcttttctgccatataagaatctattgtttcatttgtataatatttaattagccaaaatctttactattacacatcatttaccattttaatgaaacttaatgaattagatttaatagagcaggaattttgggtagttgggttctacccatagccagtgatgaatgaaattatatgacttgtatttacatttctagagctatgtgtaagtaggagtccccagggtaatcccaaacaattgccatttggggaagctttggctaccagactatgccctacagatgttgaagcctcaggccttagtgtaaagctaaccaatacaacttgttgataatatttgaaa

SEQ ID NO: 1371 - DNA, 5425 bp, Homo sapiens
ggcagaggaaatggtgtctttgaactgtagtctgtagtcctagaaattgaataaactatttcctaaatagaggtaagagactaggatcctagcaacttctctaagttaacaaaaggggaaaaatatccccataccatttttctcttcattctattaatgagggctagagtcgtttcatagattgaatagtttcaagagcatattgagcagtgcctggctaacagctgaaagtctgccatttcatgcaactttgttaggctttagaagtgaagcaggaatatagagaaaatacagcttctcccacccacaacgtgtattttaaaccatttcttctggcccagaagacaaacttttccaaatatcttgggaaaaccacagtttctactctttggagacaagagtctcactctcacacccaggctggagtgcagtctcaactcactgcaacccctgctctcaggttcaagtggttctcctgcctcagcctcgtgagtagcactcgacaccacacctggctaatttttttgtgttttttgtagagatggggtttcgcgtgttggtcaggctggtcttgatctctggccacctcagccttccaaagtgctggtattacaggtgtgagccactgtgtctagccaagtttctactcttgatgcctgccatggactattacaagcacctggcagtgacattgcacgagttctaaagaaagacttggtctttcccacagggacattaatgtgaaagaggtccagtgacaaagattcagtcacttttgcagaccctcacaagccacaataatgaagttgcagtgaatttgggacatagccttccctccccaaaattcttgatccaagaatccacccgtcaagttcaatgactcagactccatttctagtgtggtcgttggttaacaactttactagtttccatccaggcttaacctttctatggaccataatgtcttggtgtctgctgcatttattgtccctccctgttttaaggatacttaagtttttaaagaggcataaatacttcaaagtccccattggccctcctgggggaaattacctcaaaccacagggtagtctgctaaataaccagctagagctagctgccagcccaactttgcccagatctacaatattattctcgttactttagtttactcatccccccaaacttagctttcccccagaactttatatccactctccataaaagcttctgtagcaccagcttggtcagtcccaaggtcccaggtgccactggggtctggttgacaaaattgttggtatggtttggctgtttctccacccaaatctcatctgtaattgtaatcctcataatccccgtccccaggttgagggagggactcggtgggaggtgactggatcatgggggcagtttcccccatgctgttcttgtgagagttctcatgagatctgatggctttatgaggggctcttccccctttgcgtcctacacaaaccctgtctcgcctgctgccacgtaaaacgtgcctgcttcactttctgccatgattttaagtttcctgaggcctccccagccacgcagaactgtcaaacaagatcctttataaattacccagtcttgggggggttttatacagcagtatgaaagcagcctaaacagttgttttcatacgtgctggaaatgctgtgatctgccctgccattgtccccatcctggactgaccctcagtatttttcctttgagtggtgacccagctctttgccttgagcagcaggagtagcccttggtagaatctagttccccaggggaaatcaaagcagctttatcttctcactgttagccaagcacctctggagacagccttagtgtttgctcttttatcccctctcacctgggaatacaattgcccctgcaacataatggccctactgttccctcaccaactcccccagcatggggatcagaaatatggcagtactcctcagtgaagtatatgctgctttgttttaagcactcacctgaatgtgtaaggacatctttcctcaagagcttctcacttcctgaggagtctgtagtcttcattcaaatgtcttgatggctcattttccagaaatctctgtaggtcttgagaagcattgtcctagctttggtttatctgaatagtcctatttaaacttgtcccacacagatagcagcctcttgcttgcccttctgtttgtacacttgtctattttctctttctttaaatgccttttgggtgttaatacttcattggtggttccatagccttgtccccctctcttttgcaacttgaaggcaattctcagttctcttcttgagcacattcatacttagcagcttctgaatatcccacccacaattaaggtacaatctggtcacataactttttccctaggaagaaatgtgctactcaagactaatagccaaggttaagaacgtgcatactcctgaatcggatgtaaatgcattagtctatttgttctgtttagaaataaagatggaacatattttatagctactgttagtgcccatgtgccttctaaatatcttttgaatagttttacttctctccatcttgacagctaccatgccaatccaagcttccatcaccttgctcctggcttactgcagtatcctcctgtctacccttcatccacttttatctctttccaatcacttgttcatacaacagccatattgggtttttttcaaaacacacatataatcagggcacttctcaacttaaaaccatttctggcattacttgcccttaggataatgacaaaactttttaacacagtccacaaggccagagatagcctgacccttgctgatctgtccagcctctgctatatgtccccttattttctctgttccaaccacattggactttgttcctcttactagtcatgctccccacctatttggttccctagttaacttctcttcatccttcgatttcaacttgtgtcacttcctccagaaagcctaccctttctttcttaaccaggccgataggctgtcaaaaccaggaatctcttcttcgtagcactacagtcatactcattgatacgtgtgattattaatgtgggttttttaaaaaattagaatgaaactcaagagcagggaccacatctattacttgtgattaatatattcctagtggttagcacagtgtctagacaaatatatgttgaatgaataaatagaaaagggagaggaaaaagggaaggattgaccctctgtgaggcagtcttgcaaacagcagaaatgcaaagcaaagctgaagaactaactattcaacacacacctagaggagcgttgtaatgtcttgtgcctgtctcaaatgggtgcattcttatgggtaagttttactagtccagctttcactgtaatagttcacattcctctcctagtgtcagtctccaacaaatccctcagtaattcgtaatcagtaatctcatgccaaggatgagagaggggcattatccaaaaagttgggtgtgtccatttttttttgagtcttgctctgttgcccaggctggagtccagtggcatggtcttggcttactgcaacctccgcctcccaggttcaagtaattctgcctcagcctcctgagtagctgggattacaggcgcctgctacctcgcccggcttttttgttgttgttatttttagtagagacggtgtttcaccatgttggtcaggctggtcatgaactcgtgaccttgtgatccgcccgccttggccttccaaagtgctgggattacaggcgtgagccactgtgcccggctgttcatctgtttttcaatacctttaagttcagtttcccttacaaagcccacttttttcttagtgggaatctcttgtaccacttaacacctacattccttaatttttaaagttaaaacacttatatactataaaatggacacatcttaagcatacagcttgatgaagatttacaaagtaaacatgccagttgaaacaccactctgatcaggatgtggaacataaccagcactccagaaatctctctgccatcattaccaccactggttatcctagccactcttctgacttgtatcaccatagataggttttacttgttttgaagccatctataaatggaatcatggaagtttgggcttccctgagagcagatcttcagagaaaaaaaacttgagtgcagtagtttatttggcgtttggctccaggatgcaggagtgggaaagatggtagagagacagaagaaaaatcaatagaaaggtattacggaggttggatatataatgcttcccagaattgtctgactgaacaggaggctgaaatatttatccgctggctcctgtttccaattgattgagggatgcccccaaggaagttaacttcactgcaattctgagctgtaattgactttaataagctccaacagcactgaaagacgtttggattattttcagtttgggataatactactatgaacattcctgtacatgtcttttgagaacacgcatgtgtacatttgtgatgggtatgtaatggggtggaattactggttcatagaatatgtgcatattcacctttagatatagaggctgccaaccatttttctgaagtgattatactaatttatattctcactatctgtaaatgaacatttctgttgctccacatccttgctggcacttggtattgattgatttctcttttaattttaggctttttaatacgtgtgtagtgatatctcacttgctgtttgtttgctttttggtaaattttttattgaagtataatttacatacagaaaatcacacaaattgtgtacaggtgtgatttttcacaccgtgaatacatgcaaaaactagtatgaaattaagagttggaacatcaccagtactccagaagccccatgcatgttctcttccagttactataccactatcccaaggatggtctattaattcaacagcatagatttattttgcctgtttttcaacttcaaataaatgaaataatatgcactcttgtgtctggcttctttgactcaacagtatgtctatacaactcatctgtattgttgcatgttgtagttcgttcattcatactgttgtatacagtattgaattgtataaattactcattctgttactatgcatttgggctgtttccagttttggctattatgaataaagctgctatgaacattctagaattgtcttgttgaacatatgtatttctgctgggtataaagcttaaaaaggaaattactggaaaataagagtattgcctcatgttacctacctgctattttcactgtaatttcatctattctggttgatgtgtaatagtgtcatattagcattttttctttgcttttataaaataaatgtttttatgttggaa

SEQ ID NO: 1372 - DNA, 805 bp, Homo sapiens
agctgctctagaatgtagcaatggtgggctcctttgggggccatctagaagcaccctgcccctgggcacctgcctcctcactggaggagaccagaggccacgtcccagccctgtgcttccagctctggaactgcccttgacttcactggacaggcctgagcaagtcgtgtaaccttcagggactcagctatgcccactccaggctctgtgaaaccaagacaacctcacgtgctcagttcctcagctctgcaggagccaggctgctctgggttgcaagtggatggcaagcttccttgtgacttctcatcctggcaattttctggagtgtttgtgactggactttaacatttccaaaatgtggcgacagtgactgttaagtcttcccaaagacgagggttcctgggagccccagggtaagtggcagactaaggctgcaagcatcaggacagcagagaccaaattcatcattgaatcctcaacatctagcacaatatgcctggcataaggtgaagagaagaagagtatgaactaccacgaaactcatttccctccgtccttcaatcaaatacaatgaccttcagctactctcaccattctctactgaaaacatcccaactatctggaaagaactcacctaaagttccccaacatcaaataaaccacgttccaaaagattcagagccagagagaaacaaaacgccctttgttgatgaagcatttactcatacatacatacaagtgtgtatatatatatacacatatatatgtgtgtgtgtgtgtgtgtgtgtgtgtgtgtgtgtgtgtg

SEQ ID NO: 1373 - DNA, 977 bp, Homo sapiens
atataagataaatatagtggatcatgtagatatgatattaaagtactatattttataaggaaggtggattattgtatatttaccactgttttctgcttaagaaccaaggtgatacttatataattgtttttaccctagcattttgggataattcttgagtcataaaaatctcctgatcaacttggtgattgaattggattgcattagttctgatagaaactgtttaaaaaattacctgacattctatagaaatgaaaggagccatgctgtgtaatcacaaggctttcatgacatgacatttatagattatatgaaataggtaatttcaaatgtaaattttaagttttatttactattagtcatcgttttttgattatttaaaaatttgtactatggacaactaattaattttactttttatcctctgagatttgattgtggagcggcataagggggagaaagataagttgaggacgtctctttatcttttgttaatcagaggtggtgatagagtggaaaatataacacgtttcggcattcaggagacctaccttccaataaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaa

SEQ ID NO: 1374 - DNA, 4247 bp, Homo sapiens
cggaggcgccgccagctccgcgctccgccactgcccaggccggcgggcggcactcggacccgccgccctcggtccctcgcgaggccacggaggccaacacgcctcgcacggggggacagcgcgggggcagccgtccaaacaccaggcgtcctcggctggtcgtcccagggcgcccgcacctctccgcccgcgctctcctgccgccgcgcccccaagcccccaaactccgaggcgctgcggcggaggggccgggctgagcgcaggcagggtggcccgggcccaggagcctgacggcctgagtgcggatttctcatctgagtatctgggaatcgagaatgaattggaaggaaaccgaggcgctgccctggccaggttgctgccccgcacccttccggagcaccgaagtcctgcccggcaacgggacttggagctgccgcagagtcagcctgagcccgaggcaggggtcgcgcccgcgatgcggggtctctgcgccgccccgcgaggctcctggccttgccctccctgccctttgttgtgtaataagacctgtggcggctccactgagacccacacgtgcaactccgcgcctccgcgttaaaggaggtgaaacgcagcagccctgagaaaccccgagaccccggtgtcctagcagaggcgccccggatggggaggggcgcggggccggcgccaccccagaggaaaagcccagcggagccgggttgggcaggagctggcggcggcggtgcgctgggccttctgccttggatcctccgcggtcggcaccgcttccctgctcagattcgaacccagattcggctcccaaggctcccacggctccagggtgcccagtcttgcagccagctcgccgcccgagccccggatggaggaagcgctcactggccgctacctctgctgtttctggcaccagagattgagactgtgaacctgaactcccttgatctcctcccgttgggcccaggagggagccgaatccaggcccaaccgggctcactgagaagaacctttaaaaatccgccaacgaatgctgttgcctggatgcgctgcctatgaccttcagccgtgtgttcacgcgcgcccgcagccgtggagtggcggtccctcctgccgcccgcaaccccggggccgccggtctgcgcacaccgggagcaacttcgttacccacagcgcccgcgtcctgcggctcgcgcggaactgcgcgcgggaaggtggcagagcgacgctccagaacgctgcttgcgtagacgctgccgctgccttcagatcccaattcggccgcgcgcgggcggggccctggcagcaacgaaaatggcgagcctcgtagccttccgggcccggcggccacattccgggagtcgccaggtgggagcccgccttccgtgtccccaaacgcccagagcccgggacacgggccggcggccgggtcaccaagccagttcccggaatcggctcgcgccggaatccagactcggcttgcaaagcccgctcctgccgtctctccgcagcgcgccctgccccccactgccggccctcttagcttcaaaaccaaattttgcctttcatcctgagagattaataccccgcaggtgaaaccgtggagacggagctgcggtgggtttcttttccacgcctcagtttcctcgtctgtgaaatgggaccaggcgcgcctgtgcttctccgggagtttattgcagggctggctggagagaatggctgggtggaagctgccaggaggaggcccaaggccgcccaccccgtgggcctcgtttgctgagcgggggtcagaggcgtgcgggacagggcgcgccccacggcggctctggaggcggcccggcccgtccctgtctcctcccctcgctccccctcccccggccttcccggaactctcctcgcccgctgggtggaggaggggcgagggccgactccgccgcccctggggtctccctcctcccacccccaccgcagagtctggcccgccctgggctttcctctcaggtccctttgggtctccagaagcccggaggtttcgcgcagactcgaacctgagatgacaccacccagcaccccaaatcctgcagagtgtggaggggatctggggagaaggcaggggctgcccgggcgctctggctgctgggggtgggggacagggcctgccggggaagcgggtcgggggaggactggagacccaggctcccctaggtacaacgaacctcgcgggagggaatacgccatccccgtacccacttccgaggacgtaggtcttttggcaccggcggcagccgcgttcccacacatctgggcggggccccgcagcatggcctggggagctgaggcttcgggatccggcacaaactaccattctaggtgtagacggaggaggtggggtgtgggaagcagggggccatggtctgagcagaccttctcacctctgggcctcccacctcctggggcaggacttacggggaaggacccgaggggagtggggtgtccatagggacacccaagggtctatccctgcgagctttgctttctactaaaccaataatcgcagtggtggtggcagtcgagacacggctcaaagagccggcaagaatagagcagagaccaggatcgccccaggcagggaaaaaatgaccagttctgtagagtgacccgaaggtgatggaatcactcgggcgtcctcctgggaaagagctgcctgctcccccgccgccgccagtacaccggcgcccatgccccgggggctggagagagcagccaggcacaggtaactcaagaactccagtcccctcacgggtgccgtgctgtggggcgccctcacccccacactttgggtccctgggcctcctcatcaaagcaggggcctgagtggcaggaacacccctgtgtgcagaatagtgccccctgcagcccccacaggtcacctctttgaggacctaggtggggcctgccctggggactggggtgaagagggcaggtccagccttcagcagcccctcccccatgacttcagtggaattacaaggggaacacccagggcagctcccgtaggctgcacaagggaagaggggagggcttctactgaggtgaaacagtgacccacccctcccacaccgtcagcctccctcccctctccacccttcagtgctgggaccccagggcccatagacagctgggggagtggggagacaggaggaactcaagctcagcttctgcctcctgtctcctgggaccctcgggcagcccctccagcttcctgggagtccaatttcccaaggtagaacggtggcggcagagcctggccctgtggtggggcagctgcaccccgatgagtggcttgcagttcctggagccctgcaggttgttggagaggcagggagcccttctccctcctgcctgccctcttgcacttcctctcccagaacccagcactactcccagaggctctgagctggagccctagaaggtaaccacctcctggctggacacagggcaagttggggccaggcgtgaggacaggtgccccaggagccacctgctccactcatccacaaaggccttaactggctcaggggcccctagctcccagtcaagccctgccctcctgaccttgtcctgccctggtgctgccagtcgggtggagatgtctaggggccagctggtctcctggcaactgaagtccgcgcttcccttccgttcactcattccttcctttcctcatgcaggaggcgctgcaaggctccgtgctcctggagcttcgagtctatggtatgagttaaacagaagggtatctcctccatcagatctacaggagggtgtctgctccatcagacctggagcttccaaggcattttacccgaagctccagcacctggcccaaggctgggctgtgctgtgtcctcagtgaaagaatggatgagtcacagctgaatgactgaagagctgaaccaatgggaaaactgatgctcagaggcttgagcaacctaggccaggacctgtccttagaggcagaagcaggactcagaggaagagcaccctgaccacaaagccccagggtccagaaagactcagccactggagtctgtatttcctgagtcgcctctcactgctggagctgtttatcatcgctccaactttcactaaaaaggaaaaactatcacttaaacaaagccattgaaaccccagcatcatgtgtggattttttaacataaataaatcatacaaactaa

SEQ ID NO: 1375 - DNA, 2682 bp, Homo sapiens
tttatgaccttgacacttttaaagggtactctcagctattttgtagaatgtccctcacactggggactctgaccttatgactggacaaggttttgttttttgtttttttttttttttttgagacggagtctttctctgtcttctaagctggagtgcggtggtgtgatctcagctcactgcaatctctgcctcccaggttcaagcgattctccttcctcagcctcctgagtagctgggattttaggcacccgccaccacacccggctaattattgtatttttattagagacaaggtttcaccatgctggccaggctggtcttgaactcctgacctcatgatccatccgccttggcctcccaaaagtgctgggattacaggcctgagccaccacgccctgctggtttattttattttttggcatgaataccacagctgggatgtcatcttctcaatgcatagtggagatatgcaatgtcagtctgtccaactcctggtcctgttagttcaggtggtggcagcggctgccggggcttctcccctacatagttactgttttccctttgtcatccataaataccttggggagatacttccagactaagtgaatgtctgtttcacttccaagttttacccacttttttttttttttttgagatggagtctcacttttgccgaggctgtagtgcaatggcgccatctcagctcactgcaacctccgcctcccaggttcaagcaattcccccgtctcagcctcccaagtagctgggattacaggcacgcgccaccatgcccaggtaattttttttatttttagtagagacggggtttcaccgtgttgcccaggctggtctccaactcctgagctcaggcagtccacctgcctcagcctcccaaggtgctaggattacaggcgtgagccaccgtgcccggcctacccactaattaatttcagcatccactggtgggtcttgcaatgcagtaattattaacttagttttcaaaggtgatttttgcattttcctcattcctttgacgtttattaattggaattcatctctaagaaagagcagtcccttcagcttttttcccttttttttttttgagacagggtcttgctctgcggctcaggctgcagtgcagtggctcgatcacggctcactgcagcctcgacctcccgggctcacgtgatctcccatctcagcctcctgagtaaccagaaccacaggtgctcaccaccatgcccagctgactttttgtattttttgtagagatggggtttacccatgttgctcaggctggtctcaaattttcgagctcaagtgatccgcccgccttggcctcccaaaaggcatgagccactgcgcctgacctacgatttctttctttatatatcagtatgaacgcaagggctgtttgttggattctgtgagtcataatctgatactgtttccacgctttggccattgggagctcctggagattgtctcctgtgccctatccttatttaagcacttgtttattttgggatgtcttcagttttccttgtcccagctctgcacccagctgcttctccagggagccctccctcactggagactgggatttagcaaccaagacctgggcactggctgtgcttgttgcttctgggccctcctgggacagagctgggaagtggatctatgacacgtgcttgtgcatttacccgccctgttggtttctgtagctgtctagttcctgctgttcctgtctcacctgcccctttccttatgtgtagtttcttcctgtgacagggagaaacctggctctcagattgacaggacattcgcttaggccatgtcagtgctgtaggtgaactgttcaacctgtgccccagggaggcgcagtcactatggaggcaccttacttccttaatcgtgtactgttgtttttgtgtttgacctgtagcatctaagtactggtttcaaaagttgcctagatgagttcttttctttctttccacctcctgcaaattatgtgatttgcataatttgtacatagttaggttcatttgttagtttgtattccttttggcttcccccatatcctcgttgactttttctttcttttgtaacttacatatgttatgaaatttatatgaggatatataattttcataaatgtttatggtttacatgtattagttgttattattaagatcaccctgggattgactggccaagcatttggtggaagatagcaataaataatacatcataaaagactttaatgtaaaaataaagccatgaaagtaccaagaaataaatcttctcattttaattacatcagcttgtctgtgatcatgtagcctaaggtaggccagagttaatttttgtgttatctatacacgttattgaagcgaattataaaatgttttagcatgttaattacttgtaaattaatatctacatataaaaatgtgagcatatattctatttagtatattaatccttcataaacaagtaatgcaagttagtattaatgatatcttaagacttaacattccttttttagtttgtgttgaataaatgaacatctaagagttcatgatgatgcttaaggaaagaagcctcatgtttacctttggaagttgtaaggcactgactcataaaaattggcaaataaaaggaaagaatcgggcattt

SEQ ID NO: 1376 - DNA, 490 bp, Homo sapiens
acaaactgagaagaaaaaaaaagaattacccccaacaacatctgaggaagcagaacagggacagacttgaaggcacctgggcagtcctctggttttggagtagaggcagctgacgtctggtgatgattcaccatatcaggaacaccctgtccagtgggctcaggcaagcctgccaggccacttctctaaagacacaacctgaggcctcctgcaataattctcacagagcattctgaacatacataaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattg

SEQ ID NO: 1377 - DNA, 841 bp, Homo sapiens
accgctctgatggtggcacatgccgagtcacccgagtaagctattgttaagggccgtgacccgagcctccatcagccgtccgctctcatgaaaggctgtcggtggtagtccacgtgcttaagtgcctgcattccgcagtgtcaccaatatttccattagtgtttcttttttcttttttgagaccgagcctcgttctgtcacccaggctggaatgcagtggctcgacatcggttaatggcaacctccgcgtcccgagttaagcagttctgcctcagcctcccaagtaactgggactacaggcgcgcgccaccatgctaggcttttatatttttagtagagacggggtttcaccatgttggcgagactggtcttgaactcctgacctcaggtgatccaccagccgtggtcccccaacatactgggattacaagccgtgagccaccgcgcccggccgccatcggtggttcttaactgcgggtgcagtgcttctttgtaacattaagtgtatcctttacctgtcgctagataatgaatggtatgttacctgcatcattggtttaaaaagacgaaccgtttttttaaagaacactctttaaaaaaaagaaccgtggaacaatgaattaaaatctgtacctgatctctttaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttc

SEQ ID NO: 1378 - DNA, 956 bp, Homo sapiens
tgcggacaacacggccggaggggcctccatgaaatccaacccggggttccccatcctgcggtcacaaaagtcctggcatgtccttggggactatcctaggtcagaattgctcagggaaatgaaggctctgggatgcagaacggagaatgctttgcttctagagcaagcctcccctccccagaccagctccgtggctggagaatgcacaggaagcgtgaccattcatggagctgtccctgattggagtggaggtagacatacagcatggcgccgtctggccctgccagtcacctgccaaagacggaaggtttctcccggagggactatgacagtccccacctctacacgatggcccacccccaacaggagcgtcaaggcagacagactctggaagttgtaaggatgaggacagttagagatgacagcaggtaccttttctgtagagtgtaaatgccaagatggtgccgccagagatgaactagccaagaatacctatttatgttgcagtatcgccaaagataataatcactattgtggaacatgaaggatatattttaaggctttctccacattagactttctaggttcattttcccacccttctgaaatctgactcgattttccagttgaccacagtctgaagagagccagttggcgtgaggttctgtgacctacacagatggtgggaggagtcagacgggaaatctcttatgtcgacgtggtcaccaccacttgcttcttgagggagaagaatcggaaagacctggcaagacagactagctagaagggctttctgattccagaacaatactaagtttcctgaagtaaagtattaaataaatataaataaatggtaagacgtatataaatgtggtatgaagaggaagaaaataatggaatggagggaaatagacacaaatagaaattctaaggtatttctaatctgggatagaaca

SEQ ID NO: 1379 - DNA, 568 bp, Homo sapiens
acttgcccagtgaaaagactgtaatcagacaactttaataaagggagagcaggagagtggtgacgaatttccacattccgaacaagcttgtcgaaagaggagtgcagggaaggagcaagaatgaggcactggaagacggctgtaggcgcatgatgtcacaagttattggaagaaatccctccaacctaggttgggacagatgaaggcggcgcttattggtgttcaccaaaacaccagcatggtgtaccagctttggctagatgatgctcaggtaacgaacaacccctgcaactcagtggcttaaaggtccatttctcaagcgaattactgtggctgcagggagctttggcagtactccaccagttttcttcactccaggctgaaaggtcaacttttctgggccatgctccctgctgggctggtaaaccaactttgagggagaagggggaagtccagatatgtagtgtttgctatttctatgatgtaaatgctcccacaatggccgatttcaagctacaaacagtccaacaagtggcttgccaagttcctggaaatttaacaattagct

SEQ ID NO: 1380 - DNA, 540 bp, Homo sapiens
gaatcctagggagcgggtaaaggcctgggagagggagcaagatgggctccgccacgagatccgcctgaagtccggctcggcgccggcctcaactgcaagaggaaggccacccctctctccccaagctgaaacaccagaagagccacactcggccgttcccaaccgccgccagttaccggccgccagcgaagaccctttcagctcccacactccattggcctcttgcggtcaggtcacgccgccggaagccgcccccggaaacggaagtcaggctacgagtcacggtggctccgcgctggcggcgggttcccccacaaggtcttggggaaaggagcatgcgctggaagctgtgtgctgttggttttgaggatcttcagtaagctgaaagcggagagtcaggggccttgtgtcctaccatggtatttgctaacgtttagagagtgcttccccttgccgagcactggttcttgaggctggaaagtccaagagcatggcactggcatctggtgagggccttcctgttgcattatcccatggcag

SEQ ID NO: 1381 - DNA, 1999 bp, Homo sapiens
acctgcagtaacagctgttcatctgttgggacccttatcttaactcaccactttcagaagagcagacaaactcaatttggtacttacggagtttcgctcttattgcccagactagagtgcgatggtgcgatctcggctcactacaacctccgcctcccaggttcaagtgattctcctgcctcagcctcctgaatatctgggattacaggtgcccgctaccatgcccgggtaatttttgtattttttagtagagatggggtttcaccatattggtgaggctggtctcgaactcctgaccttgttatccgcccgcctcgcctccctaagtgctgggattacaggcatgagccactgcgcccggcctccaaagcctaatgtctttgatcttatcaatgttcaatcctggagcctagtgtgtcttggacctgcgttttaccttttgaatcagtaggagcagaactctgttcccaggcaccacaagaatacgtaagactagaaagttgtttctgcttttttccttttttttttttttttttttttgagacggagtctcgctctgtcacccaggctggagtgtgcagtggcgcggtgcgggctcactgcaagctccggctcccgggttcacgccgttctcctgcctcagcctccccagtagctgggactacaggcgcccgccaccacgcctggctaattttttttttttttttttttttttttgtatttttagtagagatggggtttcaccgtgttagccaggatggtcttgatctcttgacctcgtgatccgcccgcctctgcctcccaaaatgctgggattacaggcgtgagccaccgcgcccggcctgtttctgctttttagcctcaccctattctcagtaaaatgggaatgggacgccagaaagcatttctgagttaagtatattattgctgcatttgggagtcttctagactccagtgtccctgcctggccaccaaagtgccaacagctcatctatctcagtctttggcaggctttcttctccgcctttgcctccacaaactgccactgcttaacggtcactcacaaagggctcccctctctgaaaattagtccttctggacttttcttgcaactaccattcttcagtagtttcataaatgagtaagagttttataacatctgaggggtgggggtttttttatgttaccataggagcaaatgtgttccacatcctttcacacgctacacagaaaattgtatgttgtgtttaaatcatagccaaattgcaaagaaaattatggtttctttattttgttcataactgatctaatctttctcataattatctccttctaggttgaaaggattataaaatgtaattatgtttaaaattccatgtgatctaaaattccatcattctatcatgagcccaggagctcctgctacataaaacatatgctaatcaataaatgtgatacatcacatcaacagaataaaaaacaaaaaaaaccatatgatcatctccatagatgcagaaaaagcatttgataaaattcaatatcccttcataataaatactggcaacaaattaggcatagaaggaacatatttccacataacaaaggccatatatgacaaacccacagctaacattatactgaatggggagaagctgaatgcctttcttccaagaactggaacaaaacaaatatgctctctttcaccactcttattcaacacagtgctagaagttctgtctaaagcaatcaggcaagagaaagaaataaaggttttccgaattagaaaagaggaagtctaattgccccctctttgaagattacatgatcttatatctagaaaaatgtagagactccaccaaaaactctcagaactgatcaacacagtaaagttgcaagatacaaaatcagtcaacatgcaaaagtcagaagcatttctatacaccaacaacatggtagctgaaaaagaaatcaagaaagcaatcccatttataatagctac

SEQ ID NO: 1382 - DNA, 318 bp, Homo sapiens
atcctcgatcgggaccgaaaaggccctgaacttgtgcagtgacttgccattgagtccgggaggttctggagacctgggtgacggaagaacgcccaaggccgactgctgccctcagttatcggggctccacatggaccaaacccagctggcagtcagagggcaagagcatctcgatgcagcgcatacaggccaattccagggtgcagtgcagcatggaaaaggagaaatgtacctgaagaggcaaatgaaagatatacagcgtcacaggcaatcttgcttctactaccataaaaatagtttacgtttcttagacactta

SEQ ID NO: 1383 - DNA, 1947 bp, Homo sapiens
acccactcactggtgagctccgcaagagtgtacttctctccgtccctggagcgccacggcgtgctggtgcatagtaagcatctgtccatgtctgtccagttgaatttcttgagagtcatttgaccttctcagcagctctggagaacccacattgaccagagactttgcagccagctcacccctccaaatccccgccctggagtccctgacccaggaatttctgcatcaggctgctcaaacctgaatttgacaaaatttcaaagcgctgtatctttatgttgataagacaacggataaagtgccatacttggaacctagatcactcaatgttgcctgtagctgagtccacttctgtcactcaccctgcattgccctgccaggagcaagggagagaaagccagccagaaggcatgggcatgggctcaaatctggcttctcctgtggccactgtgaaagttgatcatacaaaggtcactgttgtcatagccaagcagagttatgagaccacaggaaaaagcacttggaccacgtaacattgctccaagagtataactgtctccaaccctggctgctggaacaagtgttgcaacctgaaaccggtttgatctaatagctacagaaacaacctgcggaaatctaagactagtttcacccactcaccaatcagagcttgccggatccccaaaacgttgctagtgctaatgaacttgctttcctaacaatccataacatttctcatttttatgaaacctacaaccttctctttgctctttggacatactgaagaccacccagtctgtgtgtatgccccaaactgaaattcttgctccccaaataaaacattttaaacttagagatttgtctgtatattttatttgactttgacagcaccaggggctccggcacaaatctcctccttcaagcccttttctacacagtcccgtgggtctaccctgaaagaagcctgatgacggctcaaagacacaatgttactgggaggtaaattcaggattacttgaccgaatggcccacccgaggtcacggaggctgctggaggaacagaaaatggtcttcaccaagtgaagcattgtcggtcttggcctgtgtctggctggagaatgttaaaattctggggacacaacagaaaaggcacagttgtggggaccaggccaatgtcagcgtgagaactggctccatccccctcccatgaaccagctctgcggccaaggcaggtctgcatttcctggtctgtgacacggagtcagtaacattgcctacttcccggggctatttccagagaagtgagggaatgggtgtggaacgcctgccatctgcggagccccgcatgaaacgtctctgtctttccagccagccctgagccagggaagggactggaagcacagcgggtggctgaggcgggctttcggcagcttacccccagccttgcccctccccgcctgctgaaacacaatctatggttgtcgccttcctggagatgttagccgccccctccagaggtggttccaaatctatttctcatttggctgatttaggagaggctgcgaatcggtcgctatggtttctttattttctcctgacagcttaggaatcatttttccaattattcccaggggaggaaaaagaagtggaggaagccagtgtttggaatgaggggaagctcacggatctgaaatgcaacctcttctgcaggagacccggcacagctaccgggacccatcacctccctgtaggaaccccgcccagccccctccagccagccctgcgtggttgtggccccactgcagaaacgcctccgcttaacactccagcctctcttctattcggtcaggccacagctgctgactttgtgcctgctgtagcaaccccgagcccccaaataaaccctccctcccagggtggcctctctacggggggagacagacggtg

SEQ ID NO: 1384 - DNA, 921 bp, Homo sapiens
gacaaaataaccattctgtatattggatattgacttctattgacaaaatagccataacaatattctgatttagaataatactccttttctgctgtatatttgcaagcttttatcaaatattacgggagctcaatagaaatcaacaatatgaatctttatttaccacaaacattattgatgcctatgcttgtttttcttaaaatctattagctttttatgacacatttatactttttcagttgtttattactgagaagtggctgtcctgccagaaaactgctattctcagctgtatccacaatgactaatagtgagtggaagtgcagtggataaaagcaaatgtgtcttctctgtattttttttcatccattggctaaaaaacaggaggatgcagaagatgaaagaaaatacaatccctgaaagatcatgaagaagctctcaatcagacaaaaaaccccataggagattttttttttttttcattattgtactctctgcttctatgagtttaaatttcttttacacttcacatagaaataaacctaggtttcttattagaagatagactgtgatactgaaagcaaataaaatggtacatgttacctggctgcatttcaaacaggtgatggtgacactgcactgaagcaccaaaggtgattcttgttggccaggccagagctccttgtgaaaaaggttaggcccactggtatgtctgaagcgtcctagctggatggacagaaccccatgagctgttttgattagactctgaatttaaaacaccttggtgcccagtaatgaggacattttcacatttagcataacgtgatttggtgtgtggcttggatttgacaaatcttcactgagctaatggctgattggatttacttggcctgaatggaaaataaaaatcacctctgagca

SEQ ID NO: 1385 - DNA, 529 bp, Homo sapiens
acttccgccctcgcctgggagcgcctctcgccccgtcgcgtttatcgaggagacaggttctaaaagagaaaagccctcgcatttaatttctcatacctggacctgctctcccagccactgaaatacagtatatccaagatcagttctgatgaccaagatcccaaagacaaattgaagacctaggcccgaaaacactgtcctccaggacacctaggatcaataagaatattatttcaatggtgaaaactgaggtttagagagggtaaataacttgcccaaaatctggaaaagtttgccaacccctggtcttactcctcattaaggtgagcaaaaatattaaccaacattcattgcaaaactacatgtggacagccggttctttcttcttttttttttttcaagacggtctcactctgtcccctaggctggagtacagtggcacgatcatggctcactgcagccttaacctcctgggctcaagtgatcctcccacctcggcctcctggaatagctgggactacaggcacgc

SEQ ID NO: 1386 - DNA, 687 bp, Homo sapiens
aagtgacataaactggcatgttctgaaagaatcactctggatgctgtgtggagaaaacactgaaaagaattctagagtgaaagtttcatgaatataagaagcaagacaaggaagtggcttatgcttaaggccttaaaggcaaccactgtgacaatccagccattctctggagaattcagcagaaagccagttggaaggtttgaaatggaaattacaagcgcaatattacagaagtgtggattttagttacaatgtctctatgagaaagtctaaaagttaaacataagcaaaacaacaaaaacatctaaataccaggaatttgttatctcgattatggagggcgacaagtcccacagtctgccatctgcaggatggagaaccagggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggcttacctcattgatgctgaacatcctaaaaagcttctgctgctttgagtcactgaaaaagaccaagaaacatgaatttaaaaaaaaatttcaaatgttataaaataaataatatgaactcat

SEQ ID NO: 1387 - DNA, 742 bp, Homo sapiens
agatggtggtgatgaataaaataaatggctctccttaggagccttgaaaatgactatggtttctctgcactgtgagagcgacatgtgcagcacctgggcaggcgtgaggggtggacttactttgtggaacacatgggagcatgaaagcagcacctgttcatgaggaaacagaacgacgttgaagtttacaaaagagaagcagcatgtatccaacagttaaaatcctgaatgcttagaagatggggcatggttgcacggagtccccttgcaggagagagcgctgtttcaccttctcccattcatctgatgacagtggaggtggtggaggcccaatgaggcccaacttctgtgctaaagtaagacagcacaggacaggagttagagtgtcttttagcatatggcacccacctataactttaatgacaccatttgcaaacaaagattaaagaactacatatagatcacatactttatttcacaatagaagctgtccattggtatccacagggaatgtgttccaggacattccaaggatgctcaagtccctgatagaagatggtggagtatttgcatacaacccatgcatatcctcctgtatactgccagtcatctcgattaccaataattcctaatgcaagtgctatgtaaatagctgttatactatattgtttttaatctgtattatttttattatattgttgtattgttattttttattcatttattaaaattttgatctgtg

SEQ ID NO: 1388 - DNA, 645 bp, Homo sapiens
gaaataggaaagtatttaatggtttcaacataaaatcaaaacacataagtcataaatagaataattatgacttgcataattatgaccagtattgtcaggttttatgtgtctgctggtaaaactttggaatatgatttgcagaaatctcagttcaggagtttagcaaagtttatgaatgtgtacagcattaaaaagtatttaaaccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagtt

SEQ ID NO: 1389 - DNA, 4261 bp, Homo sapiens
gagatgaagtctcggtctgtcacccaggctggagtacagtagtggtgtgatctcggctcactgcaacctctgcctcccaggttcaagctattcttctgcctcagcctcctgagtatctgggattacaggcatgtgccaccacacttggctaatttttgtattattaatagagacatggttttgccacattggccaggctggtctcgaactcctgacctcaagtgatctgcccgccttagcctcccaaagtgctgggattacaggcgcgagccactacacctggccacagattttttagacccctcctacagccagacttctcccaccatctaactaacccctctcccttacctccctgctcacaatgcttatccctctccagcaaagagtctctgctctggaagacattatctcttcctgttccctctacaatacctaaccatcctattcctttctatgcatttgcgtattttcgttattcacattgcagatgcattcctcatttttctcttccagccacactatgctcagctttccattccagctcaaatttttcttcccaaaagctcttccttgtaagccccgttcctggtgagttcctggtccaaggggactgttctcctcagttcatttacagccgtcactgaattgctctgctaatactttaaagcgtgttcagctttcctcacctggctgggtacctgctgaggaagatgtcccttcaatgtttggttggagtcttttgaagcagaacagacctaagacaaagctgtgaaagagggccccaaattatacccagtatctcctccttttaccactcattcttccagagttctctcctaccatatgtgcccacccagaatttgtccttgcaaggacccttcaacgctcacagcacagtctcatcttagcctgttctctcaggatgcaggtgcttactagctggaaaaccagttgatgctactgggtgtggactggtttaaaccagcggttctcaaccctggggctacacactggaattccctgggggttttgaaaaaaatgtgaatgtacagatgtcccctagaccagctgaatcaggatctccagggtgaggctgtggctactatctgtcttcctttcccaaggtaatgccaataaactatttgcccaagctgggaagagaccagggcagccacatgacagagtagttaagagagaggttctggagcaacattgtcagttcaattgctagctctacctgtgtctgtgtggtcctgggccagcctctgaacttacctgttccctcctctgtatgtgggaataatattcatcatagtacctccccatggggcttccaggaacatcagttgaattaatacccatcaagtacttaacaccacagtgtgggcatatagaaagtgctcaacaaaggtttgctatttttttctttctttttgaaacagagacagggtcttgctctgcttatccaggcaggaatgcaatggcatgaacatagctcactgcaacctcgaaatcctgggctcaagtgatcctcccacctcagcctactgagtaactgggactatatgcgcgtggcatcatgctcagccaattttttaaaatttttagaggcagggtcttgctatgttgcccaagctggtctcgaactcctggatttgaacgaccctctcatgtcagcctcccaaagtgctggtattacaggtgtgagtcgccatgcctagccaaggtttgctactattattccttctctccaaccttctccctgtattctttctgaactccctttccctatcaaagccccatttcaggcctggtgtggggaaatgcagcaccaggtgagcatgtgttggtggggaggatttggggagacacatccccactgcttactctacctgtgctgggaactgcacaaagaatgggggtgaagtgggtgagaggccagttgggaacccaaaagctgtcctctacaattctttttgaaggctagggagatcccactcctacttcaggccatgcattggaaccaaagttgaggtgggggagagtggtggctgcacagataccatagacaagccaagacctccctgcctcgccctgtcctggcatgaaggcacaggtctgtaactacagcagcttttcccagtaccatctgacatttcttctgaatttgctttagcgcctagcagagcactccataaactctcctaaagtaggtaggaagggtaggatggggtatgggatatgagggtcagagggtcagaccagaaagggtggattattataaaacaagtagtcctaagattctgaggatgggcaggtgtaccctaaaagggaagcagtgggattcccaagtaaatacttcatctacttcacaagtttgcccaagcccagctcaggaacagtaacaaatggaaatgagcagggatgccggctgtggacaagcagaccccctaggtagagtccaccccaccttcccattaccacaggaattattaccttaccacccataggggagggggtaattgtgggcaaatttgatgggcccagtgggacagtcagaaacagcctgcctagagccctaatgtacccacccacatagctgtgacatcctcagcccagccaggctagcccaggatatatggtgtgtgtagcgcactctgctattttcctctccttgaatgtccttgaggacccagttcaggtgcctctgctgggacactccctgtgacactaccagccttctctgatctactctttctcttgactcctaagacttactgtcaggctctctggtcacctgatcaatcccaggcttgtgatacctcatatgctaccttgtaccattatttaacttttagttcatgtgtataattttcctactgaagcagtaggagcttgaggccatggctcctaaagctttgaaacccatgcagcaactgaaatagagctcagcattcattcattcactcactcactcaatagttattgagcacctccaacatgcgaagcaccgtgctaggtgctggggatttggcagtgaaccagagatgaattctacattgaagccacttagtaaatatttgttaaacagatagacgagtggatggagacatggatgcattagtagtgagtggataatgtctctatctgtggcatcccttctgctctatgttacctcagagaaaaatctcacttctttactctccgtgatcccacaactgttctggatgggggaagtcccaggaagtttagtctcaagtggagagtagggagagaggaaactaaattcagaggggtagtacccacttaaaggcatccatatgatgagtgctggggccagaagagactggaaccaatgagtcatagggtctcagggtcttcagacatcatatggggctgctacagggatcttttcagagcatccccttcaacagatgttcctcagcctccatgctaactctcaatgatggggcacctgacacaggcattccactgcttgcccctggtgatttccctcattctcacctctaagtaacatccaaaataaaaccagcccagccttgggccatgatatcctaacccacagcatgtgcacatgtacccacatctgcatatctgctctacctccagatcaaaatagcaaccagggagattggcagagcctggagtaccaggctgtcttcccagtttgggactggctgaggcactgtgacttcagtgagagtctgggcccatcctcagtctagaaaaagcttatgcaaggatgagggtagcctagagaaagtccagaaaaccacacaaatgaccacctgttgattccaaggcggagacagagcactttctccttttaaaaacagtatcctctcctctcactcaagcttagcctgctcaactgaacagccaggaaaagctgctggtgtttggtgatttgaagggaagggggtctgaacctcagaagcttgtcacttactggggaccctgatgagtttctctctgttgtcctgccttatccctaatctagctccctgatcatttgaatgtaaccctaattggacaagaattttctccctttcagtatggacaaaatcaacaaccatgaatcagagacttttagaggatgggtagtgaagtgggggaagaacagaacattgtagagtgaggggcagagaggcaggcagtgggcatgggtaggttctggttttgtgattagtaatattatctctttaattgaaaaaaataaactcatttcagattcgta

SEQ ID NO: 1390 - DNA, 495 bp, Homo sapiens
gagtacccagggacacgatacactgcggaaggctgcagggacctctgcccaggaaagccagatgatgcatatcataaattattactcaccccatgttcccaccctcgagagacctccaaacaatcaccatgccacagtgaacattcagtaacaaaaattcagccagggttttcaccagcatgaatggcagtgattccaatcaggaaaacagaaagaggagagttcagagccacctagaatggctcttgcaagatacgaaatcaaggcagcagcaacagggctgaacattcctcatccctaactctcccttcaccagtaggaaacccaggataactgcaatcaccgcaggcccatctggcctgaagttctactactagtagccctccatgggaccttcttaaggaagcatgtcaactcaggtaagggatgtaaggggatggatgaccctttgaggccaaagttggagcaaaaaacaccagatgttcctgtgcactg

SEQ ID NO: 1391 - DNA, 517 bp, Homo sapiens
aggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaac

SEQ ID NO: 1392 - DNA, 416 bp, Homo sapiens
ccaggctccagctatcctcccacctcaacctccagagtagttgagaccacaggcgtgcactaccacgcccggctacctttttgtattttcagtagagacgaggtttcgccgtgttgcccaggctggttcaagcggagctcaagcaatcagcctgcctcggcctcccaaagtgttgggattacaggcatgagccgctgcgcccaaccttcttctgctgtcgagatactgctcatcacctgcctgctccagaattcatgtggcttctcattgctcaatggattaagttcatgtttatcctggctttcaagtctttccgaagtgctgaatgaaagaacttgtaaggcatttcgggaatgccaaggagggaatggacgagtgtttcctgggctggaaaacctttacagagaaatggatct

SEQ ID NO: 1393 - DNA, 594 bp, Homo sapiens
gtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttaatcctttgaacttgtagaacatctgggagtccacttccctgtcctcttcctgatccctgctttctggactgtttaaatcctctttgggatggatcagagagtctagagaggccactcataggtccagctgctggcctcctgactctccaaagccttcactggaattgggacatttgctccagccctagctgtgaacatgaccagagacattatttataattcagccatttaagatatacctgtactcaaaaagtcctgtatatttttaaaaagttttatttttcaggtgaacaaaaatacatcctaagaactctgcctaa

SEQ ID NO: 1394 - DNA, 2156 bp, Homo sapiens
gggtggctttgtgaggatggctttgtgtggctgcacattgcccttggccaagccccgctgccaggagaggcagctcggctgccaaacctcctgaacccaagttacctgagcaagcagccctatcccctcgcctgcttctcactgcctcgcctgccttgggcctgcccgacccagggggtcacatgccttgttccccatcagtggagaccagggacaagaagacagttctgtgggaagagccaggaggaccatttgggaaaatacaggttccaggtgtgtctccagaccttgagagttggtgtctcctgggaagaggccctgatgagatctggggagattcggatctgatgagattcaggaagccctggcctctccgtacttgaggagacgggacacacaggacaagctgcaggctggtgagcaggttcaccttctattttgaagacccgcttcttcctcaggtacctgatcttgaaaacgacctcccctttcaggccggcgtgcagcagggcaatcgtggttcactgcaacctcgacctcccagggtcaagtgatcctccagcctcagccccacaagtagctgggaccacagacggttgagcccatagaacaggagtgagaagatggaagggcgagggggctgggatgatgaaaacttgcgcctgcagccaccattcattacagagcgccgggggccagctgcagaactgtagactcctcatacatcatcgtgttgagtcttcaaaacaaacctatgaggctggagtgcagcagcgcgatctcggctcactgcaacttccacctcctggtttcaagcaattctcccgcctcagcctcccgagtagctgggattacaagcacccgccaccatgcccggctaatttttatatttttagcagaggcgggatttctccatgtagcccaggccggtctcgaactcctgacctcaagtgatccacccacctcagcctcccaaagtgctgggattacaggtgtgagccaccatgccccgccagccatcagagttttatagcaagaatttttacctttgtccttagtgcaatgggaaatccttgaaacgctattattgccttcctctgcaaggaaaggttattttggtgagcagtggatagaggaaatgcagagggagccactaaagggttctggtgagatctggagccctgctgggataatctgaccagagaaagcaaagattccagagagctaggcacacttgccctacctccagctgcacacagctggttccagctttgtcctgaccttcagtctggcatacagggtagacccactggtacctggtacctcactctgggggtgaggtggccacccacctaggtctgggtcctgtagcagtttggcagcaacatctgggtgataagagaaggcgatttgacctactcccagggacaagaagctttgactcttcaagatcataaagtcttccctcctggccttgggtcctcctgttgcgggagaggtgaggtggggtgagggtcctccgggagggcaggcttggcagagcccagcaccatctcagcagacactgctcttctcctactctcagcacctccaaggcagtgagtggctttctcttgtctagaggacaaaatccgttcctcacctggacacaatgaacctgtctgtgggatttagggagcatcaaggagggaatttagtttccgcagacttcaaggaagactttctggaggaggtgatgcctgagagctatccaggagagaagagtgaaaaaatgttaagcagtggaaaaacatgaaccaaactgtggctgcatcttcccatagggcaacagggacttagcgcgtgcaatcaaggatctccagatggggataacccaggtgtgcccaacctaatctcagtgtccttggaagagggatgcagaaggagtcagaatcagagaagaaggtgacacgatgaaggaatccgaaattagagtgatgctctttgaagatggaggaagggaccacaagctgagaaatagaggtggccactagacactgaaaaaggcaaggaagtggattctcccctggagcctccagaaggaaccagctctgccgacaccttgacattagcccattgagactgatttaagggctgctggcctccagaattgtaag

SEQ ID NO: 1395 - DNA, 679 bp, Homo sapiens
caggaaaactgcacctgagtacatgcctcgttctccacttcatctaagcaaagaagagatcctacaaacaagaatacaactaagaaaatgaagaagctggaaaaggacacagccacatggaaagcccgatttgagaactgtaacaaagctctgttggacatgattgaagaggcttctctgccgtgcgtcctcctggaggaagggaggaagcgtagaaggtgccgatgcacttttcctctctccagccctcctgactgctccaagaatttcatcgaacaagactcaaagaggcccagctgctctgcgttttgattcttctccctctctcagtccacactgacctgggaggggcttctcaaacaccacatttcctagcgtgctgtgagaagaggactgtgagctaagaagggagaaaaggcactccctcctcatcaacaaacacctgacctgggtagaccctctgcttaccaagatccagtccaccttttgacatcagcattcatgctgcctctttttacgaaccaagccaaagtggtcccttcctctggaaattataggatacttaatgtacatcatatccagcttcccgactccagactgtgggagatgacacagagccagcctgcctggatgtgactcagctctgcaacttattaaagacctttggcaaatcacctaa

SEQ ID NO: 1396 - DNA, 4094 bp, Homo sapiens
atatggtactttgcacctcttcataactctgaactctgcagtgagaggtcttggtcccacaaggggacacagttttgctgagagatatataaaaaatctcactgaaaaacataagctgcagcagctacctggatactttcggttccttgtgtctgtctagggagcagcagccaataaaaggagtcaagatcagttgaccctaatcaagaggagattggaatcctggttacacaatctgggcagaagtaataaatgtggtgcccaagtgataaacctaccaaattgagactaatgtgtaggtgtggcaacccatcctcaaaagggcatgatggcctggaactcaggcctctcaaggaatgtgggtctgaattataccagataaaccaccaggagcagcagaggtggtagcagaggctgagggaaatctagaattgatagtggaggatgaggggatgtgacaagtattgatggcattcccaagccccactgcagcagcaagcactgtaatttgtcccactaatctcccatcttctaaatttctgagaggtcaagaaaagaggtctcttgattcctttaggaactgctccctaagcatacagggagacatagatctatgtggagcaaagggtggattgtaataagcaaagagatacactgcctgattcactttaagaaaggactgacctcccagttgcaaggaatgaggtcagcagcctccaactgtcagctccttcagagtctgcttcaactgcagaaggacactgtgcttgaggtcatacccttcccatgtctggtgactgaagtccagctgaatgtagctgccaaagttaccttaatgcccatgggaagcaaaaaatcaaagagtttaaacagaattttgagaaatcccaaatcagttttttttcagcatatgacattttggagtagtttgttattcagcaatagataacagaaattggtatcaggagtggggtgttaccataacaaaaggttaaaccttacatggtaaaaaggactttgcctctgtcattaagttaagcactttgaaatgtagagattatcctgaattatctaggtaggctcaatataagcatgagtccttaaaagtggaagacggatacatgagaggatgtcagaatgatgtgaaatgagaagaactcaacctgctattgttggctttacaggtgagtgataggaaccacaagccccaagcagcctctggaagctggaaaaagcaaagaaacagattctttccagagtgtccagaaaggaatgcagttcagctaacatcttgattttagatcagtgagatttttgtgttggacttctacagaactatataagaataaattgtgttgcttaagcacactataatacatgtggcaagaagctgccagctaagccttgaagaatagtgaacaaactcttactggaggatgggaaggcagtaaataaattattgaattattgaaataaatggaggattgagttatgcattgacagaatgcttagcaataattttgcttgtcttaatgtggaacagaaaatgaaacttaatagcttgtagatgtcttaaggagatttccaggtgaatgttgaaagtactgatgaacttattatggctgcatctcataatgtacaggaagacatttactgagtgaactaaagaaggaactgttcaatttgaaagcagaatttagaggaaatttttcaacctagtacttgtcatttttttatagaaaaggaaaaatagatggaagatggagccaaaatcccagagggaggagccaagaagcaaggagagcaatggattaggaaaccactaccagagggatgaactgaaccacaatcaaggaatagcctcttcctttggtgtagggggaccctgaaaacaatttaattttatgcttcctgtttccttgtctccttttttgaatgatagtctctgtgtggtgttcctatcctagaaaaccttaactgggacaagctactctcaagcatcttcacttgagaaacagtaactgaggaagtttattgtatctggacatggtttagatgataagattctgaacttaaacttatgccataatggagtgagactcttagggtacagagtaagtacatttttgcatgttagtgagacaagaactgtggccgggggcagactgtgatagtttttgaagatgtccctcaaacaattccttcccttccttggactcctctcttcagagggtagagtccatttccttttccttttaatctggattggccttctaactcactttgaccaataaaatgtggtaaaagtaaggtctggcagttttcactttcactctcctgaaccttcatattagaattccaggatatccttctagagatatccatatctctagggacatggtgagtccctagagacaccacatggaaaggccacctagggaagaactgagatgccccagtcaatagcactgccttagtcagtttgggctagtataacagaaatatcatagattgagtgactttttttctttaaaaaaatgagattgtggaacctgaaaatacagtgtagtaagagtggagagaaaggccacctaaggaagaactgagacgtcccagtcaatagcactgccttagtcagttggagctactgtaacaaaaaatatcatagattgagtgacttaaacaacagaaatttatatcttacatttctggagactgaaaatatggaaatccaagatcagagtttcagcatggttaggtgtttagtgggcgctcccttcctggtttgcagacagccatcttcctgctatatcctcacatgatgcagagagagagaactctggtatctttgtccccttataagggcaccaatctcatcatggagggtcttcaacctcatggcttcttggaaccaaattacttcccaaagtcctcacctccaaatctagcacattgaggtttagggcttcaacatatgaatttcagtgcatagaaagcaccaagtcctcagacaaagagaacttgaaccttctaactcagcttagccattatctgcatgcaaccacataagtgaccctgggtaacaccatctggagctgaagaaccaccagccagtacacagaaatgagaaattttaaaatggttgatttaggtaattaagttttggggtggtttattacatagcaattgataactgatacaacagtcttttcgttagtagaagagggggtaagaaagaaagacttatgaagaaaagacctgtagaaaatcgggcctacgtacctctatttttttttcatactcccgtgttttttttagtccatgctggtggtatcctcatcaatgcaattttctttaaaactctgtgagcctttatatcagattagtccaccccattagaacaaaagcaacttctataaatattgagacattccctttctacctttggctaagaattggggtgctatagataattcccaaaagattatctagcctacagggccgatgaggtatagcttgaagtcattctaaagtcttcacaaaggatcttacagcctttgattttattatcactctgggaccacgttttactgttggcacgttcggcttttctcatcttttccctgagatcatttatgatgtggaaattactttgctggctgaagttgggaatagaaaacagtagagaatacttcaagagtattctaggtatgcactaagtttatgggaagatatgccatctacataatttaccttcctctctaggcccatcataaaaatctttgaaaaattaatactacattttagtatgaatataagttaaacttagaggtgatatctattttgtggttaaatgtgttataaacatttatttagtgaaatacagtacaattacaacaagcatcaatgaatatttaatgagcagctgttaatttctgaagcagaaagaaagatgaataaaagttctggttttacttttaaaagtgaaggctaactgttagctcaagaaatactttatgtttgtcctatatgaaagtgttgattgcacctggttctttgctgtaaattaaataaaaattcaaatatttgtaaaa

SEQ ID NO: 1397 - DNA, 693 bp, Homo sapiens
ggcccctccagacgatggccattcctgttgccttggtccgcaggaacgatgggttatgcatgaactttgtagaacatggccttgtcttcaccaacgcggaggagagcccgttcggttccagagaggatgctgcctcatctcgtctctaaaagaggaggaaggggagcaggtcccttcacgttctctggtctcagctgagaactctccctggaagtagcgggccgtgaaatgtttcacaagtgacaccagtgatgctgttaaacaaggacaatccggttcatggattgtgacaacgcacgctgacatcaagcagaccctgccgtcaggtacagagggcaccacagtgaccaggaactgctgtcctttcataccaggttttaggaggctttaccagaaggaatggaaaatgctggtgggcagtaagattgaaacagcatctgaggactggttctgcacaaaaccttaaattcttcaaggactttgacatttgtttattcttgtaacaaattaaaacctatcctgtgtgttggttagagatcttcaaactgtaaataccttgaggcaggagtgaggtttttatcttttaaaggacaggcccctactctcctacgtaatgagtttctaaaaatggatgtgagcaccaatcaatatttctctggttgttaaagtcaagaataaaatggtatttttaag

SEQ ID NO: 1398 - DNA, 2598 bp, Homo sapiens
ttttggggctagaagttgcggactagtagctgaggcggcacgggagtgtaggcgcgcggggtcgttgccgggggcacagagtgagaacaagcaagggagccctgctgaattgcagcttaggaagccctgaatcctggagatatgttcctgacccttccttcttgaagggacagctgtgtaaccattcaaccatctggccatcagtttccacatctgtgaaatcaacttctgcctcatggagccgtgagttcccaagtgaaggcagtgaggggctgtggtgtgatccaggaggctgagaattatgcagtgggtgctgtcaccttgaagacatcagcgtgatcaggcagatcatcatggtactgcatttcctggacacgatcttaattttcttaatacctccaccgacatttcaaatagcgtctctaatgccccagagacttttatgcccctaaggtagttttctttcttttgtgaagcagaagaagggaaattgttaaagggaatattttaactaaatttatttccataaaactatctttgtctttatatctcatggaaagtgttaggtagcctcaggattatatctccgttggaaaactgtagatgtaaaccttcttgctatctacatacttacatatttttctgttgttatttacttatgaatagcattttgattatagcagaaataaaatacattaaatgactaagctcagaaataagaaaaaaaggtcaatggtgatcatttatttggaaactatgatattttaatgatattaatggtgtaattgacatttagttaaacatatttcatcgtaagtagagcactttaactcttacggtccacttaaaatgtaatcatacgtttatgtatttctagttaatgtatcaaactcaactgagtaatcaatgtacatcatttattttgctcctaagttaatacactaagttatgctttaaaattactaatttgctgcaatatccaatactctcttttaagtcttacgtctgcagaaaaggatataaacatttcatgacaccaaacccaagtatttttgatgcccttggcagtgtcagttgaacagacagtgtcatttaatgtttgagacagcatctgaattccttttattcttaaaattctattttaaaatgcagtttttggaaagttaatgtgaatagaaaaatttctaacattttatgtgcatgtgttttgtttgttacaggcttagcatctcaaatctgaaaattcgaaatctgaaatgtttctaaaattcaactcttttgagtgctgatatgactttcaaaggaaaagctcattggagcatttcagattttggatttttggatttgggatgtttaaccagggtaaaatatagaatgcaaatattccaaaatctgaataaaattgaaatctgaaatgcttatggttccaagcattttggataagggataattaagctgtataacttataaaactgaatataacaaaatttcccaacatgtggaaaatgatgtcttttttcaaaaatgtcaatagcagatacatggtacagtaagttaggggaaaaaatgaggtttcatatcttctagtttcctaattaaaaggagcccattctgggttggaagaaagtgtcagtaagatcatttctcctatttgaaaatcatacaaagcttgtcagagtgactcaggccaggagtgtagctgggcgtgtagctaaatgatatctccccacatctatataataagctgttacctgctttaaaaggaaaagctctcagcatgactctaatgttgcatttctggaatacagcttgaaaagctcttctcagggttgaacagagcatgaaggtaatggttattatctactcacattaaaaaaaaaaaaaaagaaagaaaccaccacagaaaactacttactgtctttaggctctactttcaaaagtgccctttatgaacgcttttacactgttgatgggagtgtaaattagttcaaccattgtggaagacagtgtggtgattcctcaaggatctagaatcagaaataccatttgacccagcaatcccattactgggtatatacccaaaggattataaatcattctattataaagacacatgcacacgtatgtttattgcagcactgttcacaatagcaaagacttggaaccaacccaaatgcccatcaatgatagactggataaagaaattgtggcacatacacaccatggaatactatgcagccataataaaagatgagttcatgtcctttgcaaggacatggacaaagctggaaaccatcattctcagcaaacaagaacagaaaatcaaacactgcatgttctcagtctaagtgggagctgaacaatgagaaaacatggacacagagaggggaacatcacacactgggcctgttggggggtagggggctaggggagggatagcattaggagaaatacctaatgtaaatgacaggttaatgggtgcagcaaaccaccatggcatgtgtatacctatgtaacaaacctgcatgttctgcacatgtatcccagaacttaaagtataaataaataaatgaataaataaataaattttaaaaagtg

SEQ ID NO: 1399 - DNA, 525 bp, Homo sapiens
gagaccattaggagattctgaaggacctgtgatgtgtgatcctgagagagggcgtcaatggagctgggaccagctattgaagtactggcatatgcaagagggagaacaaagaaaaaggaccagtggatacaaattacaggaaggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaagggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagcttttt

SEQ ID NO: 1400 - DNA, 82 bp, Homo sapiens
tgccacaatgatgacagtttatttgctactcttgagtgctagaatgatgaggatcttaaccaccattatcttaactgaggca

SEQ ID NO: 1401 - DNA, 497 bp, Homo sapiens
gcttccctttaagttttaataggagtggctttgttttatagaacgctgtaggcatctccagccactgaggggacttcttcaagcttggcccagcctcatccacagaaggatctggcagtgatatcttggcattcatagtctcagtgtgcaggacagcattggttccccaccctacagtcccagctctacctaggcagtatcatatgtatcatggtaatggctatggaaaataatatccctccctccctgcctcccttcccctcttcctctttttagagatgaggtcaggagtttgaaaccagcctgaccaacatggtgaaaccccatctctactaaaaatacaaaattggccgggcatggtggcgcatgcctgtaatcccagctgctcgagaggctgaggcaggagaatcacttgaacctgggagccggaggttgcagtgaactgtgatcgtgccattgccctccagcttgggcaacagagtgagactccatctcaa

SEQ ID NO: 1402 - DNA, 4208 bp, Homo sapiens
gcgcggcggcgactacagacgtgtcgggggtccggggcctgtcgcggttgccaagcgctcggcgcttggcgctggcgctggccaaggcgtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggttggaatcaatgctgctctggggaacatggaggaggacaactggaggtggcatttctatgacaccgtgaagggctccgactggctgggggaccaggatgccatccactacgtgacggagcaggcccccactgccatggtcgaggtagaaaattatggcatgccgtttagcagaactgaagatgggaagatttatcagcgtgcatttggcggacacagcctcaagtttggaaagggcaggcaggcccatcggtgctgctgtgtggctgatcggaccggccactcaatattgcacaccttatatgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggctacgggcgcacctacttgagctgcacgtctgcccacaccagcaccagcgacggcacggccatgatcaccagggcaggccttccttgccaggacctcgagtttgttcagttccaccccacaggcacatatggtgctggttgtctcattacggaaggatgtcgtggagagggaggcattctcattaacagtcaaggcgaaaggtttatggagcgatacgcccccatcgcgaaggacctggcgtctagagatgtggtgtctcggtggatgactctggagatccgcgaaggaagaggctgtggccctgagaaagatcacgtctacctgcagctgcaccacctacctccagagcagctggccatgcccttgcccggcatttcagagacagccatgatcttcgctggtgtggacgtcacgaaggagccgatccctgtcctccccaccgtgcattataacatggacggcattcccaccagctacgaggggcaggtcctgaggcacgggaatggccaggatcagattgtgcccagcctgtacgcctgtggggaggccgcctgtgcctctgcacatggtgtcaaccgcctcggggcaaactcgctgttggacctggttgtctggtcaggcatgtgccctgagcatcgcagagtcgtgcaggcctggagataaagtccctccaattaaaccaaatgctggggaagaatctgtcacgaatcttgacaaattgagatttgctgatggaagaagcataagaacatcggaactgcgactcagcatgcagaagtcaacgcaaaatcatgctgccgtgttccgtgtgggaagcttgttgcaagaaggttgtgggaaaatcagcaagctctatggagacctgaagcatctgaagacgtttgaccggggaatggtctggaacacggacctggtggagaccctggagctgcagaacctgatgctatgtgcgctgcagaccgtcaatggagcagaggcggggaaggagtcacggggcgcgcacgccggggaagactacaaggtgcagattgatgagtatgatcactccaagcccatccaggggcaacagaagaagccctttgaggtgcactggaggaagcacaccctgtcctatgtggacgtcggcactgggaaggtcagtgtggagctcgttctcaccacagcccagcacccacacggccccgcccaggtctgcgggctggccttgctgatggtgaacgcggaggagcaggccagatttaaatcaactcccgacagatttgaggcaccgctgaaaaaggcactctgacagcagtcgggcttcgggctggaaacagaatccagtgcctgcaggtggttcagaggagccttaaggaagggttgctctgtggtgtgggccagatggaagtcactgggcaggagcaagtgtccaaggcctggtggcaggggaggagatgatgattgtggacctagcgagaaagtcagcatctgtgtggtggggacagagccactaccagaaaccagtcccgagccaagggagcccagaagagacccctcccctctcttcccatgggctgggccaactggaagcatctgcaggggagcagaggggatgtggtgcagcccttagcatcccctgggcactgagcaagcagagaagggcagaaatggaggcagggttggggtaagcagcgtcctgggaacagccagccgagggtgtggtaggggggttgcagcttgttccacacaagcacagcgtcttgggaacagccagccgagggtgtggtagggggttgcagcttgttccacacaagcacagttcacctgtgtggcatttccactgggcattgagattcagaaatcatgaagatagaaagcttttacccttaagcttttcataacttgtaagggagagtcgtataatcacttagctgtgtctgtggaagttacctttggactctcactatcatctagtgtgtctgtgattcaggcagtgggtcattttcagaatttatcatgaaggccatttcctgatagtatagagaggtcacacttcactcgcttagcacaagtctatttttaatgtttccgggttcaggttttttgttttgtttttgttgttctgagatagagtctcatctcttttgcccaggctgaaatgtggtggctcgatctcatctcactgcagcctcaacctcccctcggctcaggtgatcctcccacctcagcctcccgggcacatgccaccatgcctggctaatttttgtatgttttgtagagacggggttttgccacgttgcccaggctagtcttgagctcctgagctcaagtgatccacctgtcttggcctccccaacaggcatgaaccaacacgcccagccagtttcagtgatttttgaagaaatacatactcattttagaaagtacaaagagattgaaataagagctcactaaccagagatgacccattatggtttaaatttctttgtatatgtgcctaccttttcctgtgtgtgcatatttaatacacggcttgagtattccttctctgaaatccttgggaccagaagtgttttggatttcaggcttgttcagactttggaatatttgcattacacttactgtctgagcatccttaatcggaagatctgactccatagcacatttcttttgaatgtcatgctggtgctcagaaagtttcagatttgggagaatttcagatgtttggattagggatgttctacctatataaatatttactttgaagtagaaaaactggaagtagatagtttaaacatgaagtgtcttggtatagacaagggttctcccacttttcatgatgggagcatttttgtaaagcaaagcactgagaatctggtacagtgtcattttcgttgctctgttccactctaccgatctgccgtcatttacagtcccctgttgcgcatgtagatcatttttgaatttgttattggaaaatactgcagcaaataccttaaagttcacatgccgtaaatctacttttatagttaaaatttttcaaaaggaacacaagagatggctttttgtacatttttgtgcttaacttaccactgacttcttttcaaggtcactgtggaatatagacccataattgacaaaactttgaacgaggctgactgtgccactgtccccccagccattcactcctactgatgagacaagatgtggtgatgacagaatcagcttttgtaattatgtataatagctcatgcatgtgtcaatgtcataactgtctttatacgcttctgcactctggggaagaaggagtacattgaagggggattggcacccagtggccggggagcgtggcacttacctttgtcccttgcttcattcttgtgacaagataaaactgggcacagctgttaaataaaatataaatgaacaaa

SEQ ID NO: 1403 - DNA, 928 bp, Homo sapiens
tgcacacatcttcttctccaaggtttgtgtgcagaacatcctgcccatgctgacccaggagcttcagttggcacctgccccagtccagcctctgggaaccatgcagcagctcccagcggccctgcacccaccaccagcatccgtttcacctgcagttgaagatccgtgaggtgcccagaagatcatgcagtcatcagtcccacggagcagcccgcgaggctgaggctcctcccactggaccgccccccaactggcaccactgctgcccctgcccctactctcagcctcacgtgactctcgggcagaggcagtggtggggcagccagggcagcgtcaagagtctgagccagctgcaggacaaattcgagcatcttaaaatgattcaacaggaggagataaggaagctcgaggaagagaaaaaacaactggaaggagaaatcatagatttttataaaatgaaagctgcctctgaagcactgcagactcagctgagcactgatacaaagaaagacaaacatcctgatccatatgaattcctcttattaagaaaaataaagcatccaggattcaatgaagaactatcaccttgttaatcattcagaaacatattgcagacttaagccatttttgatacagatactgaaacaattactttctaagagcaaacttgaaggtatggataaggccctgagtcatcttcctgagctgaatgatagttaagctgaatgtacgtataaaatatgattttctaaccacttgctcgccaacaaggaaaacttttaagtagagcagaacctgaatagacaagacatttctttcttttggtagaaaatgatttaccatcactgtgtagttaattgtagactaggtaattttaactgtgatttattgccggagacattttcttctgtactgtaaagtgtgtgtc

SEQ ID NO: 1404 - DNA, 653 bp, Homo sapiens
ccgggaggtcccggtcccggcagcccgcggccgcgtccttggccctcctccgggggaacctcgttcattccaaactctggaaggccggctgtccttcggttactgataaggacgcgagctcttggaaacccgggcacagagaggttaagtaacttgccccagggcacacagctagctgatgtcagtgccagaattccaaccgcggctgtcggaccccatgccatcctcatgtcaacccactaaggacgggatccttctgtccatcttaaagatgaggcaactaaggcacatggaaatttaagtataataccttgcccaaggtcacctagctggaaaatggacgagacagaaagcgaacccagggctcctttctgtacgcagaacccgcggtcttggccataggcgatgccacttccgacagcccagcagggtctggccctgggtcccagaggcgcagcccctgcggggtttggatgggttcctgcggcctccgatccgctggtgaattgggtgtgtctgagcatcgtccccgctcagcccgcaggcgtaggatagggaggcgtctccgggaatctactccgggacgggtccgcggtcctcagtcgggatggagcgggggcggaggcagccggagggaactggagtccccattg

SEQ ID NO: 1405 - DNA, 314 bp, Homo sapiens
ctcattttttaggaaggaaccacatgtgaaaccacttacctgtttaaccctatgaacttgaagagaacatgtaatgccacttaaaatacctaagctcgggttctgccttcagcgactcctggtagtagtgcccttatgagccatttatcaagaagaaaccagggcacttggaatgttttgagggaggcagatctgtccccgtcatggagcactgactaccatcttccctgaactcttacgtgaggaagaacaaacctctaaggttgtacaagaagcatggtaccagcacctgcttctggtgaggcctcaggctg

SEQ ID NO: 1406 - DNA, 2261 bp, Homo sapiens
tctttcaggatgaatgccatccacacaaaagagctcctgttgacatctcatttacaatctcccccaggacacagacaagaccctttcaataaatccagctcagaaacacctattgttcaaaatcttcaactcgccacaggctaccaccactccctatggctttgcaaaattaaagatttagaagaaggatggggcggtggaagctatgaaaagaggcaggaaaaaagttcctttgacccgatgctgtcagagagcgtgcatgaagaagaaagttaatggtatttccatttatataagaagcgcctaagaaatgcctgtgacgttcgtgaactagtgattgtgaattccaaatttgatgccaactttatgtgtaaagaagctaactcctgccaacatcgtggctgaatgaacagctgggactatgcttaacccattcccagcttataaaagccccatggcagctgcagtgaagcatcagaaaagtatagtaagaagaaactgaatttgaagtggattcttacaaaggaaaaagaaaatcactattgtaactataccaaattactatgtatgtgagctcccagctttgacatcaagtcgttacagccacgtaatgggattacgggtgatttttactttattctttgggcttctctgaattttcctatattttgaaaaagcacctgcattattttgtaattataaaaaagtataaataagaattatacacactattatttcttcactgctatgacatgactagattacaatttttttctttttgagatgactttcggtcttgtttcccaggctggagtgcagtggcacgacctcggctcattgcaacctccacctcccgggttcaagcaattctcctgcctcagcctccccagtagctgggattacaggcacctgccaccacacctggctaattttagtagagaaggggtttcgccaagctggccaggctggtctcgaactcctgacttcaggtgattgatccacctgcctcggcctcccagagtgctgggattagaggcatgagccatcgcgcctggcctagattatggaatttttgtattaccatgtatgttgccgtgtaatttttgttttgaaccttttttatttttcttttaattcctttgagacaggatcttgttctgttacccaggctcactgcaacaaggtgattttcccgcctcagcctccagagtagctggactacaggccggtgccaccacacccagataatattttatattttttgtagaaatggggttttgttttgttgcccaggctggtcttgagctcctgggctcaagcgatccaccctcctcagcctcccaaaatactgggattacaggcataagccactgcacccggccttgagcatttgttttttgaaggaaattttatatgattaccacataaaaaaggaatactaaaaatctaacattatttgatatctcactgtctttgaaaacttaaggaacatggacccatacaaggcagccaaatattggccggtaactcctttacaactgggctgcagcatattttattaccttctcctgacaatttcttatctggctgcttatcatttccagaacataccatccttttgcatgcctttacgccagtggcaaacatggttgtttgcctcctcataaccattctctctatcctgcttgctaatgagaccccagtactgttgatcttttccacacagctgtgagttttaggggtggctaagcccctccctacacgtggaggctgaatcttcaccagactaccagacaaagagatgagaagggaggttggatgggaatgttctgggaaagtttacctcactatttaaagccacccaagtcagggacatcctttttcttcctctggactttgtcatctgcaagggatgctggaactgtggctgccatcgggggaccacagaaagtactggcctaagaagaccagctcagctgggcgtggtggcctgtaatcccagcattttgggaggatgcgggcagatcatgtgaagtcgggagttcaagaccagcctgaccaacatggagaagccctgtctctactaaaaatacaaaattagccgggtgtggtggcgcatgcctgtaattctagctactggggaggctgaggcaggagaattgcctgaatccgagaggtggaggttacagtgagcggagagggcgccactgcactcccgtctgggccaatgagagtgaaactccatctcaaaaaaaaaaaaa

SEQ ID NO: 1407 - DNA, 781 bp, Homo sapiens
ataaccgtccagtctacagaatatcacaggctctacttttgtgtcaatttaaaatgaggatacagaaaatgaaggcaaagggaaactgttgacaatcctttgaagtcatgaatatacaagagcatgaataagagaagaaaagatggaagataaaaagcagaagggtgctggagatataatggtgaataatgttgcaatatgcccagtcttcatggaatcaacagtccagtggggaaggcagataagtgagcatattccttctacttacagaaaaagtcaactgtaaaacagcctcaggcaggtctttcaggagatattccagaaggcattgttatcatacaaaatgatagctccatgagtatcattttccctgaagaccagtgggacaagatgaggagatggaagacagtgatatggatgatcctgaacctgagactgtataggcctaggctaatgcatgtgtttgtgtcttcgtttttaactaaaagcttaaaaagtaagaaaaataaaaataaaacatttgaaaatacaaaaatcatatagaattaaggacataagaatattttcgaacagctgtacaatgtatgtgtgttttaagctaaatgttattgcaaaagagccaaaagtttttttaaaaagtttataaaaacttacaataagctaagattaatttattaatgaagaaataatctttgtatataagtttagtgtagcctaagtgtacagtgtttataaatctacagtaatgtcccagaccttcacattcactcatcactcactc

SEQ ID NO: 1408 - DNA, 3907 bp, Homo sapiens
gattctgtcgcgaaccctctcacggcagctatgagactgctgcgctccccagacgaggaaacctggtctcccggagccaggtggagtctcgctctgtcgcccaggctggagtgcggtggcgcgatctcggctcactgcaagctccgcctcccgggttcacgccattctcctgcctcagcctcccgagtagctgggactacagagtcttgctctgtcgcccaggctggagtgcagtggcgcgatctcggctcactacaacctctgcctcccaggttcaagtgattctcctgcctcagcctcctgagtagctgggattacagctctgggacaaaccagcttctatgtcatgagcacactcaggcagctcattggagagatctgcatggtaaagcaatgaggcctcctgccagcagccatgtgagtggcatcttggagccagaccctccagccccagtcaagccttcggatgcctgcagccctggctgacattttaaccacaacttcatgagagattctgagccagaatcacccagctaagctgctcccgggttgccagatcaatccacagttctccagggacccattgtggttttgtgcttcctctgtgcctgttctgctcctctccatgcaccccagcccctcccagtcccctcaacggtccttctggccaggcccatagccccctctctgccccacagtcctcaggctccagctttctcgttaggaagtgttagaaagttgctggagtgagaaatgagcctgtgaaactcgttgtcctaattaaacttccacaaggagagtgacaagaggcgacggggaggaaacggtgccaccaccaaggtctcagcctgggcccaggtcgaggaaggcctttgtcctgcagaacaaaagccactgtttgcacgtgttaaacttcatcaaacttcaacagacccaggtgcaaaaccccacatcccaaatgccatccgggcttatgccaccttcccgagcatggaccgtccctagccgtcaaccctaatcagggccatgccctacatcaaagctgcactccctccacagacagcttctgctctgagatgcattgttcctatgacttcctacactccgcccttgtctgacgaattagggcacggagcccccccatggcacagctgggccctgctggcattgttaatgaggtaggaagggcgcgtttgtctgagcctgggactaacataatcacataaagttgttgctttggaatagatggagctgccccagagtcgattttcttggaagcaacgcaaagcacagcttcctgggagaagacacaatgcctcctattgtctctgccacttcccctccagcctcccagcatttctgcgtctcctcgggagccactgccctgtgcaagagctgtttgctgatgcccagccgcggcttccaaaactcccgcgagaagtcgtttctgtccacagtcattgtttccagaccagccgagccaactggggaggagaggccaagcccagggagagcagtaagaggcccagcttgcaacacaggcccccggcggctggagtcggctcatgggttgctggggggcagctggtgccagccctgctagacatgtccagggtcggggcagaggccagggtggctctcatccacaacgaggctccaggaagaggctccagagggcccaggtccctggaggaagacagagggtggattatccagtgagtcctcagattgctccagggagactctacccctaggccctcatcctacctaggactgaggcagccatctgggtctctgcttccctaaccacttcctcctccacccgaccatcacctagtctcaaggacttgggcagcttctggaagtggctgagactggaagaatgttgtcacacctaccagatatccctacgtgtatctctaccacccccactacatattctgaagaaccaaggtgagctgggggaatccccaggccagcagggcaaggcctgggcaggaatggagtgaggaagtgagaagtggggatcttgggggtgggcgggctgtggggctgggctgtgctgcacactgggcaggaggcaggagatggcaatggaagcgacagctccccatcttccccggctgcatacgtgagggattctgctgcattcactgagtcaccaaaggacactggaaggccatcaggatttttgggtgaccaagacatggctcccctcttactgcctgtggggagacaggcatgtgaacacccaagtctaacccaagctgagttgactgagggccatttaaagattccacagaggctgagagcagtggctcatgcctgtaatcccagcactttgggaggccaaggcaggtggatcacttgaggtcaggagctcgagaccagcctggccaacatggtgaaaccccgtctctactaaaaatacaaaaattagccaggcatggtggtgcacaccagtagtcccagctactcaggaggctgaggcaggagaatcgctggaacccaggaggcaaaggttgcagtgagccacgatcacaccacagtactccagcctaggtgacagagcgagactccgtctcgaaaataaacaaataaagaaaggttccaaggatggtctggaggacaaacaaaggaggagatttggtgcaggagttaggacaaagactcctgggacagcagccctcacttggggccatagtgaatgaatgggggccttttgcagaagggaaatggaggacatgtgtggtgaaggctttgctgaagcatctcttataaaaggggcaaaagcacttgctctcctcccagctctggctcagcctctctctcttcaagtccctggcatccctggaaaaccatgatttttccattctgcagccagcccaggcacctcctcccacccccgcacactgcagtctggtgtgtgtggtgggcacacatagaacacttgctggtcttgaaaatgaagccatcttttggggcccctagaaatcaaagagacccacttagccaagatatcactcttggacaccagcaagggtgagatcacttgataggtattttgccgtgtgtttctttttaactatataaaaaacaaaagggtggatgtgcaaacccaacccaagaataccttggctcaggctcaactagatgaaacttttaaaaatgatttaatgttatgttagactgttgcatattaaagcgatgtaatgccttctaagaaacgagagtcagatcctgaaagcgatgacttgggtaaatgtaaggagttataactcacttttcaagagagcaactataaacattttgcccaatatgtacagacctctaatgacagtgtgcaaagactctttcgttcccagattatgaggctgccactttctcctccccttcctgagccgcacttttctaaacagcaactgtcggggcagggggatgggaagctcatgagagaaggaaatatttgggaccgtgtcggccagtggaatggggcttgtggtcaccgtgttacagagtcaaatcacttcccagtaaacaccagtttccgatggctctctggccagggttggccggggacaagcagggagtatatgtgtcgggtacgttgcgtcacaagctgtgcagctgtgtaggcctctctgtccagaggcattaatggaaaatgattgggcacccagcccacagcagatgcgctgaggaatccagccagggggagctgggatgcagtgggagaggggacacgcagggcctggctgagaagcctcgcgaggtaaccacaggcggaaatctgaaaaatgaagacgttcccaccagttccagaaaacagggctaacttaaaatgcagcccctttccttgaagtgggcttggcaggccccaggtgttgaaaggcaaaagaaaaaaaag

SEQ ID NO: 1409 - DNA, 1122 bp, Homo sapiens
acatacaacactcatacaacacacattcatacaacacaacactcatacaacatacaaaacatacaactcacaaatacatgtacaacacactcatacaacacataacactcaaacatacaatgaatgcaactcaacacaacatgcacatacaacacacatacaacccatgccactcacatacaacacaacacgctcatacaacacattcatacaacacatactgtacagattctaagtatgaaatagaaaacagcacatgcacagtttctaaagtatgacaaaagcttttttcaagaaggtcatccaacatccaaactggtaacatgtcctcattttcagctgctgttcagattcaagcatgtttatcatctgctccatgaattacaataatatagcataaacccttttttcattttacacccactttggtgtggggtgctccaaaacaggggccaggagcctcagtcatccctcggaacaaaacacaactcacactcagaggccaggaagggaactcggggggcgacacacactctctcatctgcagagctctgcttcaattactttacatgtaaccgcggctggaacggggttggtgacggtacagacacggcaaactgaggagaaattggcaggtggagaaagatcagccagaatccaaggaaaaatgctgagcattttccacaaatagttcacacaacggacaatagttgggctactgaaagtttattgagaggggtcttgctccaaagaaaaagttctttcccaaggttatcaaagactcacagcagaccccggcccccaacacaccatctgcagagggcctgttagtcaaaaagaagacaagacagaagcaagggggtgcggggggaggagagcaagaggggaccgagaactcggaaccaagtgatgggcagacactgaatgcctgactccagggttatcgcctcagaaaacaagtccgtttaagcccgtggtaacagtgttagcgctttcactgaacctgcactcaacactggagaacctccctgcattatgaagatgagccgaaaaataacattaattcacaatgtagagtgatgattcagccacagaaaataaaactgatataatccactacaa

SEQ ID NO: 1410 - DNA, 599 bp, Homo sapiens
ccagctcttagtgactctagccctctcccgccctcctctgcaccctgcatgcacttgtgttgctgaatgtggccggagaaaaacacagccatcttgactgttctgtgagacttcatagatttccagggctgtgtggaatcaaaaaatcttcctgcatttccccagccatctggcctccaggatgactatttcacatctcctcaagcctttcacatctcatccccctcacacctgatgattttgcttcctatttcactgggaaaatgaagtagggacggggtttcatcatgttggccaggctggtctcgatcttctgacctcgtgagccgcccacctcggcctcccaaagtgctgggattacaggcatgagccaccgcgcccagccaaagagcctagaaccatgcctggcacacagtgggcatctagaccctttgctgagtggtgaaattgaagtgtgacagggtgcgtggcttccctgctcaggctccctcagttcccaaagctgtgctccttcctggatctcatgtagcacaaggaggcatacgtgggtcgcaccacatggcttctagaggagtatgtgtgaatgtgttcatgttcat

SEQ ID NO: 1411 - DNA, 2129 bp, Homo sapiens
aagtactgcattcaaagaaatacaaacacaaccagaaagtattataagtctatattcagcatttcaaatctgtcctgtctatcaaggaaacaccgaaggaggaggtaaattcttaatgcatagcagacatttaaaaattctctctcaccattgctgcccagtcactaccctgcatgtgaatgccagcttgtctcttgagttgtctctttcctattctcaacttccacccccaaacacatttagagcacaggtcttttctgtcacacttgccagtcttccttgcctgctcttattatgtaaatcaaattcaccactctgtcctgttttgttttcatctctgcttcactcaataccccgactccctcaggaccgtgttgcttctgccctgaatgagttcttttctcccgggctgcagggaccacagaggtcttcttcctattacttcatggactgtatgaattccacccagctggtgacatcatggcaggtggtttggagatgaactggtatcctgccctgtgttaaatgtcctcagactggagctcagaacttttgagtattttcaaaagggtcaccgtgtctccagagaaatgctcccaacagtcctaactgaagtcagcactgaactgggcaaaggactcaagaaaaaaagtttccttcctcctcgatgtgttgctcaaagcactgcgtgagaccacacggagcagtatctaagcattgagcaacactcagaagggcagcaggacaaatgcgtagctgctaatgacccctctcctgccaatgctttcctccctcagccccctctagggtcaccgaacagctgtaaatacaagctgaccaccctcaaggagctgggatggagggaggttttctccagtctccagttctgcctttgcacctctgtggcctctcaaatgctcagccagtattttgagtacacccaacctcacccaggagatatatgtcacccagaaacatgtgctctccagaaagtcttcctgacatcatcggggcagtcctcctccacctcctcctcttcccagcaattcgttctgcaaattaatgccatccaaacaatcctcgagaactatctaggaaaggacgaggaccaaattaccaagcctttggatctaatccatgtggcatcccatctgtgagctccagggagattcaaagttggccagtgctggaggccaatcatatttataccatttccatatggcaccttttgattgagacttggcaagcacatgatcggattggaggaagacagagagcaagacgttggaacaagcagcaggggtggagcctgggacacaaggtcagcacatagcaagcccttgctttggagcagaggtggccggtttccagggcagtgagtatttgaggcagtaattgtgatcttcagcttcactggtgcaagtatcacctgtgagaaagcaggcattgggtgtgattaattagtatgcttctttagcatatggggtgagggagggacaggggctaatttgagcagtcagggacaaggagtcaacatcagtgtggagtgataacgtttgtacaccaagctggtaaatagacatcctagttacatatgattctattggcattgcctacagaggagaaaaaagtgatcaagtggttgtggattttatgtttgcttacctgttttttaaaaaaaaggtgaataaggaactttataaagatgttggattccagcatgttagacattgtagtggattgaattttgatccccaaaaagatatgtcccaagtcttaacctcacagtagctgtcaatgtgagcttatatagagcctttgcaaatgtattaagttaagcatctccagacgagatcatcctggattcagtgtgggctctaaattcaatgactggtggtggtataagagaaaggagagagagacaaacagacccagagacacacagaggggaaggccatcagaagacgaggcagctattggagttacgcagccagagccaagggatgccagaagccaacagaagctggaggagtcaaggaaggattctcccctagaaccctggaagggactgtggccctgctgacgctttctgggctccaaaactgagtgagaataaatttctgttgttt

SEQ ID NO: 1412 - DNA, 651 bp, Homo sapiens
tggtgatggccagggctccatcctaagcccttttcccttgggaacactatggcctcattgctgtaaacaccccattgctctgatggcccacatctctgtctccagccccacctctcctgaaagtccaattctgctacccagaggccttcccaggtagagggctaaaggtccccagggactggagaattcagtgatcagccaggctgcagatcaaggttgaacttggaagaaaaccacacctggttcctggcttggagttggaggctgcgctttccgtgaacttggccgtccgaactccagctctccctggcctcctggttcccaggatccagtctcactccaccccaccctacctcacctcccaccaagctgccctggaaagagtctggcctctgggaccagaaacacgggcctgagtctaggttctgctgcttcctcactgtgggaccaaggccaagaccgtcacttagctgcacctctatttctgcatctgtaaaatggggtcataatcatcgcccacacccccaaactcagcactgctcattcgttcggccagagtggcttgggcatctgctctgtgctgggccctaggccctgcgggatacagggaacagttggacagagcctctgtctatggggtggagagagggg

SEQ ID NO: 1413 - DNA, 206 bp, Homo sapiens
ccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagcc

SEQ ID NO: 1414 - DNA, 1983 bp, Homo sapiens
gtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctctaaagcaaaacttttaaacttttttttttttttttttttttttaggtaccagcatcaagatgatttatggtaataaggtactcagtctttgcttaaaataaattttacgtttatcaaagtaaaatttaccagctttttttcctaaagaggctagtcatatctcatcagtggttacaaagtatccttacaattgaacctacatttgttaatcctgttcagtgtgtatgaaaatcacttggtggccgggcatggtggctcacgcctgtaatcccagcactttgggaggccaaggcgggcagatcacaaggtcaggagttcgagaccagcctggctaatatagtgaaaccccatttctactaaaaatgcaaacattagtcaggcatggtggcaggtgcctgtagtcccagctacttgggaggctgaggcaggagactctcttcaacccgtgaggcagaggttgcagtgagtcgagatcatgtcactgcacttcagcttaagcaacagagcgagactccatctcaaaaaaagaaaagcacgtcactcgatgttctttctttcataagagttgaagaactaggtatatctgcttatattatggcatctatagtagcttagctgctcatatttgggtctctttagaaccagtgtctttcaaagagggttttaactatgctggtgtaaattttaagaatagatacattcaaagaagaattcaacattcatgtgacattcatactttggaactttgggaaagtataggaatgaccatagattggcttagggatagtcaatttacctgtctgtaaatggatccaatttagtattgttcctgtatttttctaagaccaacacttgtgtcattcacagttaaatatatgagttgtggccaggcccggtggctcatgcctgtaatttcagcattttaggaggctgaggtgaacagattgctcaagtccaggagttcaagaccagcctgggcaacatagtgagatgcggtctctacaaaaaatttttaaaagttagccaagcatggtggtgcttgcctgtggtcccagctacttgggaggctgaggtgggaggattgcttgagccatatgctctaatatattttaaaatacatattttaaatatattttgagtggtaaaatgtagcagataatgttacataaaagaagccatggtaatgacatgacattactggttttgagttgtttgtgtagtagttagctattaatactcaggtataatgatttgctatttaaactacacaaatgctcaaagtccagcgataccctgcacccaaattcagtggctagattaccttcttaggaaagcacaacacttcaatggagtgacactggcatgagtccactagagggtgtgtatacatggcctgagttcaaattgttcctgctgtgagtactgcttttcagcttcaagttattcttatcggccacagtactgtttattccacttagtaacagttctgtttacagagcactttaacataaattctgatttttaacatgaaagctgtctgatgttggtatttttattttaatctttagagatcaagaaatttttttagtgacagaatagggactttattgatccttaaatccgcccctcaccacaataaaggaaaaaagcaaaaa

SEQ ID NO: 1415 - DNA, 1088 bp, Homo sapiens
gcggcgtcggggtcccatacctgatgctgttgtcgcccctgctggtaaggcttaattggcccctggtggcaacgccgcgtccggatcttgccgccaccgccccctccgactcctccggctcccgaggccatggcggagcctccgccgcttcccgctccggggcgggtaagggggcgggagaggcagaggcggaggccttagagagcctcccccgccgcccggccccggcccaaaagtccgcccgcgctgtccacacagtgggcacaagcaccccaggaaccgcgaggttgcgagcaggagcggagagagggtgagtgctggcagcggggaagggggtggcggccgcagaggccgaggaggctccggtccggccgcctctgcggacccccgcctctgtgtgtgtcacggtctctatggagatctcccgcagaggacagcacgaacagttccccgcggtgctgaggcctaactcgaccgccgactggtgggagttcttccgtcgccctagccgtagctgccgcagttgaagccgctggcgacgcccgcctacccctcccctgtgcgcacagcgcccgccccgccgccgtcgtcgtcgtcgtccctgcagcctccgccgccgttgcgcctattacccctgctaaggcggctgccgcggtcgcgagccagaatgtcgtcactcatcggcgcccgacgcatttgcatcatcatgctgcgacgagctgataggcaaagaggaagggctggtcgagtccacgctctcggccgcgcggcacgctgggaaacgtagttcaacaacggaacgcggcttctcggaaaggaagagggacggggaaggagatctccggggcgccgcagaggcacaaagccaaggggtacttttgctgttcttggctgtaaattagactttgaaaagacacttaacataaaaacagtaacctcttcccattctccttctccctgtcggttggttaagtaggcaggaagtaagcagacagtaaaatcaaagacaagagctaatgatttaagaaggaggaaaaaaaaatctgtggttgaaaaataaagtccatgatccttagaattagaaaata

SEQ ID NO: 1416 - DNA, 426 bp, Homo sapiens
ctgattttggtagcatcctttggtctcttctagtctgggagtcagagaaagtttgcatcaaaatgtcatcagggattcatttccatcatttcaagcagggtcatcttggaacaggacacaggatagccaaaaacaatccattgatacacttggtgacattaattgagaaaaaaacaatatggtctggccatggaggcatggtatccgtaacatcccccaaaggagctaaagaagaaatccacaatttaccatgagcatttctcgtctgaagattgccaagcgattcctccaggacattcctcaagatcaatttctgttcatccaccttgtcctgggagggacatcaatgggtttccatgtcctttggcttctggttgagttcactcagtggagaaccctggcaagaggcaggaaaaggggaggaag

SEQ ID NO: 1417 - DNA, 1148 bp, Homo sapiens
gcaggagcccgggaggcctttcgcccgaggcgggctgcgggctgctggggtctggtgcggagggccaacttctgggaataacctggctgtgggcttaaaaatcgtagtcattcattatcacgggcttctctctctcgaatacctttaacatttatcgccttgttagtctccacatccacctccgtgaaagagatggagtctcgctatatttcccagtctggcctcaaactcctgatcttaagggatccccagctcaacctctcccagcagctgggactaccgggctgtcaaatttacattaactatgagaattaagcaggaattctcaagggtctctttggaggcttaccaaggacatccagctgcacagtgaaggtggcttctcctgctctattcttggcaacacatgcataagcccctgcatctgaagctctgactacttcaaagatgagtgaatgaagacccttctcagacactatcattttgtgcaaatcatctgattgaactgttcttccatttagataccatgacacatcaggagctggcagtccactcacctagaaagaaaaacacaaggagatggcagaattttaaagtattgcatcactgaaacctatttgtccatatatgaatttaaacagttcccgtatctgagtgggtttgcgattgaaatgcaaagcaagagctcaaaagtatttataattttttaaacaaaacattggaaataagatccttgaaattaacatagtatttttagactgtctcaaaccataactcttttacatgcaacctcagtctctttatgaactcttaatttctatatttagaacattaatttatgttacattggtttccataaggaatatagaagtcattgcttttctggctaaatgtgactgcaaatgaagtcccagaggcacatatatatgaggcttcctgatctaatgcgtaatttttctaaaacagagtgttcttgagctatagtttggcatataaatggcaatttgttaagtgtttttacataaactgttaacagtggaatccaaagctttaacactaacttgagttcataaggaatctggaaaaaaaattttataaggaaaagttctccaaaataaggataataaaaatataacctcttctaaaga

SEQ ID NO: 1418 - DNA, 496 bp, Homo sapiens
gccccagaaatagcatatacattgcgccctaagtccagtctcgcccaggtgtggcaggagcttttacctgctcttcggcagtagccggctgccactcaaccccatgcctgactgagctgtggtagaaggattgaggccagcacagaggaggatcagcaggaaatgtaagggttgtcctcatctaatccgtcagtaccagacagtgaacatctctcccccaggatgctgagggagggtcctggagggaaggatgtggaactacagcctctgctctcaagaagctcagatctgggcagggaacatcacataccagggctgtctgtcgggggggtggagggctgggggagggatagcattaggggaaatacctaatgtaaatgacaagttgatgggtgcagcaaaccaacatggcacatgtatacctatgtaacaaatctgcatgttgtgcacgtgtaccctagaacttaaagtataattaaaaaaaaaaaaagcttca

SEQ ID NO: 1419 - DNA, 859 bp, Homo sapiens
tggcgacccgtgtcatgggagcgggtttctgttacgtgggctttagcgcgagctgggcggtcggcccggtcccaccgaactgcatagggccgtgtagccgggggaagtcagccccctgctctgagaagcagactctgcatctgtaaaaggctaagcgtgcccactggggcctgtggtcaggattggctgcagtgaggtccgcaaagcccctaccgcatcctgcgccttcgttagggtgagcagtcatggggactcgcattgtgccaccacgtagcgggtctcactgggtccgcttgtctgctcgaggagacagccggtgaggacgggagctggcctgctttgcccaggctgtaacctcagcctccgcccatacccacaatcatcttcaatccagagggttttccttgttccaggaaacgtctcacctccatgtgcagatttaatttttacagaaactgaaatttccctcatttattatctagatgagcccctaaaatctattcaataaggtttgatctttgatggaacagaccagagttgtataatgtgacagtggccccaaggaacagtttgtaggaggagattgttgtcttctctgaaaaaaacttcccagaagacattgatggttcccttaggtgccctgcagtgggtccacttccaacaggctgaagcctggatttggtgggtgagggtcctaccttttcctagataccattcagcatcactgaagccagtaaactcacctcctgaggaaccgttaccatctgtactatttacacccatggcatgagtctgctgctcaagacctttgatgagaatcttgaaaaggaaaccatgaattgctggagaaaatatcttt

SEQ ID NO: 1420 - DNA, 641 bp, Homo sapiens
atccataatggattcctgggacattttcagatctccttccagcttcctcttcgccctttccaagtccgcccgcagtttcttctcctgctctaaggaaccctcaagctgagaagacacacagagacaagggcttgctctgttgcccaagctaaagtgcagtggtgtgagtgtagcccactgcatcctcacactcctgtgctcaagtgatcctcccacctcagcctcccaagtagctggaactacaagatggagtctcgctgcgatgcccaggctggagtgcaatggtgcaatcttggctcactgcaaccttcgtttcccaggtttaagcaattctcctgcctcagcctcccaagtatctgggactacaggcgagcgtcaccatgcctggctaatttttgtatttttagtagagatgtttagtagagagtttcaccatattggccaggctggtcttgaactcctgacctcaagggatccgcccaccttggcctctcaaagtgctgggattacaggcgtgagccaccgtgcctggcaatgtttgtagtttctttcatgaatttacctccttttattctttaatccctgcttatctctaaagagtaagtaactgaaagtaataaaacggaattttctcaacaata

SEQ ID NO: 1421 - DNA, 3539 bp, Homo sapiens
aaatgttaaggaggcttatttaaatattcagggcttcaactaaagatctaaccactaagatcaaaagagttatttaaataaaagttgttgagacattttttcatctgtattaataatgtggcttttgaagttacccggtaataatgtgtccataatgcccacacctaatttttaatttccattttggctttaggtgtggctttattttaatagctgccaaaaagttggcaattgtttttacgtttagaacttcacagtttgcttttctgtaggtttaggtagcattggggatattcgtctaataaaaacttttaaaatttctgttctgaccctgaggcacttaaaaaaaactcttatgggccaaattttaaaagtagagtgtctctactactgcataaagaatttctataaaagatgaaacatggagctgattgaaagaatagacggcgcaatggtagaggacacatagttaccactgtcactggtaatctacagcttgatgcgaagtcattccgccttgtttgttgaaatgttaatcatttcattaagaaaggttaagtaattaactgatatttcattagggaatcaatgacagacctttttttagtgatgtatggtagatattttctaatagaaagtttgccccatttaattatttggaaagaagctagttgattgagccttgggaaggaggggtggggcatcttcagataacatctatgtccataagcaactttaaataattttggagaaaatggtctattagaatagaaaatcgttcagtccccagttttcttttatgggctccatcaggcatgttgttgcagacctgctgttgttttgcatgccttctctgggtttaagaagggttcagctgcttaaatgtgttcatcttattttctaaataatggcttttgttgcagtgtgatgcatgttgacagtaaacgcgcagccgtaactttggcacaaaaaaggaacaaagagtaaatcagtgagcacccatgtacctgtagcccggcttaagagagaagacgctgctggttcaggtaggagaggctcctggaatatcccatcctcatcttacctctgtccttctttcctagaggttactttaccactgttcgcagctgggtggttttcatcttgtgtagttcttcatatttttaatatgtatgcatgtacaggattcctcaaaatacaggattttgttttgcacgttcaaggtttgttctgatagcatcctactatatatgttttttagtaacttgcttttttaaaaaataaacaacagtaaaattcatccatgtggatacatgtagctatagcttattgatttttccatgtgaaccttttgaaatactggatattaattcaagacaagttctttaaatttgagcctaaaacccagtagcactctgtacattgaaaatttcagattcataagaaaccatcagtcctgactggaacttcataatttgttcatttgtctgtgttttgggggaaaaaactttaaaacctcaaccatttatcagggaatttgattaaaaaaaataatctatcaagtggctgatctcttacattaagggaaaaaacaggcaaagcattcatttgaaggagcctagccattttctctttcttatttaaagacttggcttggaacttagcagttacatatgcagggtagcgagttaaaaagccatgtttaattaacaggcgctttatacttctgtatccttgttatgatatagcaccttgttcttcagtgtagaaagtgatttctgcatattttaaaggactggcatctttatggtaagaaagccatataaataaagatatacttagatgaaaatcggaacatgtttttaaaatagtgtgtgtctactttcatctctgttatcaaacttgctgcataagccagagttgatgctctgtgattatgctaatgaccaaaagaatcgatgatgcgagactagatgaaatcagtggtataatcggggaaagttatcagtttttttgtcattaagtattagtgataaataatacactgttcatttcgagtggatagaacatatttaattctgatgtacagagtttcattttagtcaggctcattgctgagtaaaatgatcatcttttgtaatttaagaggaaagagaaaaggcatttttgtcagcctggctaactgacttgggccatctagaaatgtttaccttgaccagccagggaagattggaaaaacttaattttttttcctcctagacaacttgcttatttgtactgacattttattaagaatatcagatactcagtaaatagcataaatgactagagatgttaaacaaaatgagtataaaggtagatagtgtttccctgaagaatggggaaaatgataacaaaggggcaatgtttggataatgctctttttaaatgactagtctgcattaaccaggggctattaaagtcggtatcacccattagacagcagttttaattttttttaattgagtttttcatatcaaataagatcatacttagtaatggtttacttaaagagaagtaatacttgtaacttagaatcttttcctgggttactaaaaccttaagggaaaacactgattctaccttccttgtcaacaaagcgtttctaacacaattctctgtaacagacatttctctgtggatagagtttagcacttgttttactactgtatgacagtacctggtgacaagagagaaaataaaagaataattagcaatgttctgtaggacatgaaaagtgattgaagtctacgagagaaggaaatcagatcgatgttattttaaaaaaatgcatcacaaaaatgattctcttcaaagcaaagcctcctacccaggctggggccagctgtgctctgccatttccctgccacagccctgtccgtccacgttggctcttaccagcagtaccatctgctgctccagcagtggccttctctatggtaaggcaggccaattgggtcaaatcttgtgatatggcagatgtccactgagagctaagattgggccaggctcatttttatgtgtgtccaaagccaagatttcaacttggtgaaaggctgtggaatttatttccccaagtgttgcccaaactctgttcttttcttcaactgcctccttgggctgagatgattgcttaatgctcttaattatgctggatccctctgtattttcgaacacctgtgggtaattcagatcatgagtggtcacagaggctggctcgacaaacggcttccctttccgaatgggaaaatcccagggagctggaccatgcaccgtgtgtcagggagctgagtggaggctgaaagaggatggaacacttcccttgaacttgaactggcattgtgttgtgtccaagtatccttcacccttggattggggagagtcttacaatgaataactcagaaaaaagttttcaaaataatcctagattgtaagatatctacgaccattatccatagccatatctttaaaaaaaaaaaaagaaaagtagaaaacaagaa

SEQ ID NO: 1422 - DNA, 7070 bp, Homo sapiens
agaggagtgtgcggaaagatggagttgagacagaaacttgttagcataacaccgaaggagttttgctgtgagtagcatcagcatagcaggagaacatccctagctctcctgccgctgctctgccacaaggagagaaagggaaaagcaaattcagcaggacctctaggactttgctgtagatctccaggtggagccaggaccctccaggagaactgatggctagaaaagactgcaagtaatgtggaggaaggaagaagagagagagcagagagagatgattcttgcaaacattgatctgtgtagagcggatgtcaacttgatgggataagacctgggttgacttggtatctgggttcaggtcagcaaactctaacggcatttccttctactagcagacagatctgctcatcctgcgacattgtggacagtgctgaatggcttccagaacattcctcttatgtctactggttaaactttgaagcatctgaaccatttgggagagcagggacccccatgaacaggagatactggaggtgtctgaggccacttcatgccctttctcaagagtggcctgcaggtctttcagccactggccactgaagtccagctcctgccagccatggatttgggcactgggctccagtgttgagaaagttcttgacttccagcgcttgttttcctagtggacaataggagtcagagacagagagggagagtgaagatgcagaagacatatcctttccattgtgacccagataagaatgtagccggtgagcttgcttcctgtcactcatttcccagctatttgttgtagtccaagttgtgcatattctttctgttaggttcttatgtttgtcttaagctcacccatcttttcttcttccctcattttttctttataaatcaagaaaaattctgccactttctttccctggctcactgcacagccaatcaataattttgaatcctttgtgtatcaatttctactggctattcattatttgtggaaaccatattaacgggtccataaaaatcacagcaatccatttgttaaattcatcataagaacagattacatctttctggccaagtttcatggtttggtaatatcatattttggttttagaatttataaggtgcattctcccatacttttcaagtatattttttattcattgccctctctgaattaggcatttttggggatgcacgttttacagatatggagacaatggttcagagaaatcagcttgttcacagtggggccagagctgggacctagggcttctgactctatgtctcaggtcattcctatcacacacacactgaaggagaaaagagttcccttgtctggagaagacatatcaaattcatgcgggttaaacacagaaattccaaatagctgtagtttttgtaaaaatggttgagctatggacttttaaagtagttggccacctgtggtggtgggtggaagggagttagggcaggattgttgtgcttcagggaggattcagtgtctgcacgaccacggaggggggtgcagggcaccaggtatccaggactgttgtcaagagttatgctttgaatttcccagagaagacacactgctgcgaaaggaagaaatcgttggtttttctccaactgcttagctgttaagaagcaagaagcctatctccaaggcagcagcaggcctcagagaaaacagtaggacccttccttcaaacaaaggagaaaactcccacaactcaaagcaagtgccccctggtcattctctcaaaaagctacaggctccaaaaaaagacagacttcacaggctagagacgggctctgcactcagggttggtggtcgggggcacagagctggctgggcagggccagaggggaccacattctgccacatgcagagcaaagcagtatctttctattactggtcaatgtaatatgagctgggaatgagcaatttcatacctttttctgagatattaaaaagaaatacgctgatgtggctggaggtaatttcccaaagcctgtggatggagttgatgtcagtaactggctatgaggttgttatttacaggactgtttgatcccactgaagtagtggtgcttaatatgtagctcaatgtggctcaggagcgaggcccaatactgcatataaaccaccatcctgcaatttatccagagagcatgtgggaggtgaaccttgaatcatttgcttgatggatttttttctttccttggaaacagaaaaacgaatctcagttttctccctaagccttaggcaacagggctccttgcaagtcaccttcccttccttgtccccaaaacaaagatgcatacatgttccccgagcactgcaaacacagcctttctttcaggggcagctgggtccctggatccgctttccctcccctgggctggtcccagtgtaaatcatcagatctccaggtccactcgtctgcacacaggctgctttgtaagtgggagaaagaatccacagaactttacactaaatccccatgggaaccaggtgaataggtgtgtgtgtttgcacacaagcccgtatacatggcaaaccaatccaagagatggtgaccgatgggtccataaagactctggctggcaatgctgtcagcttccttcagctgagcgtcagttagttaccctggtagtctcaaatgtctccttgtgtctggagacaacatagggcctggccctgaggactgccaggctgggtcgcccggcagctgcacctgttgtaggctgggtaggccccctaaaatgctttgggcagcccaagagtgtcttcctgagtcatgtggagctgcctcaccagcagcccagtgagagattcacagccctagtggagagtggaagccctgggctatcccaagcaatccttgcgtctgtggggctggtgccgcccctttgcgtctcttcttgcagctaagcagagctcagaggccaggaaaaaagccactgggtgtctttggaaacagctgacctgattttcaacattccctttgagcatttgctaaaggggcaccacagaagggcattaaggatgccaccgtggaaggaagctgcagatgacagaagcgtgagcactgctggaaaatgagaaagctgagttgggactgcgtgccatggagaacctgtactgtcaccctccccagccatctgactaccagcagcttcagcagcatcatcatttgcattcattcatctcttttcctcactccctccctcgatgaatctctttgggaatgatcttcaaaaactttgcttaggtttcaaggtgcttttgattcactgtatttttctttaaataagccttttaattgagcacaacgttcatagagagaagcgcacacatcctgaggggtcagcccaaagaattttcagaaagtgaacacgtgagggtggcaagcacctggactaggaaccagaacaccgccagcgccccagatgtgcccttttagtccacttctagtcactgtgctcccatgagggtgctcaccctaccctctagtactgacattgatgttgcttatttgtgaacttcacttgaatgaactcatgcaacagcgtgtctgtgaggttcatgcacgtttctgaacgtgggatcgctgaagtgtggggttgtattcgaaactgtagtttgcactcaaagaacagcaagtggaagaaaattactttggaaaggaattttcaaatcgagtgtgaatgagagggtctttgggactttggcctttggagttgagctgacctaaaggtagaaggtgaactaggatcctcttagctccccactccactctgaactgtgctcccagggcaatccagcttctgctctcttttactactacttcatgtaatgataaaaattatgtcaggttaaatatcagtaattgcttaagtgagtttgtatatcaagctgtgtagtaacgcctcactgaaacactgctcagctgagactgagattcagtgtgttgacgaaaagagttaaactctaacatatttgaagagatttattctgagccaaatatgagagaccatggcctgtgacacagccctcaggagtcctgaggacatgtgcccaaggtggttgaggtacagcttggttttatgtattttaggaagggatgagacatcaatcaaatacatttaagaaacacattggtttggttcagaaaaggcggaacaactcaaagtggggaggcttccaggctataggtaaatttaaacattttctggttgataattggtagagtttatttgaaggtctggaattaatggaaaggaatgttcaggttaagataaaggactgtggagaccaagttttattgttcagaggaatctctcagatagcagacttcagagagagagcaggttgtaaaatgtttcttataagacctaaaagggtgcctggctcttagttggttatctcctgggtctggaaagaaaggaaggaaaacaaacggggaaggagattctctgtagattgtggatttttcccacagagactttgcaggacaatttcaaggcatggcaaggaaatgtattttggggtaaaacatttcgattttcttccttgttatgccagagtcagattggaaagtaagtcactatatacagggtcaaataaaacccatctgatgagaatttatggtttgtagggtatgactccctagaccccttagataggaatttgggcaagataaaaaaaatcagatcttagtcctcaagtgtaaagcagatcaattgagaatccaaatctgcagggtataaggtcagacgcagtcaaccgatgcatgaaccaagaagcatttatagaagcctctggcgcttttcctttgctcacctctgtccacaggctctgaactaattccttcatttttttttaaatttgcaaataagattactgtattatagatttgaagatgcacccaattattttataagcttttttttatgtaacactaagaaattaaaaaaatgctgaaggtgcagtctagtaggagaccctgcagctgaaatgctgaagtcattctttgtgtgcaggaaacaagaaaaaagcctgccatgcagaaagtcactgagaaacctgctggcctccatggtggcacgtgggggagggaggagaagaaaactcctgaaagaatgtggaccacacagcatgctctggtgggtatgtgggctgacaaagaacagggagcgctaacagtgaaaatgaagagcctgccccgcctcccagcgtggaccttgacctggggccagaccaaggccactttatagaaacgtccctggagcgtgtctcaggtggccctgcctgcatcctggcctacctctggggcccttcttacccacagtcctactttccacccaccttgaccccaagaggtgttcatttataacgcccctgcatcttctcaacttcaaagtcagctcggacctcgttcacccagacaagaccttggctgagtcttgacaaactggcacagggtcccccgacagaagacagctttcctttctctttgctttcctttatcttagccgagtccggcctccccagcactcttttccatctggggacagttcgtgctggtgggaattggcaggggcacacggtccagacagagacaactgaaacacaggtgtcccgctggtgtgccagcagggcggccgtcctaccaggagcaggacactttgttggccactgcccatgcaataatcagcgtgggacaaacagtcccatggggagtgaggtgatgtgaagaaaaggaagccgaagaagagaagaagctgaagggccagtaaacacacacatagacgctcaccctccccttcgttggaaaaatgaacggctgctgttgccgagggctggtgaggatgaggccccaggcctgcaggagggcacatccggttggccgcctcgacggggccatctgggtagctgctgccctttgcatgtaaataaagctcctcaaagccccatttcacaactgctgggagaaacagcatccttccctccttccctatatttccagggaggaggtggctggttttttttgttgttgtgttttttttgtttgtttgttttgttttgttttgttttttccagatttctcccagccacatccagcttcttgttctgtaatttttttttccaaattactgactgccttctttcaaggggaaatggaactcagaaagatgggaagatacatgataagagcacttaagagagaagcctgtccatttccactaaggttgaagtgtgcatactccaggatccagtccttcatgtctacacaaggagtcccaggaaaaggtctgtgcaaaacgtttgtaattgcaacggagcagccacgacctagccctccttcagcagaggaatgaataaactggtttattcagtcaacgcagcagttaaaatgagagaattagtgatgttgaaaggaaaaatgaagagcaaacagatacagtaggaagttatcacgtacatttcaaaaacattcaaaacaaccgtacatatttatggattcatgtaataatgcagtaaaaatacaaaatcagagccaggactgtggcacactgaattcagcacaatggtcgtctctaaatgtgggttcatgtgggaggaggtgaccccggggtgggggcttctgctgtatttgtcatgtttgggttatttgaaagggagagagagcactgtagttatacagtaaaatgcaaacatattttttattttagtggtgagtatacaggtgtctgttgtgctgttttctgtgtgtttgaatggtttcataatttttagaaaattaaaccatgaggtcggatatggtggctcacccctgtaattccagcactttggggggtcagagcagaaggattgcttgaagaccagcctgggcaacatagcaagattctatctttacaatttctaaaacatttttcaatttaaaaatgataaacaatgaaaaactgcaaagaaatagattgaaaagttcacagttgcttttgccacattttgtgaatatgttatttttataatgaaaaattacagataa

SEQ ID NO: 1423 - DNA, 674 bp, Homo sapiens
cctcgtctctactaaaaacacaaaattatccgggcatggtggcacatgcttgtaatcccagctactcagaaaggctgaggcaggagaatcacttgaacccaggaggcagaggttgtggtgagccgagatggagccattgcattccagcctgagcaacaagagtgaaaaaaaaaagaaaaaagctcaattatgtgtctcaaaaaaaaaaaaaaagaaagaaaagagctaaattatgtggtgctttggaagctgggaccacatggactcttaagagggatggcaccttctaagaggttccaagggcggaaacaaggggcagttccactgggtttcagacacagagatcccagcctggattgtcgtggaggatgaagctgctccatcttggatgctgatccgccatgttgtcctctggttaacccctgttctggaatgcctcctctaagattgccactttatctactgtgaccttaaatcctgctcttaggtagattcacatagcattctgcgcctttccctgaggggttgacttcagtggtgccacacatttctactgaggcatgtgtaccttttgcatcaggtatatcagccctgggactcggggataactgactgacggctgcctggcttctgtttctaagttgctattaaatgtttctttctgagaaactgga

SEQ ID NO: 1424 - DNA, 3444 bp, Homo sapiens
gaggggtgctgggggcttgatgccaccaaggaccccagaccaagtcatcttttttttctcgctcagctttgaagggaagttaaagacaaagaggaagaggctgtatttcattctcccagatggctcctgccagcctccagagaaaaggcagctttcttctttagaaaattggcaggacaaaagaaggaagtcgacttggaaagtccagcgacagacctcgtgcccctgctctgggaggccgcaggtcaatggctccccctggcttcaggggacacagctcaagcctggaaggagcccatggccagcctgaaagccttgctcacacccagcatccgcagctggggcaagagcggctactcccaagacaggaaaagacacacagcctaactttgccactgtgaagggagacttctctctaatgcctaactagacacttatcttccaacctcctcaaaatgccttcaatagaagtcccaggaagacacggagccccagccgcccactgactcctacaggatgcagctgcgccaggcagcccatcccagggggcccaggccaaagaggggccagggtgcttcccctgagaatgaaaagggatgtcgggtagagggggagggtgatgtgggactcgctggtggctgttaaaggagctcgcgtctcggttcctgcaggaaaagtgctttgagcactcgcctggcctggtgaagaaggaaggcagttggcgggcatttttggaagctctcaccccccatgctggtcctggtaccccttctccagggatgcggggcccacattcatcacagtggggttccatagatgatggtcctgtcatatcagggttcccattgaagggggccctttttggcactttcttttattccattagtctgtttgcctggtcacacattttattgctttttcccgcaaaagaatcaatgtgggaatttatttatttatttattgagacggagtctcactctgtcacccaggctggagtgcagtggtgcaatctcagctcactgcaacctccgcctccctggttcaagcaattctcctgcctcagcttcccaagtagctggaattacaggcatctgccaccatgcccggctaattttttgtattttttgtatttttttttttttctgagatggagtctctctgtgttgcctaagctggagtacagtggcgtgatctcagctcattgcaacttctgcctcccaggttcaagcaattcttcctgcctcagcctcccaagtaggtggaattacaggtgcccactaccatgcctggctaatttttgtattttttagtagagacgggatttcaccacattggccagattggtcttgaactcctgacctcatgatccacctaccttggcctcccaaagtgctgggattacaggtgtgagccactgcacctggctgattttttatatttttagtagagacgggtttcaccatgttagccaggatggtcgcaatctcctgacctcgtgatccacccaccttggcctcccaaagtgctgggattacaggtgtgagccactgcgcccagccaggaatttatttttaaattaaatttgatttatttagtttcctaacccttttattgtttttaggcaattttttgaagtataatatgaataagaaaattatggtgaattgttacagcatcgagacctccaagaccaggacatagaacaatcccagcccccagaaacctccaccccataaggctccacaacccctcttctaacacacagattaccttcagctcttcttgaacttcatataagtgtgaaactcacccatgctgttgaacacagcactgtttcattcatgtaagcggccttatagtattccattatgtgaacgcagtttattatccgttctgttaatcacagtagtttttacctgttgtgagtaagggtgtcacaaacagcctcatgtgtactttgtggcagatggaattcttgtacagatgtggaacatacactggatttgaagtgctgggttatagagtatgcacatgctcagctttatcaaacagggcttaacagcttttcagagtggctgtgccaactcacactctccaacagtctatgggagttccagttgccccacacccttgccaccacttgcaattgtcagctgtaaattttagccattttgtcgggtgtatattggtattttattgtgtttttgatactcgttgctcccgcaatcgttgaagttgagcacggttgtatatgcttattggcaatttggatactgtctttgcgttttcaaaaattgggtttttgtcttttattgatttgtagaatttctttattctgaatttgagttcttagttgtgcttgtgtgtgtgcacatagtaaacacacacacaggttaaaataattgggagatcattagaatgagatgaccccagcgccttgggtttcaactcaagcaaaccaaagtccatctcagtgtacatggttatagttcaggtaagcagaaaccaccggctgatctctaacacggggcttttgactggaatgatttctttccctttctttctctttctttctttctctctttctctctttctttctctctttctctcttcctttctttttttctttcctatctttctgcctttctttccttccttccttccatccttccatctctttctttttcttttctctttcttttctttctctccctctctctttctttcctccctccctttcttccttccttccttctttccttccttcccttcctccttccctccttcccctccctccctaaaattcatagaataaaaaaatgcctgaatagccaaagtaatcctaagcaaaaagaacaaagctggaggaatcacattacctgacttcaaattatcttacaaggctatggtaaccaaaacagcatggtatttaggattgttttcccaattctttgaaaagcgatgttggtatcttcataggaattgcattgaatctgtagattgctttgggtagtgtggtcactttcacaatattgattcttccaatccatgatcatgggatgtatttccgttggtttgtgtcatatacaatttctttcagcagtgtttgctaggtctccttgtagagatatttcacctcttggtcaagttatttctagttattttattttactttttgcagctattgtaaaagagctcgggttcttgatttgattctcagcttggtcattgttggtgtatagcggtgctactgatttgtgtacattgattttgtaacctgagacttcactgaattcatttatcagcaattcattcatttttagaggatacttggtccatgcacatgtcagagattgttgtaatgtttctttcttgcaatgatctcatcacattttaatcacaaagtcaggctagtcttttaaataaagttgcaaagcattaatc

SEQ ID NO: 1425 - DNA, 655 bp, Homo sapiens
tgggcaagttagttgctccaaaaacaagataaaatgattgagttcttttctcaagcgggagtcggagtttatctgctctgagggtcatccaactaaaaaatatatatatcttgaggatttgcattgatattcaatatcgacatatccaaggcctccctccagaccactagattctagtaatttgaaccggcttctcctctccctcaaagcagctctgcttagtacagtgcttggcacaaagcaaatattcaataaatgttagccaacgttagctgctcatctgctttccttaaaagccaagtcatttcaacaaaccacccctgaggccccaagacacagaagaacagcatccagtccaagccttctggtgcagagccccagcagctactattaatgagtgtctggaatatgttcctggcatttcacctaccctctctccaatccttccaagaaactcacaaagcagggctttttcttgaacttctcttcctcacaacagttaaatcatccatttaaagatgtcaaacaacctccgtgttctaagaactatttactgagctctacggagacacagctacaagcaccacatgctggacccctgaatatggagggccaactacactagaaacacacacgctagctgagaaagatggtg

SEQ ID NO: 1426 - DNA, 557 bp, Homo sapiens
gtgcgaccggctgagctctggggccacggtggggtgtgtccagccctggggtccccacccccttgaggttatgagcgcccatagggaagatgttgccactgtacgcagttgggagaagaaggacctggcacatgaggaagccaagtagttggatcagccctgtaagctcctggcactgactgccctgcaggggcgacaaccccgtgcacccacactggggccctcacgaggctccaagaaaatggctcaagggagcagacagggtggtttgaccccagagttaagaacacaggttcagccaatttacttgaccctgagctggtgtgacccacttcttagggcctcagatcctcagttgtaaaatgggcataccgctggccctggccctcactggggtggcagggggcatccggtgattcactccatgacaagagccttgctcataaacagaggctattagagagccacagacaccctgacccccagaggcccagaaaggctggattcacactcagaagtgaggccttccctgggtgacccacacacagcagggtctg

SEQ ID NO: 1427 - DNA, 712 bp, Homo sapiens
cacccagaactggccgctcagttttcaggttttaaactgccgttgacttgaaggttgagtttcactggggacctacctctatctgcctagtaatctgtgtctcctgtagctatcatcatcactgattttctacgtacagatttcaattccaaacaaaaatatatgagaacgttcatttctccatacaactgcatcatggatggagatggagcccattatttgaagcaaactaacacaggaacagcaaagcaaataccatatattctcacttataaatggcagctgaacaacgaggacacatggacacaaacagcagaacaacagacaccaggagctacttgaagggaccggcgtgagagtatggaggctgaagccatagaaaggagaaattattccagctgaggccaaaacatgaaccaaggctgggtcattggccttatcccgcaccgaagttgaaacttacaccatctgttcacatcatcagttcttctggttctcatgcttttgaacttcaactggcacaattccactggctctccttagtctccaggttgcagatggcagattataaatctccttagcctccacctttataatcctaactattactgacacctctttgaggacaaaggaagtagctttctgcaagccaaaaagacctcagaaaaacaacaaatcttccaaactcttgattttgactttttgcctccag

SEQ ID NO: 1428 - DNA, 762 bp, Homo sapiens
gaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtttgcatccaagagaggggaggacaggggcaaaaggatgcagggaggctgctgatttccactgaagagctaatttcctgtgagacattaacagtgatttaagaaaaagattcctgtaactgtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgtggtttccagcattcctcacccagtccagggacactgtgggtgtgcccagcttaagtccagtaactggaaatacaagcccaagttctggagagtttgagctgcagagatatatatgggaacactttgaatcttgactcattggccataaccagcagagtggaaaatacaagaagagaaaaaaacattgaactgcgattttataacatcctttactaggcagagagaagaggaaa

SEQ ID NO: 1429 - DNA, 522 bp, Homo sapiens
tcttaaggctctaatatcttgtcttctggctatgagaacagagcatatggtttgcttgaagattcttgttcaacacttatccattaatctgacagcaggaagtgctaaagagcagaaacaggagtcggtcagactctcacctcaagtccaaggcaaatatgcttgcccctaaaagacatacttgatcttcaagttcaggaaaaccagatacaaagtctcactctgttgcccaggatggagtgcagtggtgcgatctcagctcactacaacctctgcctcccagggtcaagcgattctcctgcttcagcctccccagtagctgggactacaggtagcctcagcttgcacctgcatcagtcagtatttaccagccattctagacccttttaggatcctcaaacacacctcacaggactcaaaaggaagcgaactttcaccagttcgccaactgtcgtcaccaatctcatcactcaagagaaactcattcagcttttgaacactgcaaaaaacaataaacacaga

SEQ ID NO: 1430 - DNA, 1380 bp, Homo sapiens
acctgacgctctgctttcccctgacctccactgacatctacgacccgccctggaggcacggaaggctgtggggttccagccccccaaactgtgcagctgaggaaaatgagccgtgaatgggggcagagccagatcctgggcgggaccctgcgcaggatgaactcaggcagccagagggaccccgggaagatgggagtgagagctgccttcgtctgcaaaagtctccagacaccacctcactggtgaaggccagagaccctaaactgtcccaagaccacctgactgggctgcctccctgccacctggctgccagcctctctcagagcgcctgcaagctattcctccaacccagagtttccttcccagctaaaggcctttgcacctgctgttccttctgcctggaagttcaccgcagactatcccagggcctccatccttcccattgcatggtccccatcagctgccgccgcctctgagagctcagtctccactggccatcctgtctctcagcccactgcactctccactctgccagaaagtcccccaatcagtgacaacacaggtcacggtccacacctcacctggtttgtccccagtgcccagcatctggcaccgagcaggtgcgtgcaaatcctggacaggtgggcaagctgatggtgtccagaggcccctggtccttaagggcaggggtggggatggctcagaggacataaccttgcagacccgggttcaaatctgggctcctcagctcatttggtcctcacacagcccatgttgggagagctagtgttctccctgttttgctgatgagacacagagaaggtcagcaactcccgaagattgcccagcaagttgggagtaaagctggtgcaattcccacgtttagctgctaaacagggtgtcctgtacttggtgtgttcaagcagaaatccacacatgggaaggtcaaggcaacatccctggtactccagctttgaggtcctaggaaaaagggaacctcccattaaatgcttctattgccgggaagttcagcacctgtaaaagcagccccttcccgtttcactgtggctgcattttaattcttattttttaaatgtttagcttaaggccgggcacagtgactcacactataatcccagcaatttgggaggctgaggcgggaggatcacttgagcctaggaattcaagaccagcctaggtaacatagtgggaccctatctctacaaaaaataaaaaattagccagtcatggtggcatgctcctatagtcccagcttggagattgaggtgggaggatcacctgagcctaagaggacaaggctagagtaagccctgatcccgccagcaccccagcctaagtgaaagagcgagagcctgtctc

SEQ ID NO: 1431 - DNA, 6113 bp, Homo sapiens
aatcagaatctcccggcagttggttcccggaggcagaatctgttaaactgacaaagcccacgtctccgggtccctgtctcggggagtcgggactattgggtcaccccgggtagtcgagactctagactgagctgtctcggtcactcaggaggcagttggcagagtattcgtggtcagggaggtgacccgtggtcagcagggtcaggccacccagggacaaagggtgctcctgcaccgggccttggagaaggacagagcggtggggacttggggtcagcgggggagcctccgcggatggggagtcaccacctgccggcaatcagccatgactgcctttgcactgtccatgctctcagcccaccacctcctccccctgccattgcagtggctaacactggagacgaagaccaagacaccacagcctttctccagtacctctcaaatcagcacagacaaggacaaaggcctcaatccacaactgctgaagatggaccctggccacatgggatggtcagacacgcctgcccagctatctgcaggcgaagaggctcagaagaggtttaggggcctgaaggacatcttgcttccatgtccatatgagcaggctatttctgctccatgagtcaattttgccatataaaatacttaatttcagccattccagggtgctataggatgcacagcttcccatcagcccacctgaactccagccatgccattttaataccaggaataaggtcacctgctttcctgccccttaggaggccggagccgtggaagcaaaatggcacttctgtttacctgttatattatttttttgtcatccttatatgtttgaaaaatgcaattatatgaaaaaagtttagtaattacagacataacagcagaaagtcctcggaaccaagcttattctcatggccgattctgctccacctgggactctgctgtgctgcgggcatcctgtggtcagaatcgcagaggggccatcagggaggaccttcccagaggatggacctcacgtgactgctgcgtgggcaagtggcactggccactctgcctggagagaggagtaaatgcagggctggccaggcgacctgcacactctgctaccggccttgtccatctttagcctctaatttgaaaatgaggatcacacagaccaagagtatctttgagggttagtacagaccacagaaatgccctgggcctttcactctctccttttgcaaattcccatgtgtggaaatgccgtttggataatgagggagcctgaaggaggtggacacatgagcagccccgacaggcctggctccatcctctgaaaatggggccccgtgcccggcgtgtggccttactggttcagtcttctttacagtggtaggttttgagtgcccagatgcccagtgcctcctacccggaacaggacaggaccaggctgtcccctggaagaatcccatgcacacttggctattcagggagtttccacccagccgagctcgcctctgtggctaccctggtcttgctgctcatatctgccaggaaaggcctggacttggagagaaacctgggatttggattcagtccttgccagcctggctggttcatatccttacctctgtctgtggaagcctatgttcctgagcagcgagtcagagggggcatctgaacgcagagcagggagcttcagatgggaagaagtcagaggaaccagaatgtatcagacgatgtggagttgggtgcctgagctcaaagcaagctgggccttgggctggctgtgtgatcttgggcaagttcgaccagcttctttgtgcctcttttctctccttaataagataaatgtcttcactagtacactgagggctgccattaagttctatgtgcagggatccaaggcaggccctaggtctcttggtgagtgctactcctccttacaatttgctgcccggagcaacattgggtgacagaacttcttagcaccttggcagtccttgtcctcctggaccctctgttttgagggtggaatgaggtgaagggcaagtgctttcccagctggtcaggtgctctaccaactgggcatattctaatccccccagagtatacagatcagagtttgatgtggccaatgggtccaatgcccaagtgagaatctcttgatgaagttattggtgtggggttttgctttggtttttaattatagagagcaaaagtattgaaagtattacatttaccctaaaggtgtaagcaagttatggtcaagtgaagatgaagtaccatcctcaaacacgggttccattcttagctcatctcatttaaaggagagaaaagccttgcaggtgaaacatggtgggggtagacaggggttcagccaatttcagtgtttggccccaagaagtgaatttgggtttgaggacctctctctggaaggattttatgaccagatcttcctggagatgatattagaagcttttctcaccaaatatttatttgcctggggtgcaacttctgcttcattctctctttgactccagctgtctttttggactgaagtgcaggttgctcacagcatcctacaaagtaactgtcttcccaaatctcacttacctctgagtttctgctgtattcctgtctttctctctctctttttgaactggaatctattactttggatgatgcatgctggcgttttctaaagttttctgattgattgtgtctttaaaaaataatctgatagtattttagcttcttgaattttgtggcatatttttaggcctctcctaaacccatttttgagtgctatgacattgttcatgtatgaagttatgccagtagaaacaaaatgctgtcatataggctcccctaaaacttcaaatctggtccagatcttagactggcagcttctgctgtcattggatctcagtgagacctttgcacccatttcctccctttgtgattcatccacggacatccccatctccttgagaacaatctcaggaatattccttgccttctttcggctctcactccatctcattttctgctgttcactcgggaataaagagatgtcccacactttaaagagtaaaaacaaaaattggagctcagagagggtgaacttgtcaatatcacacagagctgggagtgtggtaagcccttgaaatggggctcaatgacaccgctacctcccagggattcctaatgtctgagggttccagtgagctgagatgaacccagggcctaagaagaactctctgacctcctcacctccaaagccccacccagtgcacatggcctgaggcgtccatggtgatggtaaagaaacctcacctgccatctctcccattactgccatgtcccctctcatcctattctgtgccaaatgtccagatgtgatcaatagaatcaggagaaaattgaggcctgaggggagggggccagactctgggagtggagagtggattgaagtcagactagggctgttcagcaaggagttcagggccttcaagtgttgggagcttggcagcaatgccaaggggaatgggggtggatttgggtccaagtttatgttcgaagaatataagcatgatttggagactcctgatgttcatatgcccccatcaagcagagctaggggtcgccagaggagagaatggtgctagaagttcaggtgagaacagggcagacccctgcataaatgtgggatctctctgtttgaatcacggcccaaacaccgtggcagggacactcccaaggaactcaaacatgtattttatcagggctttaacataaggaatattgattcttaagaaaattggaaacatatgagaatctaatttactctgttatgagatgccatacacctggaagaacaggttaactgtcaaattactaccaaattgttgcaaaaaattgccaatgaagcaatcatacaaagctcaggtaacagagtgggtggccatcactctgggagagggagatagcactggagaaggtccttgtgactcagatcaaagagagcaaatggcaaagaagggggacagttgctgttttctgaagtaaagcctcttaggtgttatttgaccatttgttacctgtgaatgtataattttgatttttaaaataagtagaaaggagcctctttcttaaaaccaaccaatctctgagccccacagatggtattctggtttcttgcaggaggttctgggtcccacccgcctgcccccttctaggacaaccccaccagcaaggaggtcttttagttccttctgtgtgtgttcacctgctcgtcctggcttgggccccagggagcccaggaacctcagggttctctcagctgcacttccatccgtggtgcccaacctcagtgcctaggactctgtgtgcctgacctcctccaggcggggctgctccctccaggtgtccacctggtatgggcatcccgtggcagctctcctctgatgaccgagtgtggtgggggtgctaaggccaacttgctgctggcacgcccagaacttatttgctggctgtttcaaagactccctaaaggcaccatggattttccttagaatacagttctgtgcagtcccgcccatcctcttcccctctgtttcccactagggctgatacttgctttaaggtctgatggctcacccagtccttcataattttcacaatgttatgttccttcctaaaacccttgcagtttaatctgctcttggcgtctgcttctcagaggagctgaggaacagagacttcaacccttcttctctcagttcctgctgcccctgtagtgaggctgacagttgcagaccatagagccagcctggccttgcccagagcatacatgacctcttagtaaggctgggccctgctaagggctatgttttgcacacgttcctgctagtcacatccagcacatctgggctaccacttggatggcaacattacattgaagaccactgtggccatggcaggagtagacaaggtggcagtcttgtcttcagtcgtcatggaaatcccagctatgcagcactagcaggtgttttgtaatggaggatcagatgcttgagcttctgagcaggccccctccctctactgccttctgtcagggtcttggcagcagccggctctggaaggcatcccggctctgggttcaagagcttgctgggcttctacatgaaggtgtgaagtgtgaatgttaccttttctgatttacacttctgttttctgctacaaacttgggatgttttctgagggatgctgaatagatgggggtggatggggggagggaggcaggggctagaaagtgttcttctggggccaccctccagcctggggcatctgatggatgaggaggggagaatctttgagatcctgtttatgagggcactgcaaataccacatttttttcttgtttgcaaattctagtggagaagttttaccaggttgggagagaggcctcagaattaagtccctgtctcctgccacagtttacaccggtgaagcttcctggccgagcataaactcccaggtggagtacaaacagccttcaacaatggcaccatcattggtaccaatggcattgagaggaggtggcactgacaccctaagtgggtggcactgacacctaagacttatggtcttctgctgcctggagagctttgcctccatcactggtgcccaccttgggaattcccaggaattactcttcaaaggtacactcggacgcccactctgcaaggccattttgttcccttacagtgcctctgaaatcattttgagagaggagaatagggaattagggtaaacaacggttaaggcataagcaaaagaacagcaggtgcagccagctctagacagcatataggccacatcctcactcctgttataacaaaacagaagtttccacttcagccttttgtttcatcctgggtaagtccttcatagggtgtaaccaattggaggcctctaaagggcacctaggggtgttgctaaattattaatagcttaaaaccctaaagaacattgtaatcagcgctcttgagccctttacataagttggcttccactctgtggagtgtactttgcttcaataaatctgtgctttcattgcttca

SEQ ID NO: 1432 - DNA, 1173 bp, Homo sapiens
ggtaggttctgacagtttcatccatcacaatacaggcctcaccatgtcactgcctcagactgataaatgcaaaatgacagtcattcatccggtggaatagaagaagccagggaaaatacaacatgaagtcacttatgccatttgatatagctttgcaatgtgtatcttttctctcccctatcttttgttttgtttgtgtacatgccagcatgattatagtctttgcaaaaatatatacaagacaacacatttccctaaaataaaaaagtatgaatttagaaagattatagctacattaaaatgaattcagaatctactatgacataaatagaattagttaaagattaaggttagaaagtaaatgtcacttcttaactttttctctttcttgctattgaggagcacaatctaaaatttgtaggcagatagagtataaaagtaatgtacaattatggcacttatactatttttttcttttatacaacaattctacaaaaataatgactatatgtacacattaaaggaaactgtagatttactgaaaaataggtattaataatatggatatcaacagctgtgtacctttaatttaaaaattaaaaaaataaaaataacagtaaactgaaagtctccattctctcatcttccttttcctatgtttatttttaaacaaattatactgcatatatcgatatctattagggtcatgtgttgacttagcaataaatttaattattggtttagatatcttacagatgtatggaatctctaatatacacatttttgtttaatatgttactgagaaagaagctcaagtgatagaaataacacaggacaggaagtaagacagttctcgtctgaagttcttctctgacagcccacaaactagttaatatatgtgcctgtcacagtctccaccagaagctttatcttactacagagtccagatgcattaaggctgtgttcgagccatgatcttcctctgaagaagaaatgaagaagaaatttatcttatttttggatatagtgttcttagttggcagtttaattattatttttacttcatcactttgtatacgtcatcgcactttctcctggcctataagatctctcctgagaaattttacgttctactttactggaacttcattaaatattatttgcatcattttt

SEQ ID NO: 1433 - DNA, 1286 bp, Homo sapiens
ctgaacaacaagttaactgctgttcccagttatatctggtctttcccacccccaaacatacacaaaagatttttgtcattcttggcactggacaacagaagtgataagacatgccagcagaactctaaaggcagaatgtccttccacctgttttatgctgtaagacaaacttccaagtgcgaggcagtgtggagggctgttgccttgaatggcagctgaatgcaccagcgggatccttggcagcaatgcccaggcactgaagtcgggcattcaggagagctaaatggagaaaagaaacttgagcaaactgcttcctggaacactgagaacctgaatgggaaattaagaagaaccagattctttctattcttccaccagccaaggtcagatttccaaacttctattgattctaatctttcccaaacagtgctgtggcaatgtatgaaagtaataaaaataatcctttttctgttaaaaaaaaaattgctgttacttgctgttttgttatgcttttgctggagattttcccacccatcttaaagcagcaacttcaggatgggggaatcaagcaaaaccatggtgaagagattcatttaaagaggacaagtgatttattctacatctcaggagacagttccttaaggtgatgagcacaaaaggatccatcttatacagtgcttgccagcttccataatactactcaccacgatgttgaaatcacctgttccagaaccagtcctgtcctttgacaagaaggatttaattatcagtagtggtggggactggctggagagaggaaaaacacttcaaggactctgccacctttcgtagatggagagtgcaaagtttgtaccatggaactccttctctaacagttactctgtggcagtgcctatttcaaacctcccttaacttctgattgtatagatgtttgtttcatttgttcatctgtttgttcacttagtcagagatgttttaagccttaagagaaatagtggactagaaaatgccttggaaaagtacaaagttcaatccaagtaaactgtttttaaactaggaatttatgaagcctaaaatataaaatgtatatacatggatatgctctgaagtgaggtagaggggtagaaatcaacattgtgatattgtactatagttttgcaagatgttaccattgggggaaaatgtttgaagggtatacgggatatctctgccttatttcttacaactgcatgtgaatctacagttatctcaaaataaaaatttaattaacaattgattacaattaa

SEQ ID NO: 1434 - DNA, 403 bp, Homo sapiens
gggtaccggccccgacacacacacacctgaggactccccacccctcggttccttacctcctatctacgccacccaaagaaaaagagtcggatggactgggtgacccagggagggagggtctcctgcctagcgaagagtcggggtctcgagtaggagctcacacctacttaggaggcgacagcgaggcctgcggaggaagcagttgagggaaggcaggtgtgactccaggctctgcactggttcttcttggttcctcccaccaggccctttgttcctcatgtccccatgtttctctccctctgcgtcttagcacctttcttctgttcaaagttttctgtaaattttctctttttttctttctttcttttttttttttttataaattaatttgctttcagttcca

SEQ ID NO: 1435 - DNA, 639 bp, Homo sapiens
gggagtgtgatttggtggggaggaagaaaggtagaagagagaagaaatttcttggggcttctgagatccacctgataatatttgacactgtcttcaggcaacagctctctactgccctgagaatgacatccccactgttcaccatggccttaaatcccctgcgaattccacctcatcctctgccacttcccgtcactgctctgaagatgccctgatcttgtttcagtcccttggatgtacccagctcttctccatctttgcatgtgtcatagcctcttcctggaaaacccttcctgctgctcatcccagaactgactctccatgtatttactcttattttgagagaagggggcatttccaccaccagaagggaacttgctgtcttggtagccattgtcccctgacacctggcacatctactctatacagtcaccattcaagtggatgttgaatgagtacacttgtttcacagtttggttgggtaagccccaaagcttggttcccggtaggatcaggctttatgagtgggctgagtttctataaaagtctccctaccagtttccaatcttggtgaaactatgtctgtgggcacaaatgagaaaacttgccattcgtatcaccggttacccagctgtggac

SEQ ID NO: 1436 - DNA, 2998 bp, Homo sapiens
gtttccccctgagggaagtatacctgtcctgccagccttggtctctggcagggaaggtccttccaacagagagggaattgcttagaattgactcaacactgcctccttgctgaatggataattcaagcaaacaactcaagagctggatgctgcccagacaggtaggcagccagataaagtgagtgtccagggaaagagcagtaagggtcagaagagaaagagcctggtgttctcactgcctcctgccttccttatgactgtctgttcagaagtcctcctagcatctttcttctgccttcccctgctcctgtccctgaaaccttttcttcaaaagaagtggaaaagaggaactgggaacccatatagcaacagcatcacctggaatgaattcctttagaacatactgtcttggaaatctgaagcctgcagggctggacaggcaagaagagcagtgagcactgcatgaacctgcatgtactccgaaatatttttcaaatggaaaagaaaacagagaacacaattttcaaaatatctagagccctccaagaagtctttgtagagatctataaaatctcaaggcaatttaaagaatagaaaaatgttttagaaacactattctctccacatcctggggcagcagccttctccaaagaaacagaaagaaggaaatggattgccttagcaaaaaaacaaatgaagacactccaaataacagaagaatgggaaggctacagaccttgaagtcagaagaaaatttcctctccttgccccgtttctccttaaatggatcaccagtacagtctcttacttctagagccatgttaagctttcttccccaaagttgtaatgtccttcttttggttgtgtcgtgtcctaaaatcctactctttggtacaagatgaaggtatatgaagagataatgaaggaaacaaattcaatgtgtttgccaagaacacagtcttttaaataactcttaaagggttcgtttaaaacagtgtaataaattgtggtaatctagtacacaaagctagtaggaacctcgtttattaataatatttcaacattgagcagtagagggcagcactatccttcttttgcaaaatgttgagcactcttgagaaggaaaataaaggcaaagctcctgacccctgtgtctgtgtttacttttaccattaaaaaaaaacaaaaaattggagtatttttattatggtttaggtgattatgtataaagaatgtcagagcctgcattacctggaagtggtgcaccaggtaatgcaaaaaacacggaaggtttgaggtcccccactcaggatatgggttctgtctagtaaagataaacagtagcttgaccctgggtaatcagatagggttattgtatgaacagacctaatgctcctgcacgttctggatagaagtcaatctactgaaatagcaggatgtagttttaaaaaatgtgtgtaactcatatagtcttagccctgataagtgcttctaaattcttattcactgcctttattctgctgtgttagtgttgctctctgtcatacgtgggtcaggtcagaactagctcaaatacagtatgtgtattatgactttaaggagtggtgtcagacaagatgggtaaagaatgtctttcatgggactgcagttggctaaatggctgtgtataagtagtgaaattgaagccttgtatgctcgtcgtcattctatcacagtatgatttgagtttccctaaccggtaaacagcaagaaaaaatgatctgttattttttactaaagttacttgatgctctttagcaagctgacagaataattctaattttagcaaatacaaaaccatggtaatcctagcacatttggattctgtttaaccctgaaaactcttttggcagcaaatcttcaatgccaatttagataaatcccactaggaataagcactgaaagacgttgagtctagttcccagctctgccatgtgaagttgggcaaattacagtctctgagcttttatttcatctgttaaatggagataatacctcctagatttattaaaagggtcaatttagaaaatatgtattaaaatggtttgaaagccatttaagtacctaatgaatatttctatcactgtagcccaaaaagattcctgcctagaagactttatgtctcttctcctcatttggtatcattctattgcctgagattgttaattaacttttatgtatactcaatattttctcccaacttggttgctagttccttgagaactgaaaccatcaattgcacttcttggtatcctccacaataaggtatctaggtactcaaatatttgttggttgattaaaaacataaaccacaagacataattaactctttttaaaattgtggtaaaaaaacatgtatttaccatcttaatcatttttaagtatactgtatattagtgtttactatatgcacattgttgtgcaacacatctctaggactttttcatccagaattctttttttttgagacagagtcttgctgtgtcgcccaagctggagttcagtggcaccatcctggctcactgcaactgctgcctcccaggttcaagtgattctcctgcctcagcctcccgagtagctgggattacatgtgcctgccaccacgcctggcaagtttttgtatttttagtagaaatggtgttttaccatgttggccaagactggcctagaactccagacctcaagtgatccacccgcctcagcagcccaaagtggtgggattacaggcatgagcaactgtgcctggcctagccattttctataaacctgaaaatagatgccagaaaagaaggtgccgctataaaatgctttcttgagtgatttatgtctaacatacaattaaacatttatgagaaggaaattatcaggttaaaatataaactcacttgccaattatttgattttcaggatatctgacttttgttaattactgaaaataaagtattatttctaatcacta

SEQ ID NO: 1437 - DNA, 853 bp, Homo sapiens
ctccccagctccactgaaaacaaaaccaaaaacaaaacaaatcaaagccttaaggatttatcaacctggagagagtgcagcccttctagactgagctgcaaagatggccctgcctccatgccttgttgaacatgatgatgcccctgggaatgggaggtgatggttttttacttcggccctagtacagagtatgctcttgaagctggattccatcagcaggaatcactaggtacttctaaatcactggagagtcaatctgaagtcagatgcatactccctgaatattagtctttcagctctcaaatctccaggcagcctctattgattgatctgagttggcagatgagttggcaggcctcaaattcctgttcccagtgatatgagtacccacagataattcactggtaagatcaccgagtgacccaggaatgaaacctaccattgaagatgtttatttagagctgtatccactgtccacagccaagggaaatagccttttctagactggatatatttgaccagtagatggagtaagtggatcccagaaccaccaactaaccacccagaacctgctgatcaatgctgttgtctttcaatattctatcaaaaagggacaatgccatcaccagcaactaaatcttgagcttaaggtgcatcttcggcaggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccac

SEQ ID NO: 1438 - DNA, 548 bp, Homo sapiens
attacagattccacattgcagctaatcttcattaaactaccacgtggtgaattttaatgtagtatccaagaagcatactgacaccttctccattgtcctactatgtatctgtgtaaggccagattttcttcatatacattaaccaaagcaacatatggcaacagactgaatgaagaggcaggtttcctgggactctgttgcatcaaattctactgctaggcatcaattttaaagtatttcatcagttggacctaccaaatatcaagtcaggatttggccatctctgctcttgccattccacctctcacgactctatcctcaaagaaaagaaaacagtctttcatcaattatggttaaggatccccaaactgaaacacatgtggctaaacgccattcatatcaccagcccacaccagtctggtggtgggggagagaaggaaaaagaggagataaatggcctacatgattgatttcaactaagacccaaatcttggagaacaattattggatttaccactgtttgtttttgcaacatttcggaaatcggc

SEQ ID NO: 1439 - DNA, 1645 bp, Homo sapiens
gccctgctggctgtcccgcaggacccagcgccgcggtagccttctctgaactgcggctcaggcggaggtgtcactcctgcctccagcccaggagggcaggtcaggttatgcaacgcgtgccgcgcgatctccccccacctccaacccccttttctcccgggtccacaccgcagttcccaccgctccgggtgtcctccccagtgcgccgcgatttttgtgtccaagccccagagtccctctgagaccaacccccagccagcacagacttcctgccttcccagctcggggatgtggtctcattaggttgcccaagctggacttgtactcttggcctcaagaggtccttccatctcagtctcccaagtagctgggactacaagcatgcaccactacactcagccaaatactttcaataatttgccagctgacaacttgattgggttctccttcaggtttgaagcgccctcgagaagtgtctaaaggagacagttgatagccaaacaacagttttggattcactgactgattatgaaagaagcagtagactggtatcaagaatcagtcagcaaggaggccctcaccagacgccagtgccatgttcttggacttctcagcctccatattcatgaactaagtttttggaatccttaggcttccacgtgtggaaagcctgagctaacctactggaggatgagccatcacctggagcagattcaggccatcctagttgaagcctccctaggccaagcaaccgtccaactaccagacattgaccattcagccttgaacattcagcacaaagacaaaacagaccagaccagaagagtcccacagaataggggaaactattcagagaaaacttaagccactaagttttatggtgttttgttctgtagcagaagcataggcatactgacaatacaaaccgaaatccttctaacgtagtggaccttttcaggccagcattttttccttgaaaacctggagcatgtatccatcttatagcagagatcactttcacaatgtttgggctcttgatttgaattgatgatgtaatgagccctctatccagattgtaactaattactctgcgaattgactggattccacacccttctaatattttacttttcctcttttatcaactctcattcttgctgccatgatcaatggaccaactatgcttataaccacaaattttgatatgcttaaacaaatgaacaaatatatttaataatttcttttttttttttgaaatagtatcttgctctgtcacccaggctgcagtgcagcagcgtgatctcagctcactataacctccacctcccgggttcaagtgattctcctgcctcagcctcccaagtagctgggactacaggcgcccaccaccatacctggctaattttttgtatttttagtagagacagggtttatccatgttggccaggctggtctcaaactcctgacctcaagtgatcctcctgcctcggcctcccaaagtgctgggattacaggtgtgagccaccatgcccagccaataatttcctgatataataaaaatgccaatactatacaattaaatagtaaagtgataaaaaataggataacatgataaccactaattaatatatactacataatcatc

SEQ ID NO: 1440 - DNA, 2194 bp, Homo sapiens
ggaagacttaagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggttggagtgcaatggcgcgatctcggctgactgcaacctccacctcctggattcaagctattctcctgcctcagcctgccgagtagctgggattacaggcatgtgccaccgcacccagctaattttgtattttttagtagagatggggtttctccatgttggtcaggctggtcttgaactcctgacctcaggtgatccgcccacctcagcctcccaaagtgctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactggtactggctcctgtatcacccagctctggagttgaaagagctcttcattcctgagtctcctgtaccactgagaataggctggagtgcagtggcgcaatctcggctctctgcaaccttcacctcccgtgttcaagtgattctcctgcctcagcctcctgaatacctgagattacaagcatgcaccaccacgcccgtctaattttgtattttcactagagacggggtttctccatgttggtcaggctggtctcgaactcccgacctcaggtgatccgcccgcctcagcctcccaaagtgctgggattacaggcatgagccaccgcgtccagcaagaataggtgattttcaaacttggaaacattcagaagttatcgcctcagtttcagattgagtagtctcaaagagattacagacatctaccacaaattctctacttggtgtggtgcaaaatcagtatgatgtaaactttgtctctcagtttcttcaaaggaaagaagcaactggaacacacatataacactaacccttccagctgcattatgagggaccagtacctgtctcaaggcaaaattatgacttagttcatcctcacctctggaggccagtaaaagtgggttatagaagaacaaagaggcatctagatctttcactgggttatttggagagaaacatctcctaccgaaggccagtttaacaagactggtagaggaggttatcttatctaattcacagaaatcaacacattgagtcaagaaaaatgaaacacagaaacactctaaataaaagaagataagtcttcagaaaccaaccctaatgaaatgaagatatgtgattaacctgacaggaaattaaaaagagcaaccataaagagtctcatgggagcaatgcatgaacaaactgagaattttcataaagaaataaaagataacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcaagggaatagtctcttcttacatacaaaatgatccacggaagactgtcagcagacttcaccagaaaactttcacgccagaaggcagtcgtgatatatacaaaaagctgaaaggaaaacactgccatccaggaatactatctccaactatcctgtgtttcaaaaattaaggagaaatataaagttctcaaacaaaagatgtgggagtttaccaccactagacctgcacgggaagaattgctaaagggagtccttcaagctgtagtaaaagagtgctaattagaaacatg

SEQ ID NO: 1441 - DNA, 463 bp, Homo sapiens
agcaacgatccagatggtggctgtgctctgtctgcgtgggtcccagagtgagaagctgaggtgccggccttgttgaacagggagggctgctctctgctctggagatggcactgtgctctcatgtccacattgtggaaggcggaagggcgagagaggctgggtgacacctcttcttgccttagaaacacgagcgagtggttctgaacagccgcggtcttgcatgcctgcccctcagcaacggccctgctccaaaccggtgttacagtgatctgattattgtaattgatgacattaggaataaggaatccacacagaataatacaggtgcctgtcatgccagagtggttttattcattgttagagaagttcataaagttgaaagaaagcatctacatgggctagaacagcaaaaagcatgttttagtcctttcttaatttgtgaataaaatgatgaattccagaa

SEQ ID NO: 1442 - DNA, 729 bp, Homo sapiens
gcagggcaaaggaggaaagccagagaaaaggcctcaagtctaggaagaggaagtcaatgctctggaagccagactctggctctctatgcctcaaaggaacaagctcagagctgtgctgggatctaggaaagcctggtcccaggctgaaggggaagcggcgggtcacagtgggtgaggccacactgttctggtcctgatgtcgcgatgcaaacacttcattctgcaagggctcaaagggagacaggtggaggttgttaccagggctggaaagcacctcattcccagagcaaggcagacattaacccctctgctgggcctgctgacctgagatgactccagcaagcttccctggaaattcagcctaagcagctcacctcgtgcatgctgggactgcggcctccctgtaagtgctcaggtctgtaataccacaggaggctcatcatcagctctcctggaaggacaacacagtggttatggcttgaactggcaacctgagttacttagacaggcagagaggctggctggctgccctggaggttcatccaacctcaatcctgcaggctccggcaacccatgtcccctgccccaggccaagcattcagaggcctggaatgctgttaggcatggagggagaagggggagaaggcactgacaggtgaggtggggggacaggtgcccaggctctgctggctggaaaggttaatgagctgatccaacccaagccacaag

SEQ ID NO: 1443 - DNA, 2471 bp, Homo sapiens
ggcacctttgctgagtcatttggggttggcagacctggaaaagacagcggtttagagagtggttagtgccgtgatcagccaacgcaggctctattgtctgttagtatttcctggtgcacttttggaacctgatctgcccttctcatggttaagggcaggggatgagtaactagccatggggatgttctgcatatcttgccttgtgctgaatttcctataaaatggcttcatgaaactttgatgtcagcttaagcagtactgccaccaggctctgcggagggccctaagtgaatagagggcagcagtgtcttccaaatttgaaatgagtgacagtgggttataattaggggagaagatgctcttgatgctactgagaagatacagagtgagaacttttcttagaaaagtctgaggttgtaaagaagaaccaagtttttgttttccaggcccccagcagaatggatggtgcccactcacaatgagggcggatcttccgcacctagtccactcagactcacatgctgatctcttctggcaacatcttcacagacacgcccaaaaataatgctttaccgggttcctaggtagtctttaatccagtcaaactgacacctaaaattaaccatcacaattaccttctcactaaaatcaatctgagaagaaaatggtcataaagaatttgatgcaaatcccttttttgatttataggatgaacagtatcctagataaggaaacagtgaaaggctgttttgtttttttttttttttcccctcctcttcatactccccaatgtgagtaatgggcaaaaaattccaggagaatgggagcattctgagtgataagaacaagtatctctcaacatgtagagtgtgtatacgggtgggttattttcaaatttcaagtctgcaaatgggtagttccaggtatggcttggtgattgaagtggaggttcttttggggctagtcctttgtgctcctgtaatttccccccaactctgagtctgagctcagtgagaacaatcactttaatgcttaatgcacaccgtaatacacagcggagttaacagaatattcagacaatcacagacacaatggccttcctagccatgagtttggaaaagtgtttctaggagcttgttgtagcagaggctgtgtagatgacaaagaacatgcactgcattgtagatgggttatagttatggtgaccagcccttggagttagggcagattggggtatttgattgcaaagaaataagacacttctatatatttttttttaatttgctgatcatgggaaaatcttcatgaacccttatcttctttttttttttttgagatggagttttgcttttgtcacccaggcgagagtgcagtggcatgatctgggctcactgcaacctccatctcctgggttcaagcaattctcctgcctcagcctccagagtagctgggattacaggtgtgagccaccatacctggctaattttctatttttaatagaggtggggttttgccatgttgtctaggctggtctccaactcccgacttcagatgatccacccacctcggcctcccaaattgttgagattacaggcatgcaccactgtggtcggccatattcatgatttaaaggaattgaagataaaagaattgagtttgataaaaaagagagagaagaatattattttcttcaaatactgacttttaagtgagatagtgtgcaaaaaatccatatactaggtactcaaatacctgttagttgacccttcccctatgatgtgaactggttattcacaactatctttatactttaagtcctgttcctaaacacacactgaggttctggagggcagggctgggtcttaggtaaatttgttctgctaccttctcactggacacctggctcacccaaagcttgcctctcatctgttttctgtgtacagattgccattcaaaaagtgttttctgagtgaatgaattatttactttatggagcatcaacatcctttttatgttcttgtccatttttatgtccttgtcctcacccttgtcccttcaagttcagtgggtcccagaactgaacttgaagagagttaattggatataggccaggagtgtgattggacatacgtgtgtgtgtgtttcattaaaattctcaaactaaaaataaatggtttgtggattagtcaacttctgttttcttctgctcgatatcctgaattatccagtacctgttgcctccatgctactgaaaagtgaccatgtgtggtatgacaagcttatcagaaggctgtcaaagtgcttggcagagaagacatggagtttaatcctgagtggaaaatggcattgtggaaacagatgaattatagtagatgaatatagtagaaaatatagtagatgaattaaagtacatgaattatctactttgtggaccatcaaaatcctttttatgttcttgtccaagttcagtg

SEQ ID NO: 1444 - DNA, 4388 bp, Homo sapiens
agttggcccttagatcatgagaccagcctaagtgcccaaggaaatggaacagcagggagggggagggacatcacacccactatcaaaacttcttgttagtctctggcttccacatccttccccaaaacttcagcccaattcacagccgcatttttccatctctttgccattcctccatgggagagctttctgttggtacaggaatagctgagaagtgggaaagatcaagggtagtaagagctgcccccgataatctacagaaagctttgctggaatgaggttgtgcatctctgaacctgagctagatttgttgggtcagggaccatacttatttactggcccaagaattagaagaggaggtgtctaagaaatgcttgttgaatgaataaataaacagccgagtgagtgtttatatgagcctgaaaactgcctgcaccagcacaaaagtaaagccccaacaccctcaggtcacacctactggaaaaatatatgtcagccccagaaaaatgtgggcaacatgaggcaactccggagcaacacaggaaactgccctcctcttctggcccctcttccactgtgatgctcaaagtctgtgatgaccaagtctggtcatctaatcagcaggatataagagggtcattcttcactgcggccattccagtttcctggaaacttggctttctcctgaccgtttccccaggagcacggtggtgacaagcttgagctctgacatcagaaagtccccagtttgaaacctctagcttcttactcgctagctatgagactttgggcaaattaatctctaaacctcaatttctcaatctgtaaaatgttcaaggtcaagcaactcacttttccacattgtaattgatgaaactaaaattcagactcagatctgcctcactccacagtctgtgctttttccttcccactcatctttttctctttctattaaaaatttcataacacatttgagattctgtctcaactcatatcactgaaatcatctgtcacgtctgatgatcatatagaagccagactaagattcagccacaaatgttatgcctaaacatttcttattatttctttttaatgtttctcatgtatacaatcaaactcgcaccctagtattattggcaggctaatatatgcccatgagacatgtagcttaaatctctatgggataggataagtattctccctttgtttgtgatttgaaagctttccatggatgctaaagcgatttgttaaaataccttcacctgtaagtgtttttcctctcttaaaagcctaattcatctctgagtttgtttactaaaataatctaatttgctcattttctctagccattccaagctaaatcccaggaagtactaaagaagcaatgcacagacacagtatcatacaatttgagacacagtattataaaattgatgtgaacttctaggcacagtgtgctcacagtctgtctggaaataactttgtagcaagcatagttccagtctagctgcctggcagcctggcaggatattattattactgatactaatttactttttaatgtaagtctacccagaatatattaaagaagtttcaagaaatcaggatcatggattataacctgacgtagtgctaaggaaccatcagttccatgtaagcatttggttagcaagtctttttcaaaggccatgcttgagaaacagttttgctctcccaaacaatgtgttgtagttttttttagcatactactgtgcagataaataaatgagatattaatgccattgcaagttctggctttgtgtagagttttctagtgaagcctgtttaggatcctggatttgtccaagctgttctgattatcccatcatttttaacatggataatctacaatctttcatctattacataaattgaattctggcacaagttcaactgctcttcattgaaactgagaaaaattttaggatcactttgctggaatccaaagaagatgttaaatactaccaaaaaaaaaaaaaggctgaaaactggtttccaagaatctctggggcatccttaagaactccccttgcatgttcattagacggccctttacccaatgtatctctaatagtctgctgaaaatactcaaaggagtcctcattagagggaagcagaaagaccaaagtcagagacggagatgtggccgtagaagcagaggtccatgtgctgcggggccatgagccaaggaacccacgccgcctctgggaactgggaaaggcaagggagcaacgtctccctggagctccagagtgagccagccctgatgacaccgtgacttcagccctcggagactgactgtggacatcggacctctgtcactattttctgcaaactaggaatagaagcaagcttcttaacctgatgtatcgcaccttcaaaaagcctacagcaaacatcttacttagtgatgaaaaactgattgccttccccataagattgagaaccaggaactgtccaggaagaccctgcagtctctctgcaggctcatgggagctcccagaactgagacaacacacggatccaggcctgcttcgaagtcagtgggatgcggcccttgaaagtcgatgtattgggttcctagggctctcgtgaaaacatgccacacctggctggttttaaacaacaggagtttattctgtcagttgagaaggctacaagtgcaaaatcaaggtattgacgggatgagttccaactagaggctgtgaggcagatcaactccatggctctctcctggcttctgctggtttctggcaaccgttcacttcccatgcctggtagacacatcactctaacctctgcctccctttttcatgggcacattcgcgcctgtgtgtgtgtgtgtgtggatgtgtgtgttaaggacagcaatcattagactagatggggcccactctaatccactgtgagcttctcttactttggtaacatctgcaaagaccctatttccaaacaaggtcacattccatgttctgggactgtcttctgagagatgtctcccccaggatccttccaggtggaaggatgccctttgacctgcaaagccaggcagaaaaccaggatcagggcaggacaagaggatgctagcctgtgatggctcccactcaggtgggatgtgagaagtgcctgtggcctgggacacaccaacttgctcccgttacctcatctgagatggactgcacagtgtatgtccagggcccaacccggtacactgtgcctttgcaatgctgtctctgtgctttggaaattcactcagcccactgcgtggggtggtctgaggcgggccacaaccatttctcaaccatccctgagtacctgaccagtatccctcgggggtgacgacgaccgcctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatctcggaagatacattcgagtctatgtgttttgtgcatttatttttgtttccttgaattaacatggagtccatttcaactttcacttagtctcctttctcttcccccacttctttctctctctctctttctttgtatgtggaagaattttaactctgtgttccataatgtctaaatactcaaatttagagttgacagccatacagcaaattattcaagttgctgtcaaaaaaaaaaaatccctgcgttttctaggattaaaactgtgaatagagtactggaagaaaaaaaagtcatagactcagatgcaaaatgacaacatttaatgggatgataaggaaataagacttgacaagaaaccatagcccactgcagactgttcacgatgtcagatggttcatgatttttttccaggtttgatacagaagaatcagtttgttacaagaaatgcttctccaactgggatttaaaacatcatttaaacaataaacacgtttgtatgtatatataaatagatatttagatataaaaacatgcatatataggcacatagacatgtacatacacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagacacttttctttcttcaactattgtcctatcttattcaggttttcattttcttactagatgtgttttcaatggtttatgacgtaataaaatttctttacctc

SEQ ID NO: 1445 - DNA, 852 bp, Homo sapiens
ggatcctgtagggaggcacctgggacgtccccagggactggtgcagccctatcctttttttttcttttttgagacagagtctcgctctgtcacccaggctggagtgcagtggtgcgatcttggctcaccgcaagctccgcctcccgagttcaagcgattcttctgcctcagcctcccgagtagctgggactacaggcgcgtgccactgcgcctggctaatttctgtgtttttagtagagggggtcttgccaccttggccaggctggtctcaaactcctgacctcagatgatccacctgccttggcttcccaaactgctgggattacaggcatgagccaccacgtccagcctggcgccaccctattctacctgggaggggtgtggggaccctttaggaggagggaggaaggccatcccgtcccctcattagcatctgtagggcggggctgcgctagctgtggaaggcgctgtctgtgtgccccagcccaggctcgctcttgccagcctatgccttgcaggattgtgactcgttccgtgcaggagggcatcttgctccgagtctgtgtcccgggtgcctctcttctttcttctctggagctcttctgtgtctctgggggcctctctcggggaccacctctagctccttgtcttccagtctccttccttcctctttcctaactccccaccttcacccgttcctctccccagcaccactgtgctgtgtccatcaccgactataatatccaaccgaactctcttttcactgttgaatacagcgttatttcttagaaaagtggctgggtactattcatatactggctttgggaatgtaataaatgcatcaaatctgaa

SEQ ID NO: 1446 - DNA, 2656 bp, Homo sapiens
cccagtccagcctccctactcagggccgagggcaccaggaggatggtcgttgcaaaagaatatgggaggccgggtgcggcggctcacgcctgtaatcccagtacttctgggaggccaaggggggcggatgacttgaggccgtgcaacacctgccagcaccagcatttgacacggaatcgaagaaaacaggcaggacataccctgactacactagtacaagtcatcggcgtctcggggtcctgggttttagaaatcacactgtcagggagggctgatggggtcctgggttggaggctggaagtggaggaatcgaggcataggcagaaacttgaaggaagggtcagccgagctggccagaagggggctcctcgccacggtccccagggaagcactttgctcatgggccccggccctgagagaggagctcctgcctcttcccactcggagagggctgacaggagaggcttggcctggtgtttcctgatgagatagcgggcacgttccgggaagcggtgagcaggcccagcagacatcagatgtggtgcttcctgtctcctgtgaatgcgcctggcccttgaggggggtctgggatggagagtcgggggaggggaaccccactcgcccttctccttgttgttcttggcagctggacttgggcaattgtgcctccaccctctggaggggcctccccctgtgctggctgcagatcagaggggcgatggggagggatccaccggtccaggcgggggctcaccttccagacccgggcgtgggcgagaggggtgcatgggaggacgcccgatgcctcagggcccccggtcagcagcgaggcacagactctcctctgggcggtgatggccctgcacgaggtccgtgtgccgtctgcctgcacagggagaggaaaggatcacgcgaccatgggtacgttggccacctgaaggttgagtcccgcagcctagagactggagcgtggggaccaggaggagcttcttagcggaactgggctggggctcatgcagccctccaggagcccccgacgcgacgccctggctcatcccgggtgaagaggctgctgagtctgaactgatgacagtggacgggtggccgccggttcccaacgcatggttgggcctggaacccaggtgactctgggagatgtggtcacagtcacagccgtctgtgggcctttgggttcaaaacagcgcgagtcacaggagacagaagggaatctgagcttgcgattgctcattcttgtcaccctcctggctctgggacacctctgccatctcctaccaagggtaccccattcctggcgagttggaaagtggcctcatgggcagaaaacgagggcaaagggagctgcgtgctgtgagagacgtccccgcacccaccctccccaccagctcccttgggcctttcctccctcccagccccacccacagccgggtggctcccttcactgtctctcctgggtttaactcagaggctggcgagcaggggctgaccagtgtgtgtcggagactctccgagtggccagcacgggcagggagctcataggcttggccctgagaccaggtcctgtctgagaaggaggcaggtcctgtctgagaagaaggacccccacccctcctgcctgggaccctgccttaggctcactctaatgacctaatttcaatttgattgaatgcaaatctgaatttgctagaagacctgatttcatctttccgggttcagtaaacatgacattctccgtgggggtttatttgtggaactcccagtcagagctgctgccccagcccagcagggctcagcgacgtgcactggttttaggagtaaatccgaagcaacagaagcgttcgcactggctctgggtgcagcctgcatcttcagccctggggcactgatgctgggcagcttctcggcttcactcgggaagggactcaggagcgaggtggtggggaagccagcagcttggctgaggcggcagtggaggtggtccagctccgcgactgctcccacagagcagggctgccgctcgggcagtgtgcagagtgcagccgcttggggccaacttgccatcatatgtataaccacttttaatgacatgctaattagggggcgggttattcagatatagctggaggatgggcagttgcttccaggtgttgccaaggcagtgagagcaacgggaactgcccttggcgcctcttccagctttggcctgtctttggtcgggtccggggaccaggcttgcctaccacgttttctgtgtcaaaacagtcacgcagaaataaacagtgacagcactgtgatgagaaaagcgaagaaacaacttatttcaactttctgacttttgttgtggcctcagcacttttgtttgtgcttaacattgaaaacagtgaggcagtgtaaactgtgagatgtgatttttcatttggtaagtgcaaattttagttcattcatgaaaccagttttgaagatctttaaaatagaatttagtcgaccttaagaattgttaattgtttacaactaaagaccaaaaatccaagagaataaagcgttgcaccagtggtaggggtttgtagttgcctaaattgtaccttttacagatgtttcattttattaaaactcactagtcactggatcttctattcaa

SEQ ID NO: 1447 - DNA, 821 bp, Homo sapiens
gacctggcctttctctgcagctcctcttgggaaggcattttcttctttctgcaaaccgtgctgctgtttgtttggagaaggagagctgtggccaaaaacaatccattgatacacttggtgacattaattgagaaaaaaacaatatggtctggccatggaggcatggtatccgtaacatcccccaaaggagctaaagaagaaatccacaatttaccatgagcatttctcgtctgaagattgccaagcgattcctccaggacattcctcaaggactcatgttcttaggcaaatgctttggggaatgtggcagtgatgtatgtgctggggaaacacagaggcaagcatggatgaaaatcactgtggaatattgaagaaggcttccaagaggaggtgacatttgagcttgatcgtgaacacgaagtaaggacagaactaggagctcaactagaggaagaggcaaatggtatactagtgtagactgtgttaatgtgtagacaactgaaagaagtggcatatttgggaagctttaggatgtccatggtgaaaagtacctacgaacaagagatcaatttctgttcatccaccttgtcctgggagggacatcaatgggtttccatgtcctttggcttctggttgagttcactcagtggagaaccctggcaagaggcaggaaaaggggaggaaggtaaaaatggtgctacccttggaaatccaagagcagcttcaagagtcaactataccagcaatccctaaagctggagaatttatgcccatggaaaagtctgtagcgttttgcaaactgtgaggctgaggaatagacc

SEQ ID NO: 1448 - DNA, 126 bp, Homo sapiens
tcccaatgaagaaactttcacatgtcttactctctgtcctagtcccagagcctgtaaaggtgaacccactgggactggctgggggagaagaggaagatttgttccagaaggaactgtctgagggat

SEQ ID NO: 1449 - DNA, 693 bp, Homo sapiens
agccggaagtgggcagagtttgcacggaggcggagctttattggcaaacctgattggctttttgaggcagaggaagctcacctatggctactgccactacaggtccacagggagtaatgcccggctaccactgatgttcattaagacccaagggttcttcagtcggcttgtggtagatgctgcctggcctgggactcacccttcaggacagtgggctcccttctggcccaaggcaggtccagaattactgtccaggagccaaggctttgaatcagggacctcaagagcccgcttgatgttctaccccactatggctgcgcctgtacctaaggtgcaaaagtcccctttacttttccctctacttttctccagcataaggagtctctccccatagccaccatggctggaaatgtgctgagtctcatttgaagccagctagtctcagagtctcacagaaggcccactgcatacctaggtatcgctggtatcgctggctatttggagcttaagagctcttcaatcctctgacatcttgattgcagcctttgagagaccctgggccagaggatccagctattgccatgcttaaatttccaacccaaatgtaactgtgagataaatgttgttttaagccactaatttttttaattactgtattaattttaacagataatacaataagagttttaaaat

SEQ ID NO: 1450 - DNA, 644 bp, Homo sapiens
gctgccatgtgaagaaggatgtatttgcttctccttctgccatgatcgtaagtttcctgaggcctccccagccatgttgaactgcaaagacactttcagaagaggaacgaaggcctggaaggaaaagcatcaggggaacgacgcttacgtctctcctcctccctccggtctcccaccagtgctcccattggctgaagccaaccagaagccacaggactctatcacccaggctggagtgcagcagcgcgatctcggctcactgcaacgtccgcctcctgggttcaagtgattctcctgcctcagcctcctgagtagctaggattacaggaatcctgaggtcagcatcatcccaatttcacagagtatgacatgacgtctcagagagggtaagcagcttgccaaacattccacagccaggaagctgtaggaccagcctgtgctcctaaggactggctcctggctgctatatatagaactaagcctggtggaggtgtcagaaatagaggttcacttctgtcatcaccgacctccctccacacctttgcaaaggaggaaactgagaggcagggatttccgcagagcaaggaacccaaattgctgcctcctgtgatttatacactgcaccccaagctgtaggggtaacc

SEQ ID NO: 1451 - DNA, 4763 bp, Homo sapiens
gtttagtatttttgagaacccagccacctggccatgctgtaccagccttgtgctgagtgctggggataaaggaacaaataaaacccagtccaggcttctgtgtgcccagccctgtgccgggtcccagtgggtaacagcatgtccaatcccctcagtgtcccactagaggcttcctttggggctgctggggacatcttgtttctagttgagaattcagatttatgtccaaagacaagaactccctgaggggcagattacaacatggactgggccattacaatcaacaaggacacaaagctaacacagccatcgttatacaccagacatgtgctaaggacttgatttccccattgtttaatcatcaccaactccattatcacccccatttcacagatgtggaaactgaggctgagaagagtaagggacttgtccaagggcacagagcaagtcagggctacggtgatgtttcaggcccagacctgtttgcctctggagcccagggtttaacacaccccagtgctgctgtgaaagggctctggacagctcaggctggccggccaattcggggataaccgaacagaggtatggaacagaaaggggcgttgaggatgttgctgtgtgtgtgcggtggggggagtgacaaggcttcagcaatggtactcattctctccaaccagctcccagtgctgctgtcctctgatccaccctccgctctgcctgccatggactaattgttctgaaatcccatggatcaagtcactcctcagctgaggacctgtccatggctccctggtacccagaggatagaaacccagcattcaaaacctctctaaccagctccccacctcaaccctcacactcctgctcactagcccccaggcgcagtgggctcttccagcggccaagcctgtgcctacggtgccttcttgcctggaatgcccaactcccccttctcagccttctttgactctcaagtaaggaaaagcactctttgtctccctgagccccttggcacttatcacagagcactctgggcgttaacttccactgtctccgtcttggattagagtggatctcagagggcccggtggtgtctgcttcacctccctctccactgcagcagcttagcaaggactggccgggtaaactaaaaaatgcaaagagctgagagaatcctgggaaagtgcacatttcccaggactgcccaatgacaagccccgtaccaaggcacagcatcaggataccctgatgtggaagaaccaaaaattgcaccctcatggcttatcaggatggtccttgtgtctgtccctttcaagggttctgataatgaaatctgggcaagtcaccctcctgctttaaaacttccaatggttcccagaggtctagcataaaatccaaactcaagggcccacataacctaggtgctgcctggcccccaggccctcctcttgccacgcccccctccctggccagcctccctcacttctttcagttcctcaaggactccccctcactaaagccttacccaggtcgcctctctgcctagggggctcctccattccctgctcactcagccacctccctctccctcttcaggtctcactttttaggggaggcttccctgatctgtccagataagacctcaccactcccacccaatcccaaacgctcccataacctgatcgtttccttcacagcaagaattaatcttcagtgtaaataatgatctactgaagacctatgaggaatgggaaagtcttgttttttgctgattcttcaacacccagctcagagcctaaatatctctcaaatgaatgaatatatgaatgaatgaatgaatgaatgaatgaatgaatgaacctatatacataaatcaagacaagaaggtgggcagaatcctagggaacactgaggcaggaaaagcagggccctgggccaggcgtcatggctcacacctgtaatcccagcactttgggaggccaaggcaggcagatcacttgaggtcaggactttgagaccagcctggccaacatggtaaaaccctgtctctactaaaaacacaaacattagccgggtatggtggcacatgcctgtagtcccagctactcaagaggctgaggcaggagaatcacttgtacctgggaggaggaggttgcagtgagctgagatcgtgccactgcactccagcctgggcaccacagcaagactccgtctaaaaaaaaaaaaaaagaaaaagaaagaaagaaagaaaaagaaaaccagggccctaactaaaaaagacaggaggaaaaacagggccctaactaaaaagagaggaggggccctaactgaaaaaaccagggccctaactaaaaaagtcaggaggaaaaacagggccctaactaaaaagagaagaggaaataaaccagacagtgcagcctcccagaagcaaaaggagggagtttctggaactgcactagagactggcacatggagtcctgaggaaagagcactggattggacatcgaggaggtcactggggcctccctgattgaaccaaggttccgtggaggtgggcacagggctggtacattgcagggggcagaggagtaaagagggatgaataagcaaagctctcaggcgacggttgctcagctgggtctatgccagcctggccctgcagggtctgcggaagacagggcccctgtgtcatagtcaccaaaagcatcaacagagcataacattctttttgttgacagattacattgaggcaacttggcttttggagttatcagggctcagtctcaaaggcagatgcatcagagccaagacccggccctcaagtcctcctattagggcagcactagggctacctctttgtcagcagaacctttggatagccgctgatggggtgagtcagctttctgggcccggcagaccttttgggaatccctggcttttggggcacaacatcctggggaccaccaaaaagccctttcacctgagctttgggaaagaggaacagctccggctgtgggtggctcatgtcaccatctggaagccagctgggccacagcagacgcgtaagtcctgtattcattcatccccttctccttttggcagaaaagggatggcgtgggttggaggggtgttttcctgggttcttgcacaattgctcattagaaattcacttctgtttgggtgttggaagctgggcgattccccctagtagtgatccttcctgtctcactggtcacaaagccctttggcatctacaagctcgttgggtccacacagcagctttgttaggtgggtagggggagaccaaggcacccatcctacaggtggagaaaccgaggctgaagctgggaggtgagccagtctcctggcttccagcccaggactctgcactcctccccccacctccccacctacttcagcaggtcacctgtgaatctgatagtcaggtgggccccaccctgccagctggccccagcgggcatgactcatccgcttccccatgactcacacacctcaggtgctcctcctctggtcaacaagtccagagacttggcaaatggacccccatttttctcacctctccaaagcctctgggaagaattcctgcacctcctctttatggggactctgctcttctacagaatagcaaccaaggccttgagagggaaagcaactctcctaaagtcacatagcaagcaaccagcacagccagggtgggagccaggcatccgggcaccgagcccagtcccggcctcctccctacaagatcactctcgcctgacctccctctcaaggacaggaaaggagcagagacgcactctgagccttattaggaagacctcagggactcccactgaatccactgtggctacagcggctgcttccaccactgaagtcccctccaggcttccctgggcagccagggcggggtttaagaggacgacaggtgtctgtattgctctacctacctaacaaggctgtgcagggtgaagagtgctgctccgtgggaaggcgctgggaccaaggccgaagcactggacaaagagagctatgagcactacctgtaaacaaagggcacagaatgtcagcctcagggggagttcaaggtcatctggtcaaatccccatttgatgtttcaacccctttcctcccctccaccaggggtcacacaatcagtacttgcacacatccagcaacaccgcactcactacctgccaaggctgcaagacctgctgctggagggtttggctgcgtaaaagaattgtcctaaggatgcactaaaatctctctcttcttatgccttgtacctgctggtattagctctgcctccttttgggtcagccagaacaggtctgtccccctctttcctgatggctctttggagatttgaagacagtgatcctgggcccctcaagtcttctacaaattgtgcaccccctttcctccagctcttcctgagaccagggtttccggttcgctcaccctgttccctgatctgctccagatgaaacctgtccctactgacagcacaagacccagaattagacaatcagtcaagctctatccaggacagggcaagcaggactctcacctccttcattagagatatcatgcttctattaattgagcctaaaatcccatttgcatttaaggcagccctattgcatggctgaattcagtttacagtcaacttcagagctgtacgttagtactctgaagttatataaactgggccctcacttaactgtgtaacttgagcaagc

SEQ ID NO: 1452 - DNA, 892 bp, Homo sapiens
caaatattgaagaatctctaaccaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattccccgaatctgtagtgtggctggtatcggtgttcccctggtttaactagcctgtttgaaggcacagatcattcatggggatgtataaccgaaaccagtcctctccaccgcctggggatcttcactttcgcagtctacgactgcctgtgactccagaaagacaaactgcagattggccaagatggggaaattgaggcagagaagccaagacatgtgctaaaggtcatgcaggctatgaatggagctggaatgtgaacgcaggccatatgaccccagagcccatgttcttgaacccttagaaagacagcagcaacacacctggtgcagcagctgcttagttggagtggctgacaaggttggcagaggatcccgttcctcccgtggagtggctgccatgatactgcctgcactgaagctgctcctatttctgaaatatgtattgttatttttttccctgcatgttgaacattatactcttctgttctttcgcattctcttcttcccttccggatgacttctagggtttttgtgattctgtaattctaaaggagaaaggataataagaattgtgaggccgggcgcggtggctcatgcctgtaatcacagcactttgggaggccaaggtgggcggatcactaggtgagga

SEQ ID NO: 1453 - DNA, 553 bp, Homo sapiens
gatgccatccaggcgcacggcgggtatagtggttccgcaaccttgggatgttcggctgagcgcctgcctaacatgggagcgcctgcctaaccctcctgactggagggtcagcggcggggagtcctggccttcaatcggccatcgccacggcagaaactggggcccgggctgcgtccaggcccttccccgtccgtccacaggtctcatgggcgcccggactggggctgatgtagtttcccgacctctgacacataggatctggagattaaagctgctctgctaataattaggttcccacctctcaagatcattaggagcttcttttccaattcctctgttttgcatgcattggaaggcccctggatcctcctggaatccctgatccctgttgctccctggcggagttttctagtccctcttacttgaagcatgtctttcagagcccggcaccacccaagttgggtatctgctcctgctgtcttccatgctggggacaggaaaggctccacgcttgactttccctcctgttttcttatctgctgtcaacccctga

SEQ ID NO: 1454 - DNA, 618 bp, Homo sapiens
gacttgcatcctcatgagactcttaaaccccctcctgaccttcagagatgtttatcatcagagatgggttatggaagtgatcctatagaacctgagagattgcttaactcaaactctgcttctacattagagtgtcttctgaaaaatgacctcaacaaaatttgctatctacctatttactaacataaatgaggaaaccaaaaaggtcaacggtgaggcaggaaggtttcagttcagtggagaaaagaaaatcttgatgaaatgtcattaacttccatatttggaataagctataaaagcttgtcgaaggtctaatttatgtgcaagactgaaagctgtttaaacggataatatgcctccttcatgagaaataccacccctttatgctccattaagttcagacgttgactctataagctacgtaccaattatttctttccagaaacagcaacgtagtttttttctgcaagggacaacagattattgtaggcggctattaatctccacatagttcacaaaatacacaggacactagggagaaaacaatcacgttgctattttaacatttgcaaaatgctatgtggagaggaaataaaaagaagatgcttgtctgattgc

SEQ ID NO: 1455 - DNA, 624 bp, Homo sapiens
ggagctggaaaggtggaggcggaagtgactgatcaattcaggggcgtggggttcgtttaggttttgccctgtgtatgacctcgtttggagccatgaaaccaggtctgtgaaatttagtgtctattttctaccataacacatgttaatttggactaaccacatttcgagtgctcagtagccacatgtggctagcgactactatcttgagcaatgcaacgataagtctgcacttacgttcaaaaagacttaaagcagggatcgacaacccccaggccacagactggtatggatccatggcctgttaagaactgtgccacacagcaggaggtcaccatgtgtgatgactacatccaaagagagtgagtggcttgagacattggtagtatgtgtatctgatcatatcaatatgttaaaatgacgttcaaagtatgatctacctcagaataatctagcctcaagctttattctaggaaggtaattctgaagatacctatcttcttgagagtgaaattttatggaatcctagatttctcatacctaggaataacaatacaagggacagaatagttagcagtgttcctgttgaaaggtccaagtatctccctaggcacagaaaacacccaa

SEQ ID NO: 1456 - DNA, 401 bp, Homo sapiens
tttgtaaactcaaatcaaggtgtatttattgcacaggcacaataaatgaacaaggcatcttaagtactacaatgacaggtgagtgggtcaggcacagtggcttggctagtcatgattagcaaaggaacttcaaagagttttggagcctgctttatatctgtgaaatgggaattatttccatctcaaaggtttgaggggattcgctgagagaaacttcttagcatgggatctccagaaactggaagccacagagaaagcagcggccagagggaggaggaatcggacaggctgatcacttggagtgttcgcctaagcagtttctagaaatggaggcagggaccatcaggaagctcaaaacctttgcttcagccgagtttgcagaacgccctgtgaggagaatg

SEQ ID NO: 1457 - DNA, 912 bp, Homo sapiens
actcccatccagcacataaacgctccccacgtccttgtttgaccctgagctgatgacacagcatgtggggaagactcagcagaaatggacggctgaagaccgagaacactgagcagagactgcggctgctgctcaccacctgaaagtctggagtttgaaccttcacaagttagaggcttaaaaacaccacggacttcccaggaacatccagaaaaccacagcttcgcagatccaagactaaggatgtgtcaggcagaagaaaaagccagacagacctgccctaacagcatcaacactgatcctcttcagggtgatccataagaattcagcctgcgagaacaaagcccaacactcttcaggggaagacaacagaatccaacaaaattcagagtctctaccatataaactctaccatataaacagtatataaactaaaattccaacacacaatcaggaagtactggacgtgtgaagaagggataacaggatccatgatgaagggaaaaagtagccaaaagaagcagatcctgaggctgggcacggtggctcacacctgtaatcccaggcgggcagatcacgagtaataggaagctacagaaaacatgggcactacgccctgtgagcctcccaccatgcacaggagccgccttctgaagaacgtgccagaagctgggagggctttgtgacagcagatggacggagctcggctcccaggaaggggctcagcattcgccctgccagtcgctgatactcagagactcaatagatgatgttctccaaacttcataaaatataagcacatttcactacaggaagacaaaggatgaataatgcctagaaaagataccgaatgtctatgccagctctggagagaccaagacctgccactggggagtgtctaccctcaagagg

SEQ ID NO: 1458 - DNA, 593 bp, Homo sapiens
tgagaccccagctcaaagacgacacacggagaagggagccaagcagcactgaccgatgtgggcagcgttattgccgaccaggaatttgtccctggacttcccctccgcactgctccatgctcaccttcctcttctcgggggtctccaccagctgccagctgttggccttgaggtggtagagttcatcgaacttcatgctgatatcctcgatggacagctgtagcaggtcccagaaccctgccaggtcctgggctgtggggcgtgggttggcatcagggttctgtgggccagatggggatcagtggggccagctcagcagaggcttgtcctgctccccccaaccccccaacaagcagggttcctctgggccctgccagcacccgcgggggctcttgaggcctagtgtctggggaagaaacagaagttcttggccatggtgtgacagtgacaccgagagaagcccgattcactcccaggtttctgctcacaggtcacctggccagggatgccctccctgaccaccctgaatgcaacagcaacaccgaccctgcctgtgcagtggacactatactgctcttacccttcctggttat

SEQ ID NO: 1459 - DNA, 2274 bp, Homo sapiens
gccagggctttctgcagctgccccacgcggctctgggcccgggcacacctgcactctgcctcgctcagccggctgctcagggtcgccatctggatgcgggagtcatcctgggcagaaggactgagcctagcctggtacctctgccacctgctgtgagggctgtgccatcctgcccagctgccccacaggggcctttctagagccccagccaggccgttggcctccctctgctccccagctctgcaccacctcctggaggccacctgtgacctatcttgcctgctggatgggaactccctgtgggcagggacagatggtggcccgcagctcgctgttgaaaagcaacagtacgtccttctcgcgggcctcgtcactcagcgcccggcgggcctcctgggcctccctgtgcagcccctcccggctctcctcgacgccctgcagctcctggcgcagtgcggccagtccctcctgggccacggtcagctgtgcccgcagcctctcagcctggggaggaccattcagctctagaggcccgctggggaccactgctccagggatagccacaggggcctgtggcctctgacatggtgtggcaggcacaggtgccctgcccaacttggtccccatgcgctttgctcaccccatggagccaccaatccctagtgctgcggaggctgcagggcggcttccacgggctgaggcagggccagcctaagagcccagaagaccccaccttgagcccctgggcccggccccacgctgcggcctctctggacccccaggacgctgaccactgccgctaggtcctggaggctctcgcgtagggccgtggtctccctctgatgggctgtgatggcatcctcaaactgggcctggagggccttcagctcctcagtcgtggcactgatggtggcctgcggggagaagggagcccacggtggcaccagggagctgggcccagcagtggagggtgaggctgctgggatgaggagacatccacggcccctgacagctgtgatgtcgccctctcccgctgcgcagtgccctggggatggggcacaagccctccatcccggctccgagtcaccgagcgtcccccaaggccccgctgcctggacgccccggccccccagcaggcggcctgcgcgtgcctctgtgcagtcagtgagaagggctcccgttcagaatgggcagagaagggggctgcctcccgcgcctggcaccatggcctgtgttctgttcactgcacactgaaccatacattcaacgccagtcaggactcaatgtgggtgtcctttcctgccgagagtttcctctggtgcagggccagccgcctcgggttgtttctcctttggaaggatctctctgggacagggcctgaacaggacggggcaacacttgatgcagtgcagagaagaaagcttaaaagcccgaaaatgctccatctccctgatggtgtgggagatgcgtgtgagcgagacaccctcagctccaagggtggcacgctgctccgtggaccaggctgtggaagcaatgcctgtcaaatccacacatgtatattctctctatgcccaggcccatctgggggagggcagcccagagacacgtgtgcacctgtgtgggctgacctatgcgcagtgtcaccaatgtctgtgacattgctgtaatggcaacaaagctggaggcaacccagatgcccgtggaaggaagaacagccacaggaagacccagttctggcagctcagcatgcagcccagaaacagaagaacaaagctgcagatacacagctgggaaaggccaccgagatgctttgataagtgagaagaggaaagcccaggagccggcatagacttttcattccttttgtattaaaaatgcagtgttggggaggtaacgctgtatatttctgtttgcaagcaatctttggagggtgttgcataacagaagatgtatcaggtctttgtcctggatcctcggaggaagcttctaaaccctgggggtttctcagaagtgtggagcgtctgcattagtcctggcgggcccctgggaccacacctgagtttatgctaatgaggtgactcagggtgggttcctactgaatttcaggatggggactgtctgctgaaagacccgttattagagggttggggctttgagccacgggatgtcagcccaacctcccagcagtcagagaagtgggcttcaatcacctaaccaatcactccaccgatcacgttacacagtgaaaccccaataaaactctggacaccaaaa

SEQ ID NO: 1460 - DNA, 601 bp, Homo sapiens
agcagaacttggactgagtcctgcaggacacagttgtatgtgaactatgttgaaaacaggatgcatgactggcggccagaacaaagaagtttggtttaatttctatctatacacccagtaaaatatctgtaataccactggaaaaccttaaaatacattatctatttcttgtaaaagaatgatgaaatgtgaatttgaacagcataaatatgtacaagtatctcttctcaacggaaaaaattatgtttgtggatgaaatatgaaccgagtttgtggatgaaatatgagcagcatgaatatgcacagatatctctcctcaatggaaaaaatcacgtacaaaatataagaacccagtttgtggatgcgtgaataatgataaattgaggccgggcgcggtggctcacgcctgtaatcccagcactttgggaggctgagatgggcggatgacccgaggtccggagctcaaatccagctcgaccaatgcggtgaaaccccatctctagtaaaaatacgaaaattagccgggtgtggtggcgcatgcctgtaatcccagctactcgggaagctgaggcaggagaaatgcttgaaccctggaggtgga

SEQ ID NO: 1461 - DNA, 1817 bp, Homo sapiens
taaacctgcactttaaacctgcacttgatcctgagcacagtagagagccactgaaagattttaagcaagagagtgccatacagtgttggaatgattcactcggacagcaatgtggaagatagaccagaaagggcaagtccagaggccaacaataatcttagcctcagagttctttttttaatacccaagaatactatttcattttacttatatttttaaacttttctctataacgctctctctgctcccccacattgttgtctggatggtaaacctaggactggtctctgagtcctggtcacagcctggcaacagaatgtttgagcaaactgggaaggctgccccatggatccctggtttcttatcaccatcctcttaattctacgtttgccaaccagtctctaggaagccagcgtgctcttgcgcccctcccaccaggtttccagttgctaagcgtgtcatgtttgcatttgggtatcatctgcatgagtgaccattttaatctctctttccttgactacttgttctacactagagtctagggtgggggtgagtacagtggtaaagacagggatagcgggaaatttagtcttctgtttaggaagctggatggtagtgtggattttctaactccttgtggtaattaaattctggagcacagtttttagaccttttctgaaatctgttactgttgaagtcagcttcatatatttcactttttttttttttgagacagagtctcacactgttactcaggctggagtgcactggtacaatcttgactcactgcaacctccacagctcccaggttcaagcgattctcgtgcctcagcctcccaagtagctggtactacaggcgcgtgccaccatgcttggctaatttttgtatttctagtaaagatggggttttgccatgttgcccaggctggtctcgaactcctggcctcaggtaatctgcccgcctcagcctcccaaagtgtttggattgcaggcatgagccactgcacccaccctatttcactattaagtactctcttcctgtgatattaatgacttatttgtttcaaacttttttgtgccattgagctttttagtgatccagtgaagcctgtggaccccctctcatagtaatgttttcaaagcataaaactaaatataaaggatcgcaaaggaaactgatcatgttaaaataaagttgatattttcaaagttttatgatccagtaacatacatattctgttaacacaaaataagactgcatggtggttctaaaattactataattcaaattcatatcttgaaatatctaacaactgtaatatatctaaatgtctcatttctattggtgacaaagtcacaggtactctgatcctactgtggactgtttcctatattcgtaattgaaggaaatgttatatttcagttagaagttggtgaaaagaaagatttaaaatttttcccatccaagttcaccagacccctggtttagaggttgtcttaattttacttttgtcattttaagagtaaattattttgttttcttgttcaattctcaattatttgggcttattttactgcctcttgcatgcttttttatgcttgaatggtttttgcagtgttagaacagtaataattgaagacttgggtggaaaaaaatcagcacctgattgaaaatgaaaggtttcaacaaaagctcttgataatgttacctccaggtgtaccatcatgccaccattattggtgctacaaatctgttaatttatttatgcttaagtatgtaaactttaataaaacttggatcatctgcattaaaaaat

SEQ ID NO: 1462 - DNA, 688 bp, Homo sapiens
ctggcagttgctgagttcggaagattaactctgaatgtggagagattattttcttgctcgtaaacctggtttacatattttcattcttaatgctcagtaatcttaaggaaagtcacctgaaagaatactttttcaccaagtactcttctgcgcctgtttgaaggtgtctgtgtgcttgtgaagcgctcccttgttagttccttctgtgagactcgggggagactgaagagggaaatcacctgcggggaatgaacaggaaagcaataagaagatttggaaaagaggcactggctactggaggaagggagaaatcaccgagagagcgaaagatgtaacagatgcagtgactcatgcctataatcccagtactttggaaggtcaaggcacaaggatccattgaggccaggagtccaagaccagcctgcacaatgtagcaagactccttctctacaaaaaaataaataaaaattagccaggcatggtggtgcactcctgtagtcccagctactcaagaggctgatgtagagaatcgcattatcccagaggtcaaggctgcagtgagccgtgatcatgcctctgcactccagcctggacgatagagcaagactttatctcaaaaaacaaaaatttaaaaagatatcaggtagctcatagaattgttgagagggctgtaaaaccaggcttgaac

SEQ ID NO: 1463 - DNA, 5582 bp, Homo sapiens
ccgctccgcagcgcagcgcatggagcccggcggggaccaccggagccggagcagcggcggcaggggcggccccgggccagcagtggcctcggcacggggccgacggctgccgcccgccggatcgagcggcagcgcggagccagaggaagacgaaggcgggcaagatcttcagctggaagggggtgccttggggtcctgggggagtgcccccctgccctcctccagggccaggggaccagcatcttcaggcaggaaatattcagaccactgtgaggcccgggcctcgaggcctggaaagagccgcatccctggccgtgaccaccggcgctactaccacgaccactggcggctggagtacctgatggacttcaaccctgcccggcacggcatggtgtgcatggtgtgcggcagctccctggccaccctcaagctcagcaccatcaagcgccacatccgccaaaagcacccctactccttgcattggagtccccgggagaaggaagtcatcagcaacagctgggatgcacacctggggctgggggcctgcggagaggccgagggcctgggggtccagggggctgaggaggaggaggaggaggaagaagaggaggaggaggagggggccggtgtcccagcttgcccgcccaagggcccaggcaaagccccagctggtgggggctgccggcgccagcggcgagggggcccagtggcaccccgggctcggcgtctgcgcctctcagcctcccggagggccgggggcagcagggggctgggggcccggcgcctggagaggaggctgaaggagtccctgcagaactggttccgggccgagtgtctcatggactatgacccgcgggggaaccggctggtgtgcatggcctgtggccgggcactgcccagcctgcacctggacgacatccgtgcccacgtgctggaggtgcaccctggctccctggggctcagcggcccccagcgcagtgccctgctgcaggcctgggggggccagcccgaggcgctgtctgagctcacccagtccccaccaggcgatgacctcgccccccaggacctgaccggaaagagccgggactcggcctccgctgctggagccccctcctctcaggatctcagccccccagacgtaaaggaagaggctggctgggtccctgagaggcccgggcccgcagaggaggaggaggagctggaggagggcgagggcgagagggcgggggtcccgggccggtcgccgcggggccgcgcccaccgccgccacccccaggagcgctggcggctggagtacctcatggagttggacggcggccggcgcggcctggtgtgcggggtgtgcgggggcgcgctggcctcgctcaagatgagcaccatcgagcgccacatccgccggcgccacccgggctccacgcgcctcggcgggcctgtccaggccctcatcgcccgggagtggagcgagaaggccgcccacctgctggccctggggccgccccgccccgagtccccccagggccccatcccccccggcactgccgcagcctccgacgaggggggaggggacgaggaggaggagccagaggaggaggaggaggagtggggcgacgttccgctgtcccctggagctcccttggagcggcccgccgaagaagaggaggacgaagaggacggccaggagcctgggggactcgccttgccgccgccgcctcctcccccgcctccgcccccgccccgcagccgggagcagcggcggaactaccagccgcggtggcggggcgagtacctgatggactacgacggcagccggcgcggcctggtgtgtatggtgtgcgggggcgcgctggccacgctcaaggtgagcaccatcaagcgccacatcctgcaggtgcaccccttctccatggacttcacgcctgaggagcgccagactatcctggaggcctacgaggaggcggcgctgcgctgctacggccacgagggcttcgggccgcccgccccggcgccgcgtgacggcggcgcggacctcaagtctggcgctgtgtgtcgggcgtagcggcctagcgggcccccgggtcaggtcgggtcgggtcggatcggccccgccccgccctgtgctcgcccggcccttcggctgggagaccctcgcgtccggtgttagcgcttcccgcggccgcgccccccgctggccgggccgggcggagacgggggatcgggtggggccaccggcgtctgcgcggtgccacttgggtccctgagccagtcggtgcgctgcgggaagcgcactctcccatcggcccggagccctgccctccccgcgcagggcccacgttttccgagaatcctcagtggcctccacgtgttagcgccgagcgctcccggccgcaccccgcgagggggttctccgcaggccgggactgggggcgccgtcagtcagtattagggccgaaggggggccgtgcgggctctggctctggccctggctgggggcccagttccctgcagccttgcacgctggcaggcacggctcccggcttgggggctgctggctgcccttccctaattgggattctcggcctctcggaggccccggctgcggactggggcttccagcgggaggctgggccgcagggctcgggagccttcccggggtgggaaggcgcgttggaccgagggcggggctacgcgcccggggcccgggctggaccagctgcgcttacctccccggcaggctcagtgagaaccgtgcgcccggcggccccactctcctcccaggccgctgccacgccctccaggaaagctcttgtaaagggattagcacttttttcctttgctcctcttgccccgagggtctctgcttacccctaaaccaagtccgtgggagcccggggcacaggcggtcccggcagtcagccttcgattcccgccccatccccatccccctttgtccgcggtggatgcggcgtccgttctcaacccgcagggcctggggccgggcctcggcctcttttccccgtggcagccgcaggccctgtgtggcagggatggggccccgcgatctcccaggcaggtccgagagggatgtgtagattcattctcctgtggagaacaggtggccccgagatcaggcccttttttgctctttgtattttattttgaaactgtatttaatgcttttatatgaaagggggaggggcggggacagagctgacccagtcacccttatgtgcaaatgtcttatttattatgcgtgtatcagagataagctgtgaggtggtggagggaggacctgaaggaaggaggagcgagggcagaggcggggacgggaggaccccaactagctgtgctgatgttaatcccgctgggagactccgggccctactgtctgctcttcacaaagccaggctgctgcaggaacagttcccgcggtcctaaagccggggcggggaggctagtgggtggaacttgagggttgggtctggaggaagagatgcctgggcagcgtggtccagcccctgcctcggggtggaaaggcagagagcaaagaggaggcccctcttattccggacccccaggccagagcccaggagtgggaaagcagagggcaaagaggaggcccctcctctcatccctgacccccaggccagagcctaaggttcaagtgcctcaggcccagtccccttgacgcttcctgtttgggagttggattttataccacggattttatagcatttttatataattgaggattgtcagaattggaaagggccctggagatcactagtactaccctcctcaccttcacagataggtaaattggagcccaggaaccgagatgatcacacagccaggtagggacagtacaagaactagaatgaaaatcctagctcctgactcagtgttctttgcacgatgccacactgcttcccaattcgctggtcagttattaaaatttgtcaggcctgccgaaggattgacatgctgggcaatgcaggccaccacggtggatctgtgactcctgaaggtggcaaagccctgcacactgccttgggatgagcacactgagctctgcagggcctcagctggaaggcgccatccaatcgtccttcccctccccagcagaactccagaggtggggcggctgccgcagggcccaaggctgcctcggcagggggctttgtgctttttgttgtggaggccaccagggattcaggaagatcctgaatgggttgtcaattgactgaaaagtaaattcccagtgagtttgaacctccacggtttttgagacagtattaaaagcttgagaacggagattatggatggcaccaggctgggcactgccattcttttactttccttcatgcattttttcggatccagagtattaacaccactttttttactctgcccattcaaaaacagtaggcaaattgggggaaccaatttataatcactcaagcccactgccaaagttcggataagccagggcagaggggttagattcccccccctccgtaggcagagagaggcctcaggagagtggacatctttactgagacagccccaaacacaccagtggctctcaaagtgtgtccctgagaccagcagcatcaccttaggaatctgctagaaataaaaattcttgggccataccccagggttactgaatcagaaacttggttggggcctagcagtgttttcatgagccctccattgatcttgatgcagctgaagtgccgggcaccagtgaaagggaagggctgcggtagtgattccattgattcctgctttgatggaagttatggcctcacaggttagacgttgcaagttgagttggccctcttgcctaggtgtgcctccttgccttgggattctgacatgaacaggtgaagtctcttcatgattttttttgttgttgttgttaatggtatgcttgctattatggccaatatgtaaatgttactctgaatacatatttatataccatgttacttagtgacattattcaaacatttgtatgcgtatttgtgaaattgtttgcatcagtcatttaaaaaatatttcagcctaagttttctaagaggtatgttgaatacatttttaaaagccagcttaagggtcacagcagccttagtttaggagaagagctaatcacaggtgaccactcaagttctttcaatgaagacctgatgatgtatttagttcccattttccacggtgattgactcaatttaagtgtattgtggctatatgtaatttacaggctgctttgcgttgcaggtgggaaaatctcccaggctggtgtgaggctgaactggggtaaaagaccccctgacccctcctcattcttctaaggtcaccacctcttagagggtctcttattttctttcagagatcaaatgcacagttatgctgtacaactaaattctgcagtcttgggaatccttacgagtaccaactattagtcactttttaaagtccccaaagtggagtgaggatagggggagtggaagcagtgtttggttcttactttacccaaactgtgtataaagaataaagttagcagaatgatgccacagtca

SEQ ID NO: 1464 - DNA, 661 bp, Homo sapiens
agagatttgtatccattatattcagtagcctgcatgtgtccaaatcacaaatgaaatgatgtgggcaaatataaattaaaattgaatgttgcagaagtggttgaggaacttcaccaggatacattaatgtacaaactgaaaactgatgaaagacttctgaagagagatttgctaggaaaaataaaaagatatataaatttcagtgatgctgaaggagaggaaggatgtgatgtctttccccatccgtcataagggtcatggccaacactcctataacaaaaggttttgagaagccatctgcagctcacaactagatgagtgacacaatcagatgtgcgtatgcaaaaaaaagcctggagacattgaactaagatcaaatttaatgtattaaatatggtagaaagaagagagaatgaaaaataatgttaacaatctaggtgaggaattgctgaggagacaaattaagtaaatcctgtggaaggaaagaagaaaggaggaaagaggattggatggaagaatctccacttctcagtaatttgtttatttactttattagtttacatccatgtgattggcatctaaattattattttaaagttagatgacttttgctaatatccttgtatttaaatttttaaaaatacatctttttattcttcta

SEQ ID NO: 1465 - DNA, 4125 bp, Homo sapiens
gggtttgctgatttatagtttaagaaactgaggcagcaggattcatgctgggcattctgtgttctgggttccaatgtttaacggctataccatcaagggcacggagccagtcttggtagatgtgaatgatgcttggatctgtcaagatgctagtagtgattggtgtatgtcctcacaactcagttccccctaaaaccagcaactggagtataagtgtgaagactcatggtttgatagcaatgcttgtcaaaaagggggcaagatggcctgtaatcccagcactttgggaggccgaggtgggcagatcacgaggtcaggagatcgagaccatcctggctaacatggtgaaaccccgcctctactaaaaatacaaaaattagccgggcatggtggcgggcccctgtagtcccagctactcgggaggctgaggcaggagaatggcgtgaacccaggaggtggagcttgcagtgagccgagatcgcgccaccgcattccagcctgggcgacagagcaagactccatctctaaaataaaataaaaaacaaaaagggggcaagatgtgctccctgtgggtcaagagtgtcccagacagcttttgggaagggtgacaggtgtgttgctctatttggccctggtcagactcatctggattgttgtattcagtactcagcattgcaatttcaggtggtcatagattcactctgtagttttctgtaaagcacacaggagctctttggccaagtttcagctccaccgaagtcagcgatgagaccgtggacaaagtgcctcatgtccctgagcccatttcttcatttgtagaagaatccagtagttcaggatggttttgaagacccagtcacattggatgtgatctgtataaaagtgctttatgtggtggtcgtgttttatttgtttcatatttcagaagacgggaaggtgggtctcgcaaccatggctggtttggaggcatgtacaagaacctgggctcttcactcaggaaaagagaagtctagggaaacatggtagctgcctccagtagaactgcaatatgaaacaggtcttcagaggcttccagggcgaggggaaaccatgcagggctcctccccacctccccacttctgcttgttgctctgcgcttgtccagagacaagagatgttgactaaagtctatgcagggaagttacttacaccctcctaggtccaaaagctgcccactgcctctggagtgttagagcagaaagtgggcaggcatgggcagggccattgctgcgggaagttaagaggcaccagaggacagttcttccaacttagacggtttttgtgaagtgaaagcagactgcaggcctccagcactggcgcagactctgactggtgcaggcctctaacactggcatggatttagcagatgagaaagatgggtctccttacaaatactggtcactagtgagttgggccttgagagacagagaaaacaggtatctgcctaaggtgtgtctggttaactatattggcccttgaggtaatctacaatttaaggagttttagttcctctaacattttaagaaatcattctcatgtttgagtgccatgtttatagtaccaattttgggggccagggtgggaagattgccctgagcaaagctgtccattttcccatcatctagttggttttcatggagcggcccacctgctccccacctcaggagatactggaggactctagccctgcggtggctgtggtcaggccaagggcaggccaggcttccttcctaggcttcagttcattcccccatcttgctgccaaggtacctttagatgttttggtcccctaaagcatttaaacagactgtcgtgtaaaatgctgtctgaacaaagtctcccatgaacccacggcacagtgtgtacctgaacctcccaagagaaatagtaaaatcaccacatcatcaagttgcagctcagggactacgtagctttagtggtgatgtttgcaggaaaaggtttcagagaaatttgaaaattggcaggtgcactttcttgacctttccaaaaatagtctgagtcactttcactttcagccttcaaactgtgttgaatgaaacctttgtgcagtttacagaaagtgaagaactgtttggcaagagagagaagttcgagctcctaatagcctcggctgcattgagtaacatttcttttgagttgtctattaacactttcctgaaacatgctttttatgacgcctagaacttgtgtaagagtgactgtaatttgagttatttaaaaatgtaagtacaagaaatgtgtcacacgccataagagctaggaaatgacagctcacattcatcttggtggaaggaaactctaattattggaagatgtgattggagtatttgttcttaatacctacggtggctctgttatatgcttgcctaacaccagtattggcttgcaaataacactgaaaagctcctttcttttcctctggtctttgtgggaaggcatggtatgagtcgagattgctaaaccactcttctgagaggactcagagagagtgtttatcctagactatccatggccctggtacttctgagttcagttgtggtgtgatctcattagtccaggctcagaatggctcggtaacctcaaaactccaagccctcggtgcttgctttgcttccctagacttgcagcttatgtacgcccacatgtgcttcatgcgtattaaaaatgcttgcatgtgtagataggaagatatatgttgactgtcctgaaaaacttgacatacctaacatttaaaattgttttgagtttcccccggggataaactagtcttcaaatgtaaacgtgatgagcagcgtaggggctatggtaccagagaaaagagccgaatctcggccctggtccagccctacctctcgtgctctgtcacctgcagcagaggtggagtgggggccatgtctgtgagcgggacctcatcttgtctattcctcagacccacccaagggcagggattcccaaaactgctggtacctgtaagaggtattgtattcttggactccattccataacctctcatcaggattctgggtttggaactctagaatcaatgttgaggaaaaatagaacttggcgattttatttttctagatataattcacataccataaaagccactctttaaattgtacaattcagtggttttttagtatattcagagttgtacagccatgaccactagctaattcagaatattttcattgcctcccaacaagcctagtactcatgagtagtcactcccttgcccattccctccacccccaagcccctggcaaccactaatctactttctgtctctatggatttgcctatttgagacattcatatgaatggaattatataatatgtagacttttgtatctgtttttttttcatttagcataaaaattttcaagatttgtccacagtgtagtgtgtctcagtacttctttcctttttatcactgaaaatacttcattgtatgtatatgtcatattttgttatctactcatcaattgatgaatacttgtattgtttccactttggctgttacaaataatgctgttatgaacatgtgtgtacaagtatttgtgtgggtacatgttatttctcttgggcatacctacagatggaattactggatcatatgacaactttatgtttaactttttgaaaaactacaaaaccaacaagctgtaccattttgtaatcccaccagcaatgaatagggttctaatttttccacatcttcatcaatatttgttattgatctttttgattatagccaatctagtgagtgtgaactggtatcttattgtaattgtgattttgatttgcaattccctaatgatgttgaacagatgttcatataattgttggccatttatatagtctttagagatatatctgttttgcccatttctaactgagcaaaacagacaaaaattgagttgtgaatgttctttatgtatactgtatacaagccccttaacagatatatgatttgcaaatcttttctgttctgtaggttgtttctccatgttcttgttggtatgcttggaagcataaaagtttttattctggtggagtcca

SEQ ID NO: 1466 - DNA, 134 bp, Homo sapiens
aaaaagggcttctgtcgtgagtggcacacgtagggcaactcgattgctctgcgtgcggaatcgacatcaagagatttcggaagcataattttttggtatttgggcagctggtgatcgttggtcccggcgccctt

SEQ ID NO: 1467 - DNA, 4200 bp, Homo sapiens
atggacctcccccgtccccgccatccctgccgatcctgttgctgccgccttcccgccgtgctcgggctgcccgggactctagccgccaggcttcgcgtcgcccagcggcagatcgggctcctgggagcctctcccctggccgtttgctcggcctcggccccagctgccctggggcctagccactagctcccctggcgctagcctaccctgtcttgaccgcaccctgaagatttgggaagtctttctccatcccaagagtcgtctctgcaaaagttggtgtccttcctggtgctgaaccacgcttctgctcaaaatgtgttgagcgtcgtctgtctgcaaagcacggtgccaggagctttggtggagaaggcatggggtacatgtgtaaagagtacaggcttttggttaaacctgaagtcctcctctactttctgggggaccctggccgtccttgctgagcctccgttgacttctctaatggggacggtaatgcctacctgaccacaagctgatgagtaaatgagctatgagtgcaaagtgtggtgcagttctggcgtgtgccagcctctcaagtgtcagtttccgtctcattcctcttaatcttcactaaaatggacaagtattcattgagcacctaatgcgtgttcagtatggtgggagatgagggatgacagtattatttttctattttataggttagacatagaacaaaaggttgagtctattgcccatagccgaacttttcttcattttctactgtggtttagaagtcggtatagtaagttaagggttgttagatgtgcattttcacagctcccagcttccacttaggagtagataacataggggactttgcgagctggtctctttccctcttagcttcagaagggcttcgaggtagccaccactgaattagttgagagacaaggcacccctacggaggaaatctcaactgcacaacccctactgtgccccaattcagcaggaagcagttagagcggtggtcaaacctccccaatagcacttgggttttcctgttgagagggggtactgagagacaggactagttggatttcctaggctggctaagaatccctaagcctagctgggaaattgaccacgtccacctttaaacacggggcttgcaatttagctcacacccgaccaatcaggtagtaaagagagctcactaaaatgctaattagggaaaaacaggaggtaaagaagtagccaatcatctatcgcctgagagcacaacaggagggacaatgatcaggatataaacccaggcattcaagccagcggtggctaccctctttgggtcccctccctttgtatggaagctctgttttcactctattaaatcttgcaattgcacacttttctggtacgtgtgtgtcacagctcaagctgagctttcgctcaccgtccaccactgctgtctgccgctgtcacagacccacagctgacttccatccctctggatccagcgaggcgcccattgctgctcctgatcgggctaaaggcttgcccttgttcctgcagggctaagtgcccaggttcgtcctaatctagctaaacactagtcactgggttccacgattctcttccatgacccacagcttctaatagagctataacactcgccgcttggcccaagattccattccttggaatccatgaggccaagaaccccaggtcagagaacacaagacttgccaccatctcggaagtggcccgtcaccatcttggaagcgacctgccaccatcttgggaacttggggagcaaggacccccagtaacatagtgaccaggaggaaattcttcctctcaacagctaatgcagcaggatctcttacaccgtaccctccctcaccttgctcttgctcttcatggtagaacacgtaccatatcttagctgtactctatcaactgcgcatctgaagtaaagagtgaagtcttctttgtttccagtcatggagcaacaacttgctatgatactggccttctgtagctgactcttctttgtctacccaggcactctaatggaactttaattctagctaaagttattttctcagactcctttgaagcaaggggcagccatttgacacacttcaagccaatgagttgaatgttgaacttattgctgaggcttctaagaaagcatatagatggaagggctctgcgaatcagagctcatctttgccctacacctgtcttccaggaggaacgtgaagagctacagcactcatagttcagtcatgaaacaacaaacaggagaacaatggcctgcattccaaggatggcagagcagaaaactgtaaagaggctgggcatttgatggcattgtggtgccaccagacaagccctaagctatcttccctaagacttcttgttttgggtcaaattcctgtttaagccaggaagttttcacaaccttcaccacccagtcctgcagctgttgtctcatgcttgtgactcagacttccaggaatcctttagaagtgatgtggtgatctcgtttggcactatgcaatgtacactattaatgaaggtaccctaataattataaatattaagacagaatgtgcatttcacagtgatttaaacactctttaacactctttaaaacagtccatcaaaggttcgctaacacagagaaaaacatttaaaattgtaataaaggctgggcgcagtggcttgcctctaatcccagcacttcaggaggccgaggcaggcagattgcttgagctcaggactttaagaccagactgggcaacacggagaaaccccgtctctacaaaaaaattcaaaaataagccgggcgtggtggtgcacgcctgtgttcccagctactctgaaggctgaggtgggaggattgcttgaacccagaaggtagaggttgcagtgagctgagaccataccatgcactccagcctgggtgatagagtgagactctgtctcaagaaagaataaaaagtaaaaataaaattgtaatgaacattcaagaaattgaaatatacgggtacaaagatgatatagtatcagaaaaaatgattttttttaaattttacagccacttgaattaagtacctaaaaatgcttttgatgctgttgagcttggctatgataacaacagtatgtaaatattccacttttgttaaaatatgtataaacaggtatgtgtacagagcagtgtatgaaagggtggtccccagaatattgatagtgtttgacgtggaatttgggctaggaaaaataattaccaatgaggagatacaagatagcagcagttagggagaggccgtccatgcagctgcctatttaaatcactgtccatgttaacagataagaactggaaatgtcaaagaacaattgcccagctcagttaccatctgctactaaagatagccccagctgggtgcgatggctcacacctgtaatcccaacactttgggaggctgaggcaggtggatcacctgaggtcaggaattcaagaccagcctggccaacatggtgaaaccccatctctactaaaaatacaaaaaattagctaggtgtggtggtgcatgcctgtaatcccagccactagggaggctaaggcaggagaattgcttgaactctggcagcagaggttgcagtgagctgagattgtgccactgcactccagcctggtcgacagagtgagactcagtctcaaaaaaaaaaagcccgtaatgagaactctcaagagtaccatggtaatataatatggtaatagataataaaagagtcatgatcattaataataaatataatacttctacttcaactgaggaatggaaaactaaacatcatatgttctcatatgtccctaagctatgaggatgcaaaggcataagaatgatacaatggactttggggactttcagggaaagggtgagaagggcgtaagggataaaagactacaaattgggttcagtatatactgctcgggtgatgggtgcaccaaaatcttaaaaatcgccaaagaacttatgtaactaaataccacctgttccccaaaaaactatggaaattaaaaattaaaaaataagtataatttctgctttagcgatattaactattcagtacacaataagtgagtttagcaattcagtgatttctgactgttgggtagctctctttgttaacaaataaaatataaatttgaagaaa

SEQ ID NO: 1468 - DNA, 6411 bp, Homo sapiens
aaacagcgattcttctgcagtgaatcacttccagaaatgaatagccacagttttttggaatgaacgttgtgaaatccctcctttataatggcaggttttcagttggtggttttatcagaatttctcaagatcaaaacgaaaccttctctttaaaaaggaaagaaagtactatcgatacagaaagcaaaagtatttccagtctcctactgaactgtcacggcagacctctctgtatctatatttagagctgtatgtccatatatttgcctgaatgtgtgagttcttggaagtatggattcattgccaggagctggtgatttcctaagcagaggtcgctaactacaagaaatgttacactcggacaagtcctgcgcttggggatcctctgtacgcccgttcactggtgcaggtcttctgaacaaatgcctcctgaggatttctgtgcctggaaaatatctgttaacagactgcttttacacctacctatttggtgctacttctactcctcatgaccaaagctggctttcatggtttactcatgtacttactgatgaaaccctgagacttggggccagtgactgttcagaggtccatgtgaagatgcgctgaatggtataaaggacagagcagtaaagagtgctggctgaatgcctgggctggcaatcaggcatgttggagtttgagtcccagtctgccactccagctctgtgaccaagaggaagtgaagtcatgtaccctttctaagtctctagcccctcttctgaaagacgaagatgccaccaccaaccatgttagtggttgtgaatgccaagaaagtccatgtgaagcacatagcatagtgtctgccatgcgttaagtgttccaaaaatggaagctatgactatttcacagagtacacttcccatcacttttcagttcattttggccttctccctcaaaagcactccagtgttctgatccagctgataaaacaccaaacattcacatagtgctttaaaagtgacccactgtttttacagactgcattacatatgaccctaacaaccactgcaatatagaaattcgcatctccattctccagatcaggataccgaagctcagaaaaattaaatgatttgcccaggatcacatagttagtaagcagcccagccagatcctgtgttaacttgttcatccgcttcctataagaaaacatccattcaaggcacatggggcaacaaagaaggacttagagctgtgtggcccctcgtcagggcagtaccagttgcacccatagtccggcctgaatactcagcttaggactattgtgtccaatgtcccaaacattttgaagctacatcttaaagaagtgtcctgctcagatgcagttctccttgtgaaatccgcaggccccaaggaaagtgactttaatccagtttgctcatgcaagaacagactggcatttcacatccaggaaaacaatggatttgtactgttcagcttttgccatgcaaggagttcctggtgtggtttattaatttacatctcaggctccagcttcactatcaatcagatttggaagaaaaaagttacaaagaaaggcagcttgctgagaaacagcggaagcatgacggtacagactgggttttgaaatggagacacattctcatggcttgtgggctgagagacactgagaaaggattttgttcttgaaagatgattgttttaatgctggagatggagagttttgacaattttaagtgcatgttctgtgtgtaagaaagagtcattacgttttttttttctttcagatgttgccatgccttaaaattgctgatgattaaaatagaacatcctgagttacagaaattcagccctagtgtatcctggcctaaaaatacagaacaatcaagttgattgttggaaatgagaggctaggcagggttggaaacatgctaatgtttactgagtgaaatctttccttctcagtagagttgcccttgcagctgaaagtcactgaaagactcaacaaaataagcagatcccacttgtctcactctgttctcctatgcatgccctggaaagagaatgaatgagccctttttaatttatcaactggttttcttccatctctttactagtgagccatgggggttttttgccgttaactgggtagccagtctcttcatggagacttattttcaggaaactagcctcttgctttatgtgaaaacaaggacccaactcaagatgtcttatcacagtgtgttctgttgcgtaacagttgcatctgtagtccagcctcaatactcaggttgggactgttttgtcctgatgtctcgaacatttcaaagctacgttcttaaagaaatgtcctgctcagatagagctctccttgtgaaatcctcaaaccccaggggaagtgaccttaagccagtttgctggcttttcatgtcacagaaaacaatcgactgccactactcagctgttgccacacaggagtacctggcgtggtcactacttgccaactcagtaccccactttctccccaaggacataaaagcaatgtgggaagatataccaaatgaccttgtcacactgggctaatatgaagagcccacagatgcaaaataatgtatcatacctttattcttctgattttttttttttttttttttttcggagacagtctcactcttttgcccaggctggaatccagtggcgcgatcttggctcactgcaacctctgccacccgggttcaggcaattctcctgcctcagcctcccgcccagctaatttttgtattattaattagtagagagagggtttcaccttcttggccaggctagtcttgaactcctgacctcgtgatacacctgccttggcctcccaaagtgctgggattacaggcgtgagccaccgtgcctggccttttttttttttttttttttttttttttgagatggagtctggctgtattgcccaggctggagtgcagtggcatgatcttggctcactgcaacctctgcctcccaggttcaagtgattctcctgcctcagcctcctgagtagctgggattgcaggcatcccatacccggctaatttttttgaaacagaggcttgctctgtcacccaggctggagtgcaatggcacgatctcagctcagtgcaacctccgcctactgggctcaagcaactctcctgcctcggcctcagcctcactacaggcatgtgccaccacgcctggctagtttggttttttttttttgtatttttttagtagatatggggtttcaccatgttggccaggttggtctcaaacttctgacctcaagtgatctgcctgcctcagcctcccaaaatgctgggattacaggtatgagccaccacgcttagccttctgctgaatttttgagaagcatacataaagacaatgtaaaaaacttagcatatttgtttggccctgctaagggcatggttgaatatatagtgtgtgtgatgtatttggtgtatgagatatatatgatcttatcagacataagtaaaagaaattcattcttcaggaaaaattttccccataactgaagtgtcaatcatttgaaaaaacttctaggcagtaggcaaacactgtgactagttatttatcaaaaataagcagactttagagttttgtaactgatgagaataatctggctgcttcttttgtacttcagtcactgatactgcgaattagagtagcatatacagaaggatgcagggggtccctaaaggaatcacagaattagtgaaaccattatttgagagttgcagtgattcttctgtcctggcacttttcccagttttggtgcttaaatttactatccacttgaaatgtgtcactgcctgtcacttcacaaagtatgtgcctttcactgcagtcaacaagctgtttacatctttgatgaaatgattgccacgcatctccatagccctggtgttctattcccttattcacagagattttttttaaaaaccagcctagcagcaataggtatgtgctgtggatgcttctccatgatgataaaggatgagtttgtgctgggatctccttatgaaaagataactggccaagcccatgaggaacaagaatgttatgctaatcagacccaaggtaaacagcctgcagtgcacctcctgactgattagcactgaacccacttggaatcatcaaccacaggcacgtggtaattggatgttcttctaatacacatagtgagattgtaaaatgaggatgatatatgaggaaagtcagacggagaaactaaagttcagttcttaaatacaagccaagggaacagactaagtgaatggtacagccaggattggagcctggttttcacaaggtggtatgtcatgataaaacaagccaaagaaaaggttgggtagtgttttgaggctaaaagagaccaaagagtcttagtgaatcaaccttgatgcgatctgggtttgaaaaacctataaaaaaccttttgtttggagaaagtgggagaagttggatgtaggctggatatttgtgggtaccaaggaattgtttgttttcttaggtatggtaagattttgtggttatgtagaagagtgtcttcattttatagaacgacctcaaagtagttaggagcagtgtatgtatgggtggttatcaatttactttcaaacaatgcagcaaaaaatatgtatctatattacatataattaaagcaaaacatgataaaaaggaatagttattgaatttagatagtatggatttaggaattcattgtattgtcattccaatttaatgtataaaattttttataacagtttataaaaacagtgcacacccctttaattaggtggcctgggtacatgaagtatctttttggatgcctagaacacaaaaagggacgacaacaggccacctaataagatgataccaagaactataccatgacggcgaaaaagaactgctgcaaaaaataatttgccaaggagaactcagagtacaaagccttacctttggagtagagggaaggagagtcttaagtaaagctcacaaaaacccctaactcatagatgcagtctaaggaattcattccggaagcgacattagcatctcattagtgccattatgtgacttacttggcctctgagctagtctattttcttccctagaccccaaaatctcagtaatcctttggatccaagttatctccaagtgaaaataataggtttaggaaagcgtttttcttcaacttctatggagcacttgcttgctttgtcctatttgcatgtccgacggacggttctccagcaccactgctagtcgtcctccgcctgcctgggtacttgatcacaggatgcctctgacttctcctgcctttacccaagcaaaggattttccttgtcttcccacccaagagtgacggggctgacatgtgcccttgcctctaaatgatgaagctgaacctttgtctgggcaacttaacttaagaataagggagtcccaggcatgctctcccatcaataacaaattcagtgacatcagtttatgaatatatgaaatttgccaaagctctgtttagaccactgagtaactcacagctaggtttcaacttttcctttctaggttgtcttgggtttattgtaagagagcattatgaagaaaaaaatagatcataaagcttcttcaggaagctggtttcatatggtggtttagatttaaatagtgattgtctagcaccatttgaaatcagtgttcttgggggagaccagctgcgctgcactaccaacagcaaaagaagtgaatgggacagctctgaagtatttgaaagcaacagcaggatggctgtgagaacctgcctcacatgtagctgaccccttcctcacccctgccaacagtggtggcatatatcacaaatggcagtcaggtctctgcactggcggatccaactgtgatcgaaagttttccaaaaataagttgtgtctgtattgaacatgaacagactttcttcttgtcattattctctaacaatactgcataacaattatttgcatacatttgcattgcattaagtattctaagtaatctagagacgatttaaagtatacgggaggatgtgtgtaggttgtatgcaaatactacaccattttctatcagagacttgagcatctgtggattttggtatccaaggggctttctggaaccaatccctcaaggataccaagggatgaatgtaattgtacaggatatcgcattgttggaattttatacttctttgtggaataaacctatagcacttaatagatagtacagactcattccattgtgcctgggttaaagagcccaatgtatgctggatttagtaagatttgggccctcccaaccctcacgaccttctgtgaccccttagaggat

SEQ ID NO: 1469 - DNA, 5296 bp, Homo sapiens
ggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaagtgagtttattcccaccctagaccaccatctgaggccccctggcgtctggtttgaggtttaagtggggatgttcctgttcctggccacaccccaaggccagtaattcggtcgatactgtccccttgtggcagctgcttgaattacaggcccagatcctgggagccagaaccacctctgcacggtgttgtgaccttactaaaataagccaggaagggagaagagaggtcccctcctgcctcgacacctccgtggggtcttactctctccctcccaactatctgcagtcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacaggtgcccagatggggctatgctggggggcctgcgggtggcagggctggagtgaagagcatctgtggctcagacccaggcagggagtttgactcctgacttcacaagctgcctgctctcctggaatctccgtttcctggtctgggaaataagtgatgggatgatgtctgccactcagggctgtgccaaccatggggtgctgtgtctgtagggaccttggttgtgagggtggctaggatggacagcgtaggggccttggcaggcacagggacaaaccccccattcccttccctcacccctagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagccagaccccaggtgcctgctctcgtctttctctgggtggcctctgatcttgcaccccgtcttcaccccagggctcctgaagactgtgggtcattcctcagggctctgggtgagtctctgcccttctgggctgggcgactgagatgggggactgctcttctccgagtgagctggctgagtgtgaccgtgagtcacgcccctgcttccctggagcctgtcccttgcctcacaggcctggctgaggtgggggtgggcactgccctttgtaccccagaattcccactgtcagggcctccctgctcgctgcctccccgggtcctggatatggaggccacggctgccagctggcaggtggctgtccccgtcttggggggggccagcagacccttggtgagtgcctggggtggctcccgggcctcctcctgccccctccccactggcgggtggggtgggaagggggcgggtgcagccggctgagagcttgatgatttcctgccctcgcccggcgctcaccacagcttcctgccgcaggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagataggtgagtccgccccagccgccctgggtctccctccacaccccatggcggggcagggctggggcttccatcctccatcttccagccccatccccaagctgtgtctcctttaccagtttgtatccaaggggcatccagttcaaacggcctcgtgagtacaaggagggtcccctaccttgggtgccagggagagggtcccctggtgtgggagtgagcgtgaaccttcagacttcccctgccaccttggggctgcccacatggccttgacctgagctgggagaggggagatggctcccccaggcctgtccagggtgtggggctttcaggggcttagtctgttctttgaggccttgacgatgtccggagtccttctttcaacttggttctgtgtcctcagacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgagggtgcgtctgggatccgaggtgcccaggctgggtggggagtctggggtccgtcctggactaggctgacccctgtgtcgttacccccagaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaactt

SEQ ID NO: 1470 - DNA, 587 bp, Homo sapiens
accagccctttggtaggtgcgctttgcttcctaacccgttgccgggttggagattccacctccgaagttttctttctgacttttgattttacattcctagtacagtggagaagcccaggcggcctagaatccagtgtcgtccgtgagtgcttggctggtgttcaagtgcatcttccagcctgagaccgcgtggactcgctcatcgtgagggcgagaggaggataagcccattgggctgtcggctgagagtgaggtgcgggattgctgatgaaatccttggcatcgtcggagatctcatcgaatgcctcgtcgtcgaagtcccaggtggctgaggtaacgttggccaaggtttcgttatcgttgtctcccatgaagggggaaaggccactgactctggagagacaagagcaggacagcaggtgtggctaggagagggcgcgacgaccagatgagggaattgaggcacagcccaggctcaagtcacctgcccaaagattcacagccagtgagattggaagccagcttgccaactcccaattccaagctaagtatggtattctgcccactggtgctgctgcctagccttc

SEQ ID NO: 1471 - DNA, 497 bp, Homo sapiens
cttctatatagtagacactcaaaatgcttattaaactgcatttacattcagcagagataaacagagtggaaagctgccatagcattacctgtggaaatgaatgaaagcctgtgattcggatcctaatgggagaaaagtgccatggcagaaggagattctgttgagaagataaatgccctctgactatgtcttcttcaatcctcaaaaatattgccattatgtttgagagcagttgataaagcatagtgtgctgggaagagtgctggagaaggagtcagttgaccttcacgactgtccaattctgcaatgagcaagctgtgtcactttgggcaaatcatgggttctctgtttctctgtttcatctataaagtgaggcaatgaaatattatgatcttaaattatttctttacagttatatgacattaatcaattcctgacttccttcttccattggtcataaatatgtgtatgtatgtataatatattcatagataatg

SEQ ID NO: 1472 - DNA, 366 bp, Homo sapiens
ccagcagaggtgggctggacactgctcctggcaaagctggccgggaagatgcagcccgtgggacactccccaccaccactctcacagtctgactgactgcgaagcttcacagaccagaaggttcattcctcacaagaaaaggaaaaccctggtctgatactactgttctgaaatttaacagccagttgggtccagcagctttgcctctctacccttttatcaccaaagtatactgctgagaaagaatcaaatgaaaagaaaaaagactcaacaagacctcactcatattaactggactctacaagcagtgagcatccagacctgcatttggttacaaaagaagccttcaagctattttcatcagct

SEQ ID NO: 1473 - DNA, 476 bp, Homo sapiens
aagatggcggcgtttgcacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaagaaatacaaaaaaaattctaaaacttgtatggaactacaaaagacattaaataatcaaagtaatcttgagcaacaaggacacagctggaggcatcactctacctgattttgtaatccattatcaaaaaactgtggtaccagcataaaaacagattcactgaccagtggaacaggaaagcccagacataactcatacatttccatccaattgatttttgacaaaagtggcacacagaatggggagaggacaaataaataaataaattgttttgagatatctgta

SEQ ID NO: 1474 - DNA, 539 bp, Homo sapiens
ttaacagctcgcacagcattcctgttgatgtgttgttgctgagagcactttccagtaatctttctgcacacaaatcaccagctcaatctgtttcctggggaacttgaactacaacagaatgatactggggagtttgcaaaatcaaactaaacataggcagcaggaaggacacaaagcaggggagccccagaaatcttagtggtagaaacttttaaacctcttagggtaccaccagggtatctctgctcaatatttaaatccctggaagggagcctctgattggccttgtttgggttgggaatcagggccctgtgattagaactacctggggtagtggagaggaaagagaagcaacctgtgtcttccagaccatggtatctgaagttttcttggaggaagtcaaataaatatgtgggttgaggatgggagctctaagcagaggatgtggtggctcatttaagatcacacattgacaaagagcagagtggtgtcaagattctgggacagaggcaagttagaaataaaactcttgtttttcc

SEQ ID NO: 1475 - DNA, 362 bp, Homo sapiens
ctaggcccacagtaggccccgggcacattttcagctgcgaagcggaggactagcaaccggtgaggtagaaggagaaccaagagatggtgggagaatgggaactgagctgagagagcttccggaaggttgcggtggcctagggcgatccacgtcattgagaaacggcgttaggctgatttcacggggcagatgacatggaagtgctgctgaggaagacgctgagctccgaggtgaaaagggatgaggacgcctaagaagacacgagcgcaatacctaatacaatttcctgaaattgtttcatgtcacacgttaaaataatatgaaacacgttaaataataaaatggtatgaaggttttgtctg

SEQ ID NO: 1476 - DNA, 2592 bp, Homo sapiens
gaggtagccttggcgactttcgagactacccaggccgagcacacccagccccctcagacccaggcatttctgcgtcctctggtttggagggaacccagggggctgaggtgaagcaagccaggactgtttctctgactcttctggaagacgacccgctgctcgggccgcctcatcactgcgggccacgagtgcccttcttcattccagacatggtgctttgaacaatttgacttggaggcaagattgcgatatagaaaatgggccactgtggaggagataagtaaatgctttgtcgcttctaagtgacaggggaaactgatcacgattggtatacttctgacatgtaactttctatatctttagaagatcgtcagggaaatagaaaaaaaaatctgaaatctccaagtaggttctactttgtgtggttccaactaaatgaactaaatttgtgtttaaagattgtaagtctacatgtaatggtgaaagctgaaggttttacactgcacagaaatagtgatttccccccgtggagggcaagaagaccggaataggaggggtgggtgggggaatcaatgtgtaggccaaatatttgaaatttcagtgcaatcttcttagtcatcactttcatttctgtcttctagggaaatctgacacagctagaaagcaatggaaaacactaagagttgcatcagatgttgaagaggaactgatattatgggataaaaaatgattctttaagggagataactggtcatttaaaggtagcagcctttttgggaaaagctaacaagtgttcccgaggccagcctgtctcttgttagcaacattggccctgtgttagaaggaagagtggatgtgttttgatgctattccttttcctctcagcataaatttgcaagcatgtactgtaaatgaattttcatgtcttttcaggatgtttccctatagagcagtttctagattgactctgtggaacagtctacaatagatttaatatggttaggattttgcctaattctgattgtaggtctgggtgaggcctgagagtctgcattttcaataagcatctagatagtgcctgctgtttatggactacactttgaataacaaggacttagaagatgaagaacaaagagcttcatatagatcagcaacactctttggtgttcttcctcctgtgttcaagtcagtgattacatatcctttttggacctcagtttccagtcctgccaaataagggactaaggctggatcatgtttcaagctgtcctgaagagacctctaactctgcagagaagcctcaggaccccaccccctcaccccaagaaaagtgtgaggctagtgtgaggaggaagaggagcagagaagccaatggagaaggaactattctttagaaaggtttcaacggtgacctgccaacagctcccaaatctacaggtttcacccaatttttgactcatgacctgttgacaacctccgcctggatatgtcatgggtttcctcaaaacccaacatttacaaaactgaacatcctcaaaacatcttccctttctcaccattcctctcagttaacagcatctccatatactccatcacttgggtggaacatatcagagtccacttagctttcttcacaagcctttaatggaggaaatatttattgagtatctaccatgtgccacccactgtgccaaccactgtccatatgatggtgaataaccaagacaagggcttgctctcatggagcttgcagtcttgtggagaaaaagataatagaaagtaaagacatactttactttcaggtagtgagtagtgctgaaaataaagcagtgggagagagagtgatagtggaagctactttagaaaatgtagccagagagggcctctcagagagaccacttgaatgatgagaagggccgtgaaaagaagggggatgataaaggaaactgcaagtacctgagccctgagacagttaaaaaaaacatctgagagaccagtgtctggagtttgggctgagcagagatgaacttggccaaaccacgctggacttgtacaatgtggtaaaaatgatggatttaactgcactttatcttaatatatctcttttatcaacaccttcctttccacgctcccagccgcattgtttatcaagaacctgttacatttcacttgactatttaccttctcaacttttccaactcctcttcctcaggcacctttgctggctcttctctttctctctttacccgctatctctcagcaggcctcagacttctctcctgtctctcccaagagtgctaccctagaccagcctgcctcagattctgtttcggcctagaagggccaaacatctggtttgtcatcttccttgggttttagcacattatcacacacacattaggtcttagcacattattagaactcgcaaatcccttatttgatagaagaactgatttcctttttaaccctaattcctctcccctacccccatttgaatgtgtatcttttcatttggatgtgttcttgtggaatgtccattttatttgtatgcacttattttaaattctgtaaatgatattatagtatcccttc

SEQ ID NO: 1477 - DNA, 3473 bp, Homo sapiens
gccaaacatccctggactagaagttgcaggggaaatcaaacagcccagaaagtttattctccttgctggtatttcttccacttgctattttgctgagagatgcatgcaaactacccttagactttcagatgcagtgcgttttacttagccgtgcctgacaaacacacagaacttttaccgtctggtagatccgccttgactttaccagcgaatactaaagtcacttaaaaaaaaatcacaaggctcgaaaacagcagcattagaagtagactttatggtactctgctcagctatgttctcatttgattccaaccactacacggcagaaaagactgatgagcttctctgtgcaagggtgcctttttggagcaatgtccccattcggtccattgatatgaaccacttcattgaatgtcttagacggaaagaagactgaataatgattggaagaacgccggagtcatcaagctcttttgataactgcatatgtgaactaggtcaagtcactctccctcaacggatcaccagtttacccaactgtaaatggcaacaattttgaactgaacgttcttccttctacagccaaaattcttcgtttgctaggtttgtgaagtgcttttatatgtatgagcgctttcttaactatgaagatatctgagtcatcgaacttttggtgggggcaatctcatgatcagtcatgactagattttagagttttctcatccccatactcaaagttttttttttaagaataaaaatgaaaagaaacaataccccacaatatttctgagcctcaaaggacagactaaaaaagctaacttttaaaatacttcattttgaaataattttgaacttacaaaaaaatcgcaaaaataatacctggagtccctgtatacccttcacccagattcccctactgttaaatacttacataaccataacacaattaccaaaaccaggaaattaacactggtacgagactcttaacaagagatcttatttgaatgtcaccaattttcttcctaatgttcttctgttctaggatccaatccaggttcccacatggcatttattcctcacttctccttagtctcctccaatctgtgacactttctaagtctttccttgtctttcatgaccatgacactttggatgagtactggtcatttattctgtaaaatgcctctcactttgtgtttgttgaatgttttctcatgattagaccgagaccatgtctttttggcaggaacatcacagaaatggtgtgtatcctatctgagggtatgtgatattgatatatcttatcactcattatgttaaccttaaacacctggttaaagtggcatctgctgggtttctccactgtaaagtgactattttccctttatttatttattttagaaacagggtcttgctgtgttgcccaggctggagtgcagtggcacaatcactgctcactgcagcctcaatctcccaggctcaagcgatcctctgcctcctgagtagctgggactacaggcatgcaccattatgcccagttaatttttttaaaaatgttttgtatagacagggtctcgctatattgcccaggctggtctcaaactcctggcctcaaaagatcctcccacctcggcctcccaaagtgctgggattaaaggcatgagccagccaccatgcctggtctattttttattgataaatgaaatagaccatgcctgttctatttttaattgataaatatcctgggagaaatactttgggacaatgcaaatatcctgtttctcctccaacttttacccactgatttcagcatatatcagtggatcttgcctgcaaccattattaccatggcatttgcctactagtgattttgtgtttccttcatttgttctccatttattaattggaattcttctgtaaggaggagttgtcccttctccccaacttatccatttattcaattttttttgtaaactatggactcatgggcatctattttattctatgagctataattcaatactgtcatcatttagtttcttgctcaagttattctaacttcagccattgggagctccttcagactggctactatgctgtcttgtcatgcccccaccctttctctagcactttcttacattcttacaccaaaagacattacagcctcatcttgtattttccctgcttctgtccagaattagccattattccaaagatcccgagttcctttattggagaatgatattagacacaaagatgtgggtactaagtatactcgttgctgttggggtgttaattgcttctagggcttcccaagacagagctaggaaatgaaagcatacataataacccatgcatacacacagatcaatatctattcctgtatctatctgtatacatactcatgtgtcctttctaatccacaccacggtattcatcctaaccttccctttttatttttaacttttttcctctgatagtgagaaaataggctctcattatctactctatatacatttatttgttcaacctcagtatctacatacttacatatgcctgtgaggaacagatttactaactagaatcctgtatttgtgtgcaattctttttatctttattataaatatagcacctccaggcttctttttattagtgtcagcatgacatagcttttcccatctttttactgttaatattttaaactcaaaaaaagcaaggaggaaaacagtatgctactatctgtgtgaaaatggaaaataagtatggatatatttgctcatatgtatatatataatatctatgggagagggaaaaccaaaatatcagtttggaggtcaactgattaactggggaaaagagatgaggggaaaacttcgctgcatactctactatcgttgaaatttcttaaactttttcattgagtataattcacaaatcataaaactcacccttttaaagtctacacatcagtagtttttaacacatttatatacaaagttgtgtaactatcatcactaattccaggacattttcatcacccttaaaaaaaaagccatgtacccattagtagttaattcccatacccctcacccctcactcacccatctactgcccttcacaagaccctggcaaccactaatctgctttctgtctctatggatttgccaactcttgatgtttcatataaatggaatcacacaatatgtgaccttttatgtctggcttctttcacttaacatcatgtttttaaggttcatccatgttgtagcatggatcagtactttgttcctttttgtagctgagtaatattacattgtatgtatataccatattttgttgatgtactcattagttgactgtttttctaaatttttgaattatgaaaatatccattcaaaaattaaactttaaaaaatagaaacaaaatgaaaaagcccttctcataaaaaacagaaaaatgtaaaaaaaaaaaa

SEQ ID NO: 1478 - DNA, 3994 bp, Homo sapiens
ttagcaatctggagaggactgaggcaagagcttgtattgaaacacaagcaagctccacgtatggttttggacatggaagaaagagtactgttggggtggaatgacctaagtttttaataggattaggatttctgtggatttttcccaagtgatagaagttttcttcatctagcagggagcctcacccaattgcttctctatgttcatttctgaaactcctttgttaaaactaaatagcaacagagaagaaactttcttcaaaaaactcttcatatctgtcatttctcctattcttatggaacttcacaattgctttttctttattcctttttttttttctatatcagctcatcagtctttgtgggtgacttggctaccccactaatctaattgcctttttgatagttaaatcaatatggacatcaacttaaggctatatgtgaaccttaaatgcatgatattccctatacttgattccacaattgatattctgtgaggaaagttggccagatattcccttctgtgaagtcagaataactaccgaccctaagaataaacattttgaccaattctttatatgttgcaaactattcacacaactagaaagtttagccattcacatctcttcccctgattttaagtcccagattctgagactcagaaagtttagtgacttgttgagctttctgtggaaaatctgttgtaaaaacagttcagacattggaaaatataaaatagcccctagagatcccaataaagcttcctctccccaaatccctctacaagtttatcctcgaaaaactttctgaaaactgatgagaaaatactgagtaattaatgctcaaatgggaaagatgacatgtaaaagcaaaaacctgttaatggcatctgttcatatagttccatgtgcctttttacttaactgcactgataggcaatgtaatgaagaagtttccttttaaaacgtaaaatgtaattaaacagagtttatcttaaattggctggacccgcacagcttgactgagacatacacagctgtcttcattttgaagcacctacactagtcaagcttctttctaacccgcccttagggtttgcctgttggtctgtcttccctactgggctgttaatcccttggaggcagattgtcttgtttcccagagtttttccagcatataccatggcagacaattttcaccttatctattctaactcgtaagcctcagctagtgcctccatcctcgggtgcatagcccagtgacaggcatgtaacagactttgcctacaagcagttgctgatccataaatgacgttggcaaccttcttgtggcagtgagtaacatatttctttcctcctgataggcttggaatcctcatccccatctggcaattttctttccatctttcctacactcacaatggagcccacacgcctcacaacccccttgactaaaccagatgacagcaagaatgcctagttccaagtgagcaagggtgaagccttaggcccttgtctcctccagacctcctctctgctctaagagtatactgggcatggggtgtggtcggggggttgggggcggaggagtacttaacctcaaactgagaaaaagggtgtcctgagcaagtttcatagcgtagcagcttccatttgaaatgtgaagctttgaaggcctgttgctacagtaaccagctagctcctgactccaatgcctgtctaatctaaggtggaaatgtcccagaaacagaccccaggctggcagctcttaactatgacccatctcataagcacatatccagctgtagcctcttggttgctggggtgaaggggcctctgtatcgccacaggaaaaaaaatctgataaattacgggctcaagaagggtgttgcttttttttccactaacagactttgcaacccagttcctggtgaaagggctccgcacccacccgttttgtgtgtataatgctgagctaaagtgggaaggagcagtaacaccaaaggaggctaattctcttcctgtcagtaggagagagtgtctgcccccagtgtgtgaaaagggaaggcatgagaagtgaaaaatcagccttctggaagcaccttcttaccacgagaaaacaggtgattcttactatctttgagactcatccagattgtgtctgtttaactcttcaggcaatatgaaggcagagaagccatttcagagaagagattttttaaaaaatcatttcgttctttggcattgtcacaggattatgatgtgggttctcataaaaatttcactccccccaaagccacccaaaggaaaggcagtgaaatggggaggaacacacatttgcctggcatcgcaagagctgccttgtagtcatgggttccagtgatcttggaccgatctcttcacttccctggacctcagtttcttccatacaaagaagttgaactggatcatagaaaagatgctgtccagcttggtaatatcagatagggagcagaagctgtctcttagcacatggccagattccggaacaacgatgatggtctccatgtttgtcctaaaaatgcatctcatctcagtagagattttcttccacctcatttgggtctcaatttaaggaaggaagaaaggaaagaaacccggggattctcttcttgaaaggaatatacttcactttctctaggcttctaggataaaaacttcctatccttcatttttcctctttaaacctgccaaaatcaagttgagtaaagataccatacagatatgaaaaagaagccacatccttaaattttcatggagtccaagagcctgctcaccgccagttagcttttcccaggatggtggtggcactgatcatctaggttgcacttttatgttcatgtcccagagcgtttcccatcagccatctcatttcatcttttcatcattcctctgaggaaaagacttcacacatgtataggactttctatatcacaaagtatttcatatccaatgtcttatttagatcttgacaatcactgtttaaggtaatttggcaagttattaatactcatgtcctcattttactgaagaggaaactgaaatgcagagagcttgtcttttgcccaggatcactcacccagtttattgggaggcagcagcacggggattaagaacatgggttatgccgacaaccaaccaggcagaattccagctctgtcagtagttagctgtctggccttaggaaagggatttcacacctctgtggcttagtttccttgtccattaaatgctcataagaatagagctttcctcacagagattgggtgggcacgggagctaaatgagctcatacgtttaagaacaacctctagcacacagtgcataataaatgtcattattattagcaaagccaggacctgggtcttccagcttctagctcagtggcatttctgctgccccacaccaggactatccttcgtatacaggtatgaacctaaagccttcagtgtttcaatgaaaagttcacccaaggtctttctgttcagtaagtctagagctaagggctcctggcactctgttcagtcctttcgctggtaaaccacgctgccctccgttgctctgggcagaatgtcaaaccttcttatgtttttaaaatttataaatcaagcactcttatttaatattactgacagcccgaaggcagacgctcccactctcctggggaagagggtcttctaatctgccatcttaaggaggtaaaagggcttgattgggtaactcattgcaatgggcacgtatttattactgtctcccggccttttctcatgctgtttgtctgctggaattaccactagtgccaggccatttgaatatttgaccatttgtcttagaattctctgaatacaaatgtttttcatacctttactatgtactttttaagaatgaagactatgttgcatgttggtttgtactctctcctgcacataaaaaatgcttagtaaatagatacacaaa

SEQ ID NO: 1479 - DNA, 814 bp, Homo sapiens
agcccagcgtgggatgaccgtgccccgaaaacatgccagtgaatggaaagaagccaaggtcccctccctccctgcttataccctcaactttgccaatgaggaccctaaataccagctgcactacaggggatgtaactacatacaccgtcaccaaagttgcagcctggccaagaaatgccaggggacgtcgcggcgattgcagactccgcggtgactgtgtagatacgtccagaattcgcccttgtagcgcggggagaggcgagagtgaaggcctagaaaagctggagtgcaatggcgccatctcagctcactgcaacctctgcctcccgggttcaagcgattctcctgcctcagcctccggagtagctgggattacagaaagaagaataaatgggacattacacaagttcctttaaagattcttcacgttgatataaggagcctgcttcctcattgccatttgggtgcagagttcttcctgtcagcccactcatcatgctcatcataccttgctgccaggcctctctatgctgatgactcgaggaaaacacgctcctctggttgcaaagaaggcattgtttctaaaggcacctgtctcagagctctagatggattatgacccacggcggtcattggactgtaaacctgacacaggtttaaccttctgatggagcttggtttttgtcctagaaaaactataaagagaaaaacagcggcacataaagaacagtatatggtgtaaagagaagcgggagtcctgggtcgatgttagaagacatgaatgcaaatccctggctggctattaacttagttt

SEQ ID NO: 1480 - DNA, 572 bp, Homo sapiens
gtgcggggaccagagggatgtgggatcctgaggatcactgtggggcacggacgctcaatcctcagtccccaaggccgcggcggcgaggcccgggtggaaggcggcggcgatcccggggaggacgcggccggagtgcagcagggccatggtggaccgtaggagggcagtgggcagccgcaggacggagcagagggcgagcggacacacacacagggaaccggctcctgctgaaggtaattgtatgacaatggagaggtgattactgcgctgaaaatcagtttcctgaagtgaaaaagggaatcaagttacgtcacagagcctggtgtgagcggcgctctgtcaacaccagctcttcatgggttgtggtttcctccagttcctggatgtgtggagttcatcctccactgactggcgccccggttgacaatgaggtctggaaattggcaactgatgaagggaagtgtatcagtccgttttcatgctgctgataaagacacacccgagactgggaagaaaaagaggtttaatggacttacacttcgacatggctggggaggcctcacaatcgtggt

SEQ ID NO: 1481 - DNA, 2314 bp, Homo sapiens
tagcaacatcaatgactaaggttttggtcaatctctcaaaattgagtaaatgtccaaaaggggggaattgttaaggcaaactaaatatgtcctgagaaagcctccatccttctatatttgcatccttgtggatgaactgtaacctagcttaatagtcagacaaaactgaaaacctaacttaatagtatgtacctgtaacaatgactgagtgttggccaatcccagtagccatacttcaaccactcatagactgctgaatgttcaaactgtgttcagaaatgttgagctgtaaccattcttactgtttctgtacctcacttcagattcctgtatatcactttatcatttttgcctataaaattgttctttccacaagatacccctggagtctctatgaatctgctgtgattctgggggctgcccaattcatgaatcattcattgctcaattaaactcctttaaatttaatttggctgaagtttttcttttatcccaggtctcacctctttataggagtggtataaaaaatttgtagtcattttttaaaagcaccatagcacccaattcataggtttttttttttttagagttttttttttcttttcctaattatcttacaaaaaagaagatatctggcactttataggaggaaaccagaggcaagtcctgtgttttactataaagtcaggtgcaggaatactaaccaattcctttatatttcccaatattacccagttcattcgttggtacacagtaggttccagaaaaatgttaaggggaaaaattgattgctatgagaatttcacatgaattatgtttcttccaaggctccttgcagtcaatcaggatggatgttgcattagtgttttctctgatgtaacagtcattaactacagctctattagctgttcatttgtggcatgaaatagatccaaatacagaggactgtatttgaactgagccattgtttcatgaatattagaacacaaatcaatgcatattgactgggcttgtgtagatgaatgtgatagcattgccctcaacaaaatatggttcatttcttcagaacagtgtgtaaagcttagaataaaaataagaagcacttaagtttttcaagatattgaactctaggcactgagttaataagttcatttttatagatgcttgatgctgtatgaacagatactatactttctaaagcagctacttctgtgtggatggtggtgggtaagaggccagagaaggatggtaactataggtaacactcttatggcactttaacgagcatctatcctctctattggcactcaaaagaaacttgtgaggcaggcactatcatcccaaatttataaacaagcaaattgataccacaggttctatgcagtatgccaaaagtcactgtcttgcagtggtggaattggagatttaaattcctcagatatgattgcctctggagagtcacatctgatcctcctcagacaaataagtactctttctctgtgttctcgtgatatcttgaaatatatctatatccaccactttgtgttgtaattatcttcttatgtgtttatttctctccacttgagttcaagaaaaaagaaaggtccttgtctcatatatgagcatccactaaggatttaacccaaagtgaccagtgaatgcttgcagaatgaaagaataaattattgaagatcctttaactctaaaaatctctaccaatccatgatgcattttaagaaaaaagtgttctgttagaatagggtgaagaaaagctgatatttgtgagtaggatgcaagggaaccatagacatagagacctgcaaatcatctgtggccttgttttatcttattctctggaatatactgggaatagtaaggaggcatgtgtgcctgagcagaatgattaaggggaaaatattaggaattgaggtcaaagagttaatgaggtgggggtaagatcatatatagccttgtaggacagttaagaaatcccgagtgacctgatcagagcagacaaagtgatccttttaaaacctacaaggaaaatagatgggggctgagcaagagtggaagtagagagacctatcttgattgatttactgaagtgatcaagatgagaagcatggttccttggacgaaagtgagaagtggttggattttggatgtattttgaaagtagagccaagaggaccaattagatatggggtgagagcgagagagaggagtgaaagttgaaaccagtatttttggcttgtgcacttaaaaggaaggaattaccattagttgagatgggaaaatgtacatagatgaagca

SEQ ID NO: 1482 - DNA, 1993 bp, Homo sapiens
attgctgatttggtaaccacctcagagcctaccctatttattcccagcatggacctaaatccacttcagccaaaaatgaacaaagaaatgatgaagaacagagcctgtttctttctcagtggtgtactcagaaaatggatgcaagagtagaagctgatcctcgaggcttgcaaaagtggggttctttctgaaagtgaagccagcagccaagagccacccttcagaagatagaaggaagagcagctgcatgagtgatggccacagcaatgcatgggtcctgtctgtccacgtagtcctctccatctgcccgtagcttgccaggtctcctacccacactggggaaattccagctgccggccctctttgggttgcacctcccctttttgcacagggctctattgggaaagcagctgtcatgtgtctatttgaaagacaagaaaccagtctagttatagaaaagagatttagattacatcagaataacaatgcaaatcatttgtgcagttcttagtacagaaaacagatttaggaacaaaaattgggagggttaaagaaagtggttttttattctgtcatcaaaattgttttttaaaaacacatctgtagtaagataaataattgtgtgccgacttcataaacagaatgaatgactgaattcacacaatgttatttactgtttcagggcacacacacatggtttccaagtggtttcttgccactttggccttcaactggccttgctattttccattgaggggtgtctgattgtctcctccacagccctgagtctaagcaaaagcccatgggttggttgactggtgttcttgttgtccttggaagtggacagactggcagatgtggggctagtggggaagattctcgtaaacactttatttgttgtaagaactccagttggaatgtggcttccaatcatgggaggaggactgctttagaacaggaaactttctataataataccaatacaaccaaagactattattctgaacagaaaacaagaaatacagctggagctatttcctatctacctgatgaagggcactaccaggcggtcactctggctctgtccaccgatgcctgtgcccactttgtgcgacgtagcttccatggagacaagagcaatggtaatggaagaagaaagtctggatgtactcttgcagaagcagaaagcttcatggaacaatattaatcttctggtcatctctgtgctggtctagttgcccataaagttgtcagattgactttggatttaaagcctgaaaatgagtcccaaggaaatccgttgacatgaggcccaaggaagacagtttttggaaggggcaaggagggacagttctctgctccactgaagctaggtatggccatgtgacccatgttgccagtgaaacaggaggagaagggacatctgggtggaaacatttaagagtcaagtgtatttctccatactctctttctttggctttggcagtgatgaaggtcaatccaattacagttgattcttgaacaacagaggtttgaactgtgtgggtcaacctatacgtggattttcttctgcctctgccacctctgagacagcaagaccaatccttccttttcctccttctcctcagcctatacaatgtaaaaatgacaaggatgaagacctttatgatgattcacgtccacttaatgaacaacgtacctttcacttcccaccatgattctgaggcctcccgagccatgtggaactgtaagtgcaattaaacctctttttcttcccagtcttgggtatgtctttatcagcagtgtgaaaatggactaatacagtaaataggtaccagtagagtggggcattgctgaaaagatatctgaaaatgtggaagcaacttttgaactgggtaacaggcagaggttggaagagtttggagggctcagaagaagacaggaaaatgtgggaaagtttggaacttctagagatttgttgaatggctttgac

SEQ ID NO: 1483 - DNA, 2231 bp, Homo sapiens
ctttcagacctttaatctctgtatatagagatatagaaatagagaatattctttaaatatctgaacatttaagtattactcatcccaatacaatatatacttatacaaatagatatatgtatgtatactatacataaagatctgaggtactaaatattccatggttttttttcattcaacaatgtattatgaatgcctttcaatagccatactttaatagttgcatagtatcacgttgcataaacatattaggtcagtgcataagtaattgcactttttaccattttaatggcaaatgaggcactgattaatcagtgccttatttttcacaactacaaaaatattgctgtgagatccttgaaaatgtataattgcccatttgcatgtttctttaaatttatagataaggaattactggggcaaaaagtgtgcacaatttaaatttgatgtttttgtttttgccaagctgctttttaagaaggttgtactaatgcacacttttatcttgacactaagattttaaatatgatcagaaaatgggtttctgatagtaaaactgtctacttgtaataattgtggcattagaaaagacctttgtggcttcgttcctcaaactcatttacgaattataaatctgaattccaaatatgaattaactcacacaagataaagctttaacagttagtagcagtactgtaactagagtgcatgttttctgtctccagaaataacattctttttatgccacatttttttaactgaggtgatcattctccaccctcttctttccatgtttttccatgtttgttcaaacttttcattaaatatcttgaggctctaactaaattaagggtggccattaaaattgtatgtgggattccctgaaccaactggtaatgcactaccagcatataaggtgtcctcattaaagcagttggtgattggtacatgggacctcactcatgtatgtttgcatctacttgtgagtcaaaaagttttcttaaagtataggtgggatcatgaaagacatacaattcactggagaaattgtgaaaaagtaaaagattatgaatttaggctcaaagccaatttccctctcatttaattctacatgagcaagtcaaggagtttggtagagctttatgaaatctctaaagattgaaggaaaacaatcactaaaatcgatttgataaagtgcaactaagtagtatgctagcctgttaatggattttcatcttgtcatttaagtttcagcaattgagtaccacactagaacacccacaaatgagattctgttacagagtatcttttttctactacagaacatactgtagacagttattcagtggttaacttgtggaaataatcagaagatgcttttcacttttatgactggatatattttaatatttatcatattaagagaaacttaggttacttacagctcataaacgttgctatgaacatcattcatttattcacttatttatttttatggtgttcctagaaagaatttcctggactaaaggatttatgctttaaaaatattggtagttactgccaagaattgccatccagaaacagtgtagccattcataaactcaacaacaaggtatgagagtgcctgtttcctcatatcctttgtgacaccggattttatcaagcttaaagttttttcattctaggtgggtgaaaatggtattccgttattgataatgtgtggaaatcaagttctaataagtttggggggaggttaattctttatatgtgctgtatgaattaatgccaactgtatgcctttgagagtgaaatcagaataatgtctctccactaaagcaggacttagagcactagttttccaaatgttgtctacagatggaaacactagcatcacctgggtactcgttagaaagtgcagattctctggcggtaccttagacctcctgaattagaaactctgggggtagggttagacatttgtgttttaaacaagccctccaagtggtttcaatgcacattcaaagttgagaaccaatcactgatagagaaaaagcagcttgggtagaaacagttgattatttgcaaatttatattttaaaaagataggattcttaacagtaagctctttataattcaacaatgtgatctttactcctacccccgaaaaactaatatgattttagtgtgtggtagctggatcgaaaacataataaatactcagatatgcaaag

SEQ ID NO: 1484 - DNA, 2147 bp, Homo sapiens
tttccctacctctcacatacacagtgggctggatgctggatgcaaagctccctcgtcacagccccaaagacaggacttgaccatctcagtgcaatgaccctgtggtgccttctcccgaggacctaagagccccctgagcgcttgcaaacactgcagacaaagcgagccctggcaccagctccctgcctgcctgttctgtgaagggagcctacaaaactggcagcccctgcagttctgagctgcagaactgatgagctggggcaccctgaaacctgactccaaaatagcagcaaacccaaggccaaaaggaagacaagcgagaatcccccaaaagccaaggtcatcatcaagccaggatgaggactggaggaggagctgacagctctgcctcaaatggatttgggagcgaaggctttttccataagctttgggggtaagtcacagagctaccccaaatgtaacttagtctcggggtctccttccttttcaccagctgtcccctttgctggaggaagctttccagcccaaacgaagggcttaagaggagtctggccattcctggcatccagttagacctggaggaggtgaacggaggagaagcctgagggaggggtgtgtatccggcctgggaattcctccctctcccttgctagcgccccaacccgccctcatcctgttcagagagggcacttacaggcctcggaggcaggggagggtctcctcctggggaaccatccccgtccagatggtgcccccaaccagctgcggcggcatgatctgggcggctggtccagggcatgggttgcggatcgtgtagggaagaggggaacagcagtcgagaccctactccaagtacgcatcaaagacgtcgagctccgagtcagcatcgtaaaggcccgagccggggtcggagagcacgccgaggtccacgagcgcctggtccatgtcctcgggcaggaagacgaggcccacgttgaggacgatgtactccatgaggaaggcgtagtacaggatcagcacattgacgaagaacaggcccacgtagaacatagagggcagcagcggcggcggcacgtaggggaccagggggcccagtgcgtccaggtgggccgcgacccgggcgccgagcatgcagcgggtggcaagggcggcggcccggcgatcccggcgaactcagccgctgcggcgcccgggcggccggcgagggcacagcgcagccatccaggggtaccctggagcccgacagaagcagggccgggctccagatgtcccctggcaattgcgccccgacccccgaaatgcgccgggcgggtcaccgcaccccgagatgtgcccccaaggatctctcgaccgcccgggcggcgaggcgggcccccctgaagtggcccgcggctgcccggctccctcgtggcgcctccctggcgctcgcagggcctcgcagagccggtggggatcccaccgcggctcagtgtctagggccggtcccggcagccttctctcccgccccgccccgcaggtcctcgcgcaccccccgcgcccccgcaggcccagcacccatggctgcggccgccgcgtagccctcccggtggcgctcggagctccgcctcccgaggggccccgagctcattggcaggccgccccctgcacgcgctaattggccggctcaacgcccgcgctgattggctccggccgccagggggcgggtaccgcttcgctccgcccctcggggccctagcgtctgagttgctttcctggttcgggtctgccctcagatctcaaatcgaattcgctctgcgtatcgaatagggggaggtaaaagagactgaacacagttcaaacctagacataatgctaaggccgcaaaagccgaaggaaacccgggctaccgctgcaccttgctgcatgcctctttgggactccgtttctcctttaaaaggaggcggggtcggggaggggcgacggacggttgccctggaaattttggacattcccaaagcgccaattttcatggtggagatccaccagtgtccccttcgcttctccaaactctggttgctggaaggtccgcccactacggaacctgcatcctagagttaaggaacacctgaataaagagattccgaggtagttcagatcttcaaccataa

SEQ ID NO: 1485 - DNA, 987 bp, Homo sapiens
gaaacgtctactagtgacggtcaagccacctacaaccggtcccaaagccgcaaacgagtcaggcatcgtggtaggacctggcgagtggggccggggagagcgggacgcctggatcgggaacttgtcgcattcacattggctgctaggaggcctcggcgaccacttccggatccggggcgggggtcgcaactcccagcccttgctcagagggctgaactagaattcccagaagcctctgcggccgccttcctgctccttcactcctgcttcccccacaaataacacttcttctttaggcattgaagactgttcctttctgggtgaaggagaatcacgtagcaattgggagcaagatgcatccatgtaacccagtactggaggtcaagatggagacaatctccacagccaccatggcctttccctgagtgctactataactcaggaggaaagccacccagatactgcagaacaccaacatgctgaaggcaaaccaaagagaagaaagactttgtgcttgagagttgaaaatgagaccaccttgccatgtcaattcaggtctcttaaagtcttcccttgcaggagaagagggaagtgaaaagatcttcttgtgaacagggtctggtgtggacctccagcaaactccaacagattaattcattgacagaatgggattgtcttgtgaaagggaaatatcttggatcccttcaagctgggaacccctcagggcaaatctgcctacttctgtcaattcatcaatctcattctccgtccagttttgtgcccttgctggagaggagttgccatcatttgtcatacacaagtatcaatagccaaattgatcacgcaaaagaaacgatatcagagattgaagatcaacttactaaaataaggcatgaagaaaagattagagaaaaaagaatgaaaaggaactaacaaagcctccaagaaatatgagactatgtgaaaagaccgaactacagttgattg

SEQ ID NO: 1486 - DNA, 457 bp, Homo sapiens
gtagctaaattttttgtattttttgtagagatggggttttgccatgttgccaggctggtctcgaactcctgcaatttgctctccttggcctcacgaaatgctgggattacaggcataagctacagcacccagcccttacgtttacttttcattgacaggaagagtgtcttcatctctgcatccctagtgcaacagagcatgacaaaaattcaacaaatatttattgaagagtcttgatgtcttttgggaaaggaactctatggttacctttactctaagattagatgggtgttactgattcttacctcagagaagagaatgtcatggagacaaaatgacctgcttagagttctgcaccccccagcatggagagcagagcgcaaagatttcttccggactcccacattccccttggaatccaagaactggtctactgtcacaacactttagtaccctc

SEQ ID NO: 1487 - DNA, 1298 bp, Homo sapiens
gttaatctcctggagaaactagaggcagccagggaggatgctgttgaaccagttaggaggctgttgcaagagatcccaggaaaagataatgataatgtggacttggaagatggcagaggagttgcagaaaagtatccagattttaaagatgtccagctccaacctggtttcataggcagtggtaatactggaacaacctcttctccaagattctcaggcaatcaaaggccatggaagagccagcatgtggggaaacttctttattctgctatccaaatataaaatatatacagaagtagctcctttgtcccttaaccttagtaagcaaatttgattaagcatttgaacgctatagaggtgcaaggtgggagaaattctgcctctgctacttggcagctctatgatattgggcaagccattcataccacatttatattccttatatccaaaatggacataataataccttcttacttatctcactgggttattagaatgatcatagtgtttaggtggttggttgtttcaaggaggtaataatgtatgtgaaaataattggtatatggaaaagcattaaataatagtgctgaaacattatacatattaacatgcctttaaatctgtctccctaccattccatcatttattttgggggtcagttttactgagatataattaatgtattaatataagtgtacagcttaatgagttttgacaaatgtatacagatatatgactactaccacaatcatgatatagaatatatcaatggctccccaaatttcctcatgcccctttgcatttttatactttaaaagtcaatatatacccaagagtggttaaaacataccttcccaaaaacttgtgcgtaaatattcttagtagcattatgtatgatagccccaaagtggaaacaacccaaatagccatcaactgataaatggataaataaaatatatattcatgcagtggaatataattcagccacgaaaggaatgaagtaccaatgtctgctacaacatggatgaaccttgaaaacactatgttaagtaaaagaagccagtcacaaaagaccacacattgtatgactccatttttatgaaaggtctggaataggcaaatctatagagacagaaagtagtgtttgcctcacattgggggctagggaataatgatgaatgactgctaatggatgtggaatttcttttgggggtaatgaaaatgttctaaaattgattgtggtgatggttgcaaaactctgtgaatataataaaaccattgagttaataccatttaaa

SEQ ID NO: 1488 - DNA, 110 bp, Homo sapiens
gcgagggcgagtggaacagaggtcggagaccttgctaagctgctggccttttcacgtttcggaccctgagaatatgtccaccgcattacaaatgggattctctggcatct

SEQ ID NO: 1489 - DNA, 2237 bp, Homo sapiens
agtgtgttaaagttattctgatattgactgtagttctgagctttgtctctatcccaccaaaccactaacttctggaaattacttgtagaccaagatgggaggactccgtgtgtggctccctctcttcatgtgacaaagaaacttcctaaaatactaaaagctaaaggagattgttatctaagcttgagatggaaggttgccagcggaaacttggaggatcacagccagtcgcctgggattgaccacagggagtggcagaggcagaaagcaaaagaccagttgcaattatccaggtaaaagatggaggctgttgcaataatccagaatcctgaattgagcctgtgttcccagttcctagaaaccctcaaggttattggtttcctcctcgcttaatagaccagtggaagaaatctacctccagttctatcttcacatgagcaactgtttacagtttacaatattactctgaaaatcagttcttttcaagttttatctaacacccaccagaagaaacagaagattatgaaaatggaatttgtcaaagttcctctcccaacaatatgatatttaattttgctaacatttttttttgaacacttactatattgcagacaatggtctaagtaaagcattttatgtgcatcctatcatgtcatcatcacacagccctgtgaggtagatactattattattaaccacatttcacattcaaaaaaactgaggcttagagagactaagtaaattgtccaaggtcacacagccatgaagtggcagagctgtggttaaaacctatgtctgtctgatgtttaagattttgctgttagcattactttgaaatgacaatatgagggcattttatgtattttttttgccccaatatgatctgcagaaactatgtattttaagtactacatttcttttatttaccaaattattgtcagataagaaaccgaaataaaagtttacagggtctaggattcctccataatgaatgaactttggggtatttcagtgacaaattggctttaacgcgatcaaattccatcctacaatgaaagtgtgttagtttgtggtttcaagtttaaaaacagcactgtattgtcttccagaaatatataaatagaaattcaagaagtatttcaatgaatacagataaaattagttttgttagaacatcaaatatgtgggtttcatttcttagctcagtttagaaactgtaatttcaattttttttagcagctgtggtaaattttgagatttgaaatttcatataatataaatcctcatttattgagcatttaaattatatgcccaacaatttactgtgtacattacttcacttgttcttaactataactctacaaaatattattgtccttgatttatagatgaagatattgagactcagttaagtaacttgcttgaaattcaaaaacgttaactgtggaaggcagtatttgaacccagtgttcaaaaccccatgctctttttattatatgaccttatttcctattcagtcttcagaagatatattgtcttattagattattctcgttctctaaataagtgaccttgggcaactatctttttccctggtattttcccctgcctttaaaacaatgtgatcaaactggaagtttttcacgatctctcttagccctaaagctccttggttctgtaattccaccaatagcccatttcaaaaataattctacagtaatcagtgggactcctgtttttcccatcttttttttttttgaaacagaaaattgaaacttttaaattagtttagtaaatacatctactagtttttttcttttatagtcatggttatattatttggtccttcttagttgcaacatgtttccttgctgtcaatttataatacctctcatcaacaatagcctgaagaaatagatttgaattgctttccctaatttatagctggaaaactaggctacgctggtatcttaaattgactttcctgaggtcacgggcactcagtgccaagaggagttggtacctacgcatttgaaatttctggatttctggtcttactctgtacttagtcactcttttctttcatttggccctatggtgggcaaactacagcctacaggccaattccagcctaccatctgtttttgtatggtccatgaactaagaatggttatcacattttaaaatggtgggaaaaaaagactattttgtgacataaaaattatatgaaatccaaa

SEQ ID NO: 1490 - DNA, 467 bp, Homo sapiens
agtccaagacaaacagtgtaaaggaaaatgtcaacaataaagtcatcactggtgggacctcaaggcagcagagtggaatcacaactagatcctgcaatgtaactaatcaaaatcttatgaatttttttttacaaagcagaaattccatacgttttgacccacgaaggggagagcttcagcacatgaaacagattcgtctggagtaataggaagtatgtccaaatgagggaggaggcatccaaaaggacaagacctgctaagcactctgagagcatcgtctacacctgctgcttccagatcatcatctcccagttgttcccagcagcccagcagtctgacttccatccctaccatcccaacagaactgccctcgccaacctcctccacatgcaccatggtccgaagataatgaacactgctcaggactcgcctaactgggacaaaattgattcctatctggacgtgca

SEQ ID NO: 1491 - DNA, 2691 bp, Homo sapiens
taggaacaacacagaccatttgctctgattcaacgatttttatgagcaccattaagtgaaaatgggcaagtaactctgtggctcagggcaaagcccccacagcgatgtgatgaaaaatcttggcaagaacccatgaaagagaacccttcaaatcaaatcaaacaaatgcggatctactaggaggaagggccttgtttttcatttaaaataatcttttaaagagtagacaataatccaaacacctctgggttactatatcttctaggagaatactgattttgataaaaatatttaaatcaaaaattttaggtaattttaccttcaaatagcttaggcaccttagaccaaagtttgcacattctacaaatattgacacaataacaccattttaaatctttacccaccatttgttgggttatgtcaaatgtaactcaggataaaaagttgttcagataagtgattggtacaattggaatttatagattaaaaatttgttacaaggaattaaaagtttttcttacctaacctctcaataattttccaaagaaaatgtgtgatgtgtcccttgctctgcccttcactctagtgttttattttgcatcatggatgcatttcttttaattttcttcatataactcttcacatgtactcttgagattgcatattgcttcaacaatccttgcccagccactaacttctttcttaaaataattttcctgccccccttccttcaacagtaatcaatgtctaccaccgcctctattaattctgccactgattttgtgataactcttcacaaatactgaatgatgtaacttgaaggcagtttttgttgtctgaatctgcttgatgccagcttatggttggctataatgctcagaaatagaagcaatgattagacaatacaaagagatactagtttaatgtaaggaagaatattttcatccttatcacttactgtatttactttatattccacattacaaggagccacttcaacatgaacaccaagccatcttaagtttattaagatcctaataatgtttaagcattggttatgtgaatatagaatgatgatcccactttggattttacattcaagtataagaaatatctattaatcaacttctttcaggagtgttacagatggtagagtctgtttcaactttgggtgcagggcttaacacattctttaacacaataaatcaacattactgagaaacaaagtaattataagaactcttctaattctaggaatcaatgattttatatcaatcatatggaaagaggtaaaagtgcatgcttcatgttatgttactttcttttgcttgagaatgctaaatttgtaaaactatataatatgacatacttgtgactgaattgtaagagattttatctaatattgctttagaatacagaagtaattgtttcaaaggataaaggatggaagattctgataaagcttgcttactttttgggggaaggcgtggggggaaatgtctcagtgcccaaggtcagtggccttcctgactgaagactttcccagagtagaggataagagtgggaacaggaagagcagtttaaagtcatcttcacaacattctggtgagtgactgattgcttcagcagcaaacaggcacatggtaaaaatattggtaatgtgaatttagtgttgttactgtcatttttttctttattaactatgattttgcttacagatagcagtcagagtagtagtatattgataataatgaacctcttagggttgctggtttggtgtttcaaagtttttcagttatccatattaaacttttaaagatatcttgtgtgaaaattcatttcaaattacatagaattaagatactatgttatttaggatagacaaattaagtgtgtttgtcatgattctataaattgatcttatttgctatcaaatattttaattcatgaatgtagtgtgataaaatttgttaaaaataataggcacacatattttcattgtatttaaattgcaatctggcctattcaaaattaacatagattgattttgaccaaagaggtctagaaagcaagaccttttgtaagagaagtggaaaacagagtcatttcttagtttcattccactaaccaagatgaagctgggtcacagattgctgtagacatttttaagtaactccgtggatccctctccttccacccacttttctctgctatattcacagataattctctacatatttatcgtttgggagggaaaatgactctccaagagttaacttcaattacacattggtgggcagtaactgtgctgagtgccagtcagaactgtatgtcaaaaatgccaccttctctcttattaatgctgacttagcaaaaacagagggaatttagggcaagtcagaattcttgtttcattgtcctattttcagtaagagaaggaatttaggacaacttagaattttttctcctgccctattttattgcacgtatgtttattcatattcagcaaaaagaatcccaattttagcctttgttgtcttcatgtccaaaaagtattttcccaattaatttaatttttttattttaaaattaatatatctggctaaagacattagaaaaattatatcaactgaacaaaatttttaaatgactcatagttccaccggcaaaggaataaactcggctttgagt

SEQ ID NO: 1492 - DNA, 364 bp, Homo sapiens
ccatgtgaagaaggtgcttgtttcccctttgccttccgccatgagtgtaagtttcctgaggtctcccagtcatactgctggttaagcctgcagaacggtgtacttgtttgaaatgtatctggcccaatcgctgagcgtccgcgctgcatttctccaaactgcccagcagggggcggtgctacctcggctccgcgcagccacggcttcccgctggcgaaccaagggcgcggaatctggagagggcgaggaacatctttcctcccacctgtcccccgccaagcctgccagacccgtctcatccgtgctgctgcttctgaaaatcagaagagtgaggatgaaataaagtcttcataaaggaaaacca

SEQ ID NO: 1493 - DNA, 740 bp, Homo sapiens
ctgaaaactggaacagggatgtcgacagtcagaggaggagaagggcagaagtgtgcactagaacaccagatgtttgaggctgaaaatgatatggatgcagaataaatagccccaaaataaccttctatctgtggtgtcccgtccccctccttggccaggcatcaaagctacatgttgttcatttaaaacatgaacatcctgatcccaggactttgaagataggaatcacccatcccaaaccagacacactgcccacagtagctgagaaagaagccaaaggtggtgaatgattagcagaactgcaagacagctccagaatctaaacacagagtactgggaaagctgttttgtgggggaaactcagactgaccaaaagagccgaggaggtcctttgtggcctgtctgctccatgggaatagctccaggagagggaagaccagctgccttcatcaggaactcacaggtggcatttctatggggaatcagcacaagggaaaaggagacatttcatttccaagttatggtggcatcgcaattacaccattattgcatggactgaagtgcaagtggaggacaaggggttgggagaggaagtggctttggcaaattgtccttaagctggtaagaagcagatctccaagactttctactgggatatggagttttggggcaaaaaggagagtggagatcaacactaatatttatttattcatttttaaataatacactttcagatagaa

SEQ ID NO: 1494 - DNA, 501 bp, Homo sapiens
agggatgttaaggcactgagggccagagcacttgttctcatcagcatcatcatcagcctcagcatcattgtcaccgtaatcagcatcattggcatcagcatcatcagcatcaccaccctcatcatcatcagtagcatcaatatcactatcatcagcattagcatcagcatcatcagcagcatcagcaccatcagcatcatcgtcatcaggatcatcagcatcatcagcagcatcaccaccattatcagcatcaggatcaccatctaacattttttgagggcttcaaatgcacaaggcactgggctgatttctttacatgcattgtctcacttgtttccaacaatgacagcccccaaagaacctcaccagcaccacaggacccaccaccaccatcacaagccttatcatcacccctgccttctctatccctgcagcagtccggggatagacacagggagaggacagccatcttaccagccgaggaaggaagcctcagagaaa

SEQ ID NO: 1495 - DNA, 480 bp, Homo sapiens
ggcacaggaaactctgggtggtttggctccagctcttgaaaacaagttccttgtttgccctcctgagttgatggtctggtggagaatttgtctgaaggaatttgttccaggaaaggtccagctgcatttgacaggaaagggagaaaagagagaacgaggcataaatctctggccttctgcctcttgcttgggaatctgtcctttccagcctgcacccacacccttggagcccaaaaccatgccatgcacatgtaaccaaccagctacatgtgaagatcacataaaggtgttcttgtcctggctctagctaaggttccagctctcagtcagcatcaattgtggaagatgggagtgcatgagcttttagatgatttcagtcccctgcctttgacaccaagtggaactgagatgatctttccaccgagccctagtcaaactgcagattcatgagcaaaataaacaccatcattactgaagcaa

SEQ ID NO: 1496 - DNA, 558 bp, Homo sapiens
taaggtcacctcaccaaagaggcccatcaacatggaagaatatttcagtgaatcttgactcaccaagctcagtgacttttcattgaaaagggagagcagattacattatcaaaagcaccaagttgaaacatttgcaaggtgaggaaactgagcactaagacactaaataacttgcccagggtcatacgacagacatgagaggtttatatcaggcagtctccacccctgttccgaagtcaagaggctgactcgggttgctacttcttgacagaccggaccccagatcgccgaagaccatttggacacacttctatcaaatcctggcggtctccttctaacagggagtgggatgctgctctaatgataccccgaaatgtggaagtgaccttgaaactgtttaacaggcagaggttggaactgtttggagggctcagaagaagacaggaagatgtgggaacgtttggaacttcctagagacttgttgaatggctttgaccaaaatactgatagtcatatgaacaatgaagtacaggctgaggtgttttcagatggaaatga

SEQ ID NO: 1497 - DNA, 3312 bp, Homo sapiens
atcagctagcaagtattcacaggcacatccaacctccatccttacattccacaaggatttgagtgtctgttataggtataaaagcctgccgttggtggaaaaggaaaaggtggtccagttagacaagatgccaccggcttctgaaaccagacatctttgaaaacccacccatctacctgcaggaaaaggcaagggacctgacctcgcctgggctcagggaagaggttgctgggatcataaccccaggaagagacgggatggaaggagagcatgcagggagcagaggacaggctactctccaaggaggagagggaagaggccacagaaatggaaaaggggccaggacaagtcagtggagagatggtcagggcctggcgaggaggagcaggacaaaagcggtggagctcagccccgtggcggcagggccactcccattcatctggtcctctacttctgaagttctcgaatgcagaatgagatgtacagatgggccagcaggtgatatgctatctgtcataggttaaggcctcattattttattcatttttaaacttttttttttttgagacagggtcttgttctgtcgcccaggctggtttgcagtggtgccaccatggttcactgtaaccttgaagcccctgggctcaagtgatcctcctgcctcagcctccagagtaacgaggactacaggtgcacaccgccatgcccagctaatttcttaacgttttgtagagaaaggctctcactgtgttgcccaggctggtcttgaactccttgactcaagcaatcctcctgtcttggcttcccaaagtgttgggattacaggtgtgagccactgctcccagccacaagttttattttaaatgtttacctttcaatgatcacttcgaggagatttaagcttactctttcttttttttttttcttgagatggagtcttgctgtgtcgtccaggctggagtgcagtggtgctatcttggctcactgcaacctctgcttcccaggttcaagtgattctcctacctcagcctcccgagtagctgagactacaggcatgtgccaccactccctactaatttttgtatttttagtagagtcggggtttcaccatgttagccaggttggtctcgaactcctgacctaaagtgatctgcctgcctcagcctcccaaagtgctgggaggcatgagccaccatgcctggctcattgtctagtttttaccaagaagatgatgagatatgccagagggctccgtatctgctatgagaacgtcccccaagagcagctggccgtggtgctgcagctggagctgtgcttggagctcttcttcacccccatggcggtcaccaccttctgccactggcactttgtgcagatcatgctctctggccccaagtggggacctggaggtgctgaagagccaagagactggctgccgtgaccctcttcaacttcctggtctgcttggaccctgtgctttgtctcccatggtgggttcccccagtggaagagtcaaattggtgggcaggcgcagtgttgttcagtgctctcgatgctgcattgaccccttgattttctttgtttttgtttttattttgttttgttttgtttttgagatggagtcttgctctgtcacccaggctggagtgcagtggtgtgatgatcttggctcactgcaacctccgcctcctgggttctcctgcctcagcctcccgggtagctgggattacaggcacccaccaccacacccggctaatttttgtatttttagtagagacgaggtttcaacccctactcaggctggtgtcaaactcctgaccgcaagtgatctgcccaccttggcctcccaaagtgttgcaattacaggcgtgagccaccatgcccagcctaaccccttgattttctgtttctcttcctccaccgtgcgcaaagcctttgacagagggccacggaggtggcagcacggcgggggtctcactgtctgggtggtggtgaaagctctggagagccagctgcagagagaagatgtggatcttagggacggccaatgtcaccttcacaggagattagaggcgccagcttggggtaaccttttggggaaggagggctcaaaaagaggaacaatgaaacagaactaaggtgagttctcctgtgcccagtttcagaggtcaaggagagtagtagatagctcaaacccaactcagccattgagtgagtgttttcattttgttccttggggtctatgatattttctattttcttttctttccttttgttttggtttgtttgtttgtttggttggttggttggttggttggttttagagacagggtttccctctgtcacccaggctggaatgcagtagtgtgatcacatcacactgcagcttctaactcatgggttcaagccatcctcctgcctcagcctcctgagtagctgggactccaggtgcacgccaccatggccggctaattgtttattttttatagagacagggtttcactatgttggccaggatgttcaacaacttctgccttcaagcgatcttccctcctgggcctccccaagtgctgagtttacaagcatcagccaccacacccagcctatgacattttcttcattatggctggtactgcctcatgaaaagggggttcctcatgctggatctgaacaacccagcacaggcaagtctggggagcaaggcaggagcctgcatgtggactcaaaggaccggcacccgaaacaaagcagtggctggcacaggtggacaaaccaggcaagaaaagcaactgtccttcggagcagagtccacgtgatgggaagaaacagacacagtctcactctgttgcccaggctgaagtcaacggcatgatctcagctcactgcaacctccacctcctgggttcaagcaattctcgtgcctcagcctcccaagtagcttggattacagtaaaagctgccaaggtcctcttcaacgtgatggcgtaaatccagctctttctgcaagaaggctcaccagccttcccaccagctcttctccccaccccagccctgcagccctgcagcctgaccctaggtaatgagtggtggggagtgacccaggcatgcacgacctgcccagaggaaagggagttcaaagaaggacccgagaccctcacaggaacctagcagattggcacaagtgccagatgtatccaggacagacactttccccaggactccaggggtaaaggagtgccccacctctccactccttgcctttcttaactgaattcagattgtcgtgaacattcaagaaaagcattgtggctg

SEQ ID NO: 1498 - DNA, 364 bp, Homo sapiens
attaagaactcttaaaagccaaaaggtaaatgaaagcagaacccacagataggcattgaagtcagcttccattcagacgtcattggccaaaccagtattgagtcatcactggtaagtagcagctcagccagagattacatctccccatcacacatccctcacatctgtatggaacaacaggactaattctcagtcatagaaggtgaatacaaaagattcccaggtcccagaggatggtggagcttcaagaagaaagtagccttggtccctaaattatcacatggagaaaaggggcactcccaccagaaacacctaaattggactattatatgattgagaaataaacttttattatgttaagcta

SEQ ID NO: 1499 - DNA, 863 bp, Homo sapiens
ccaaacctgagactgggtgactcttgcctaggctcacagatcgagccttcccagtgttgcactgggaccctagggtggccctggggtgcccaagagatgcgcaagcatctcgcgccttccaagcgatcagcgaggaaaaacggggtccaaattcgagtagaatctgcgggttgcgggaagatggcctgcgagtgcggtgggggacaataccctagggccccgtgcgccctcgctttcccggggcactctcaccatttgtagcctctgccgcgcttgaacttgagggtgagcgcagtctccaggaagagcaagaggttgagcagcgcaagcagccagtaccgcggctccttcttcacctcggtcactcgccagaccccgaccagcgagtgcagcaggaacagcaaccgagtggccagggcgttaaggaagaccagtccctccatgctggccggagcactctgcctacgtccccttgcctgcgcccccaggaccctgccgggcgtgcccggagcccaccggtgagcaggaatatgacaagcactgagacctgctgctgcttgtggtcccttctcaccctcagcgcccgatgccggtagaactggtgcgcggctcgcccctcccccaaacttcctgagaactcttcaaagagggttgtgatttgaagagtaaccttcttcagaaaactgtggagacttcacagaaatggcagaagctagttgaagtctacaaattacctaatggaacaggtgttattcccatgagattcccaaataaacttcctgcatgcaaatctccatctcagcatctgtttccctgaggaggaaccaacctaaaatgaattgcaaattaaaatctcagtgggt

SEQ ID NO: 1500 - DNA, 219 bp, Homo sapiens
ctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtctggcttaccacacgctcctccccattcccagtga

SEQ ID NO: 1501 - DNA, 525 bp, Homo sapiens
attttcatcaactgcaaacttggatgctggatcttcctactagagctcactgattgcccagggttgaggtacaagaattatgaagatggcaaagtggatgctaagaacaattagtggatgctaagaaaattagtgattcatcaaagtcaaaccaacagaacatgacagcaaatgacaggattggaactcagtcctggaactcgggttgattgattgcaggaaaagtgctctaaatgatgagaacttttctactcccggcctgatataatgctaagcaataaaaagaagctaatgtcttaataaagccaatatagtcaggtgtattgcaagtgtcagaaaaattctgatacaaagtaagtgctcaataaatatttacttaatgaaataatcaactggagataaaggcagtggaagaaaatcagaaatggcttaatatatgaggcaatgcctggaagataaataagaattttgacaagaagggatgatcttcctaactcatctagctcatttcagatgattactttt

SEQ ID NO: 1502 - DNA, 1064 bp, Homo sapiens
gtggtgagcccggaggaggacttgcgttcggcccgctggtcccagtgtgtccggaattggtgggttcttggtctcactgacttcaagaatgaagctgcggaccctcgctatgatgatatggaagaaaagcactctttggcctgttgtgactgggacagttgacagcacccaggtgtcctttaatgaaaatgctcttgacaccaatgcatcctagcatcacagcttcaggaagccttctcaagtgtgcatggggagtactatgtctttcatcaataatgaaatcttctgatttgtaagacatgctgccaagagatgtgccattctattataaaagatcagtagcttcctttaccgacgtgtatattctatctagaacattgagctatggaagactcccacctaagggaattagttttacaccttcagataaagactgctgagaagagcaccctctggtgttgtcacagaggcaagtgctaccgcacaggcatgctgcagtgaatttaactgatcctctgtccctgcaaccgttgtttaaggatgctattctgaaaagactgtggaggaagaaaaccctttaccctgttgttcagggagaaactgacaccactcaactgcctggcactgaaaatgtggcatccagtccactttaccatcagtgtttaaggaaaccatctctgataaggatgactgaggaagagtactctttggcttgttgacaccagcacagctgacacacccagatatctgtttggtctcctgtgaactttcaaccaggatttaaggatgccactctggttaaaagctgaaacaacttcaaggaaacttcagggaaaagagaaggcctggaatctgatcctccacttcagagaacaggggtcagcttactgtatgattaagtaacacaaggcacagtagccatctttttcattatgttgcaacactgatcacgtgcctcgataaaatggctgattcaacaagatgatggcaacacgaaggggagactttggattgtctatttaaaatctaggtaataagtaagtaattaataaaaactctatctt

SEQ ID NO: 1503 - DNA, 440 bp, Homo sapiens
agaatggcctgctccagatgggaagtttatctgcctggatcctgaaacgaagacgacatatggatcaggaactgagtcactgacagactacagctgacttacaacttaagtgctttcaactgttttaaaactctacaaggtgtggggctgcagatcggaccggatactggggctcggcgtggatgggtctttcatccattcgtcggattcccacaggcttgatggcatcaggctccacagtgtcaggctgctgcagctggctcaagtcatagtcctgcaaaaagacaaaatcaaaaaccgatgggagatgggcacaaagatagaaaattacaacctcgctttttaagcacatactcagaacacatagaaatgaggaaaatttaacataatggaaaagttgccactatgagtttttcatgttatgattaaatatttctttc

SEQ ID NO: 1504 - DNA, 737 bp, Homo sapiens
ttgctgcccttcctcttccccagggcacagaaacactctccactgcggccaaggattgcaggagaggtggcatcagtgattcaagacttcttttcctacctcttcagtgtttctttcagtgatctgaagttaaagccagggggaatatcacagaagtgaagtgcaattctcatcatgtcatatcaagagcacacactaacaaacaacatgacttattgctgaatattgaacttgatcacctggctgaggtgaataaactgacactggaacattcaggaacttcttcatggtcatggtcacccagctagagtgtggaagccaggctgtctgattccaggatctgtgttcttaatcctatacataaggaagccataatgagtcaaccactatttttaagattcacagatgttcgggtccaattcaccagaatgccaagttatacagggttgtggaatcaaaaactgcaattagtaataaaatgtgatgctatctagaatgtttttcatacatatatatgcttcttgggactctccctgcaggttaagagaaattgagaaacgatggagaatttaagtgttttagatcctacatacattagacttaaaaatagtaactatgtacatgagtatttgtaaacttaagaatgaacataacatgaaccatgtggcacctataaaatgaaaataaaatacctacaaaccaaatgagagcaataaaagaagctttaaggactttca

SEQ ID NO: 1505 - DNA, 2916 bp, Homo sapiens
cagccttcatgaagagcccatggcaactctgtgggaatccttccagcagcccgcttatggctggagacagaggtgtggcttctatctaagcttttccctctgactcagtccaggaggcaactgtcttgggaagcaaatgataacagcatctgggagattctcttctggatggactagcagggaatcaggacatgaactcagtggactaactgcaccgagactcacctggtcattacttgaaggtcattacttaaacctccatgaatctcctgatgaactccctcagaaggtggaaggagcacctgacaccgacccgagatcagcagcagctacgcccacgctgtgggcagttaagaggcagccagtggtaccagtcgtgagcgatcagatttgaggactcaggattctggtttcctgagtgtcatggacctgcgggctgcagaaatgacagcgacaggtcttcaggcaggtgccacagcacccacacactgccagcattttgtgcaaaatacccaaagccacatcaccagatctgggctctcctagcttccctttgctaaaatgctggccaaagagcttaacgagccactcaggggcacaagataggtgaaacctgcatgttttgtttgttaaactatttgccacatggcacaagaaaataacaaaaaataaacaaaaggaataactgcagcatcatggttttgttaagatgtcccaaagctgatcagggcttcctgttgaaatctaaatgagactcttcctaggtggcttacattcagtcagctgtggctctgtgcaaagaaaaccagtttcccttgctcagaaatttggagccactgataagagaagaaaagtgtgattccacatggagggtcatgatacaatctgatctctgaccccgtggaggtgaaggggcttgttctgcatgccaggctgaggactctcgggactgaggcattcagagtcgcagctttaaatcataagggttccctgcccatttcatcacaagtcagcagcatccaaagagtggcgttgaagaaaatctcatcaccgtgggctcagtttagattgctagtcggctcagaaagctacctgcaattgcgtttccaggatgcaccacaaatactctccacatgagggagaacatcagtggatgaaactcagcatgcttagtgcggggccaagtcctctaacaaaggacacagcggttaacctgcatttcgaggacaggcactgtcaagccctcatcagggatccatccagagaactttggtaattcttgcaaaatccctgtatcacacaatttccttccttaatgtgatgaagtgtaacggacacatctataaagcttcttcagtcctgcaatgcatagatgagcagaaggccacaaagccaggtcatagcactctctaccatcagaatggagcctgcctgaatgtgagctcagtgagaggcagattccattcttgggcccgtccacggtgacttgtctgctctgctccatcatccacttattcacaagttctggggcaacaaagggcacgttttgtttcatcttgtgccaaaccctcgatgtgtactcactcactctacctcatctcaagaacttcagggctgggagtgcatttggagagaaggcatgtgcaatatctggaagccttagcacaggtgggttatactgatgctctatagccaaactataggaacttgggttctaaggccagcaggcccaggtgtcaccccaatggctcccttcaacagcagcataaataagtcatgtcagaagaactcacattagccatctccaggactcatttccctctcaacagcaggagctcctgcagtcagaacagcggtaattttcaaatcaggcatgtggtgatgcagcaggaaagtgcctgcatcccaggtgtcccagcagctttctggagacctctaatacccacatctgcaccacaaaactgcacagcattgagtgataccaatcttcttatacatataggtaagtggtaatagaatgcctcaacagcagaccacccaggaaccaaagacatactggattttcaagtcagaagaatgcttagagatcatctgacccaatagccatattttacagtaagatgcagaagccagtgtccacagtgctaaagccactggtccaaggtgaaagaatttcaaacccataaatacctccaagaagcttccactgggaccctatgattttagtaaaattatcaacattcatgacctatgtctactgatcttagcgtcttctcagtaggcaattattctttctcacatcaatttgcagttgctatattatcagcatccttggtaaatccatcttgtgttctgggtgaagactaacagattcttccttcttggactctgtcattcactctcatccctcataacatctggccactgctctaaacacagtggcctttgagaaatgctgctgaattctgactaagaaagaggagaactttcaaatacaagaaagtgaacattatagagcttaccactcaagatggttttctacaaatgcggacatggggctgatctgcaccgtgtaagtatcatttgccgagtactcaaagagtccatagtaagggttgaagagctcctgagacagaaggaagaagaactcccgcgaggggccactgtagtccaggctgcaaagaaagcagaggtccaggaagctcattctgtgcccggaggtggggggacctgtttgcacccagattctagtgtgccctttcagagttgggtgctggggaaagcagagagcagcctctgctctttggagtgaatgccaatggcagcatcaatttgctgtagaaaatgaggatgcagtaattggtttggagatgtttcttaaccagatgtccatgaataaactcttatggcagcttt

SEQ ID NO: 1506 - DNA, 77 bp, Homo sapiens
aaccaatgatgtaatgattctgccaaatgaaatataatgatatcactgtaaaaccgttccattttgattctgaggtt

SEQ ID NO: 1507 - DNA, 1965 bp, Homo sapiens
tttttttttaatgtgagaagcagaatgtgcttctagaaactggttttaaagagatgagctgagaaagaaatgtggaatggagtatatttgaggaggacaaaacataacttcacttttgaacagaaatcactctagcttgccagcatgggatgtaaaccaagagagtagaaatatacccatcttattttaagttgggtttatggcatcgctcatatatgtaaaagcactacaaactctttaaagaaaattgggaaactacagagaagtcaaagaaaaaaaaaagtaacccatatttctattgcccaggtataatccttgttaatattttggtttggtctcctcttttttcccccaatatagttgtaaataaatgatgtctttcagagttgacatttatcctgtagcttgaatggcatgtaaatgccagttgtatattttttcatgaagtgtaggtttggaatacactagagttagctatatgcttgaatgctgatcactggattctgagactgactactgagtctacctttttaatcaagcctaacatgaatgggctccaaaaagtaatgaatgtaattgtactttttgatgtgcctctgcacttggcttggtgagtcatcataaatagctgttaaatatgtgactttacagattttgatatgttcagattgtaaaaaatgaatagtttatttcattaattgatgggcagtcaagaatctccctcccttcagtagggctgacacttaggagttaggtcatggttgtggttacttggcatggctaatcagattttgttctggtcagaatttgcccaagatcaatacccagcagaaactggagttaggctataaaaaaccattcatgtttccgagtgatcatttcagtcagcgattcatgttttacagtgtttagttgttgattattagaaaaagtaatattttcttccctttatgattacatcattataaatcaagtccttccatgaacacatttaaggtgtgtggagatgagatctctgaatccatttggggatgggctgcatttttggggaactctatgcctgtccagtgaagagtgcctaaaacattaattatagatcaaagatgttctgttgagggacaaagcttgatggtcatcaaacacaaggctttgtaaaaatacgaccacctattccacttactggatctgtcaggtgtgtaaaacttctctcgccagttcatcatgcttccatgagccctcaggactgggatttgagccttcctggctctttatcccttggggcagacatggaaccatctctgagggaccaggtggatgctgaagctcacccagtcagggcccctctcctagctccttttacactgaaattaatctgaaagctttcatagccaaggctttgcctaggtgctattattccagctggccaaagagaagtcttgggccagattgggattctcaatggattttatagacataattcccctgcaaacttaaaaaaataaataacccctactttataggactaattgtttgaattgtatctttctctgtatgttaaaccagatttaaaactattttataaccacaatatgtaatcagagcaatatagtgttttcagatatataccttgttttataccttatgtaggtgtcctacataagggtggcatgcccactggctgtggtaaaatttaatcctcattgctttgggagtgacttaaggccttttgaagtggagcttttgcactttatactttttctgtgaactatgataactatatttgatattaaagctgtaagtggcattttcagcaaatgaatatgtacatgtttgtgtctatttccaaaatgatttctgaactatctgcagtgaaaatgtatctgatggattgtagagcaaagcacattgcctaaattcatttgttaatgaattgggtaccattgttattaaaaatgcgtaaagtaa

SEQ ID NO: 1508 - DNA, 2078 bp, Homo sapiens
gcaatgcgcacgcgcagtggctttgaaggcggggcaacaaagcctgtggccgatgtggcgctcctcggcccgcgcttcagtggttatgacagtgttcgctctaaggggagaaggaatgtgtgaccatttccaacggttaacttgcattccccagatagtttggatgagttacaacctaaatctgcaaactcaatacagccagaccctgggaagtgactctctccaagcctcctgtacaagtcccaggaaaagagcctgttttcccttggacatgtgagcagtgaattactgctcattcagaatttcatgtgtatgtgttactgatggccaggtttagagataccaacctatttatttctagaggagaggtgatttgataaccttttcagatatcactatcagtaggcagaaaagggttaatagtatgatagggttaatatgtcctgaggagagtaaagaaattgcaaactgcagaagcacctgatctgtggccctggccagcatctctccatatcctgattctgtaagatcaagtgtttatgcagaaagagaagggactgatgatttgaatgtgaccagatgcagggcatgcccttattgccatgccagcatttgctattcatgatgttagtattcaaaaatcaagaaacacccttcctgggccattggtgtctactaatccattggaagaaaagactggaatccaccacttactagcttcttgggcctcagtcccctcttttctgccatagctaaggaccacctaacctagatggctgttgttattgttcaaagggacatctttagagcctcaagcccaggaatagcccgtggcaggcacctggtaaatgttagttttcattgtcctatcccaacactatgaaacatgcagcactctctgcaactgcccctgtggatttccataggcaggagagtatccagtgttgagtggagctggtattctcagaaacgaagcccctttcctcattttgcgccaatctcttcagtcatttttaccctagtagtataatgctttgtcaaagtcactgtcatctgatgttaacagttgttttcgccagatgacttttcaaaaggtaacttcaccataataccggttaatgtgataaaaacactgcatgtagccaattttttttttttttgagatggagttattggctcttgttgcccaggctagagtgcagcggcgtgatcttggctcactgcaacctccatctcgtgggttcaggtaattctcctgcctcagcctcccgagtggctgggattacaggcacacgccaccatgcccagctaatttttttgtatttttagtagagtcggggtttcactatatgttggccaggctggtctcgaactcctgacctcaggtgatccgcctgcctcagccttccaaagtgctggggttacaggtgtgagccactgcacccagccaaatattttcttatttatttatttattttagagacaggatgccattatgttgcctagtttggaatgcagtgtctatttagaggcgtgatcatggcatactatagcctcggctcaaaggaccctggtctcaaaggaccctgccaccttagcctcctgagtagctgggacaagtgtgcgccaccacacctggctaattttttaaattttttgtagagatagtgtctcgctatgttgcccacgctggtctggaattcctggactcaaggcctcttcctgccctcagacttccaaagtgttaggattacagggtgagtcaccacgcccagccagtgtgaattttctaatgctgagtaagttgtgatccagaagtaaatgtatctgcaagctgatttaaattgtagattttctcttcattgcatattttctgatgttgaataaagtctgagtattaactaaagtttttgcttcttaaatatgtaagaattgtcctcaaaatctctattcttgagcacagtagtaaaaatatttttacatacattgtatttcaagggttctgcataagcaaccttgttttattgtgacaatttatttgggaattgtatcaaatatataatactgagatgttctca

SEQ ID NO: 1509 - DNA, 568 bp, Homo sapiens
gcacttgcagtcagaactccgggcccctcggggcgtgactgcccagctgtgtcacccggagcagctcatgctgcttctaagctcagcttccttgttggcaaagggccctactgtgtggcacacgccgtgcacgtcaggacaagcacaacgcatggcgcacaccacctgctgggagaggcaattgtgcactctacagccacagggacaggacacagcgcggtgagcccacccggtccaggagcgctgggaaagggccccaggagaggcagcagagctgagacaggacgacgaccaggagcgaccaggaaggggaggaggagagtgctctgggcagaggggacagcgtgtacaaaggcccggagtctcagtgtgccacattgaggtgtcacgcgccacactccatggcatccacgctacagatgccaaaggccacgggaaagcgagttcgccattctgctgaggtgggcaggctactattccccgggacgtggctgacacccctcacctgccccgatgtgcagctgaagagacccctcgtccggccttggcctcaggggagggacgatgt

SEQ ID NO: 1510 - DNA, 334 bp, Homo sapiens
cctctgcccagtcttcaacccccgcctttggagtccgtggaggaaaagagcagaaacaggagcccagagaccattccagactcaccagactgggatccccagggacaggacacttagggaagagcagagaggacatggcctggtcaggtaaaaaggtaaggatgaagaagacagtggtccaaggtgactcccaatgcctgaatcacatggctgcttcctgctgccacaatccactggcccactgacttgtaggggaagtaaacaggagcccctgagatcatcttaattcagaaatcttcaaatgtttctactaaatgagattaaaaaaaataaa

SEQ ID NO: 1511 - DNA, 5339 bp, Homo sapiens
agttccggtccggcagagatcgcggagagacgcagaacgcagcccgctcctccagggccctccaggccctccggccccgggccggcgggtgaactggggggccccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaaaccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgta

SEQ ID NO: 1512 - DNA, 620 bp, Homo sapiens
cctcttggaagctcctgtctgtgaagggtgtgcacagagagcttcggtagcctgcgaagcagccattttcacttccacggagcagatgctggcctgggtgctggaatatggaaatgaggaagatcctgcctgaggatttcatgacagtgctgcgattaccgacgtgagccactgtgcccagcctcactttaaaaaaaaaaaaaggttatgaagcatctcaacacaagacctcctttgctcatcacaaccacccagtgaagcaggcaagacaacagaaactccccacctgtgatagatgtgaggcctgaagtctcccacatacccacggcagatgcaacgcacagcggtgaccaatggtagggataacaagtattgcttccgcccattcagtacttcttgcatgccagatctgtgctaagtgctagatgaacacagtctcttttcattctcatagctctttaaaacaggtattgttttcttttaaaacaaattgttttgttaaatataaatatcatgtaccttatatatatattatatataaaaatacatgtaatttaccattttaaccatttcaaaatgtccagttcaggagcattaagtacagtcacattgttgtgcta

SEQ ID NO: 1513 - DNA, 3514 bp, Homo sapiens
acttagatatgcagctgaaggggttcctgggtttatttctcctgagaactggcatgggctctgagttttgccattcctggcttcggtcctagcattctaagctgcctgaccttgggcatttgtcaacctgtctgaaccttagtatcctttcctctctgtagagtgggaagagatggagtctgtgaagcgcctggtgcaagctgtactaatacacctaacaatgagctcctccctccctgcctccttgcctccctgcctccctccctcccatggggaggccagaatctggctgcttgctgccacctagtggctctttggggtcatcttccctcataggaaccacagatccagtagcctagagcagaaagggaaggaagattcaacctaggggtgtttatgtttaccgtgtgtctggcactcgtggagatagtgcatgggactacataagtaagacagcatcgaagaggtgtcttggagtgtggttaggagcgagggctctggagtcagacaagctacagactagctgagtgaccttggggcaagttatttcatttcactgtgcctcagtttccccatctgtaaaatttgtataacgataacctacctcgcgtatctacagtgcctagcatagtgccccacataaatgtgttcactaaatgtacgtcgttattaatcataggagcttgcagtctcactagggccgactggaaaactattaagtgatcctcaaagccacaggcgctcagagactggagagatcaaggtgcagaagactcagggaagggtagtcttgagggcagctgcccttaaagggtgggcagcatttagtgaagcagatggagggaagttgaccggcatcccagatgtggggaagaggccagcagcctagtctcctccacggcccagcccccactgtcttaccaaagaacagctttaaccaaacccctctgggcatcaggaccaccgctacacctcttgccaggctgcagagctatgcagtctggaggcccagctctcgtcagaagctggggcatgggctctaggggaacctggggtcggatgagcccctgagcaggtggcaggtgcctacatgtcccagtgtgggttcgtgtttgtgtaaggctctcctgcccccacccccaggcaccagcacagcctttgccttcactctctcccctcccctgtccctgggggattgaataagggaagctggggttggccgtccttctagcttgattggcagcaccagcgctgtgacggaaggatgtgttgtgccagcagcctcttggccgcaggacaaatgcacatttaaagagataacctttttgtgtcctggctgggaaagaggtcagtgcagatgtttttgggtccaggtgttggctgtgagttttcctttcctctatgaactgacctcagcagcctagtggacagtcacctccttacaggtgtaaaatccaagccagtcaaccatagcaggtggcagacttagctgccttccctgtggtgtggtgcagaccatgacccttgaggcaaatgggtgagctggccccacctcgcctgcagcctcctctgaggctcccctgctgcctccccactagccgccctgaatcacctacttcccagcacccccagcccgtggttctcatcccgtcttccatctgtgatctggcactcattcttccagagccaaagaggaatcccctcttctcatgcagaagacagtcatgcctgcccttgtgtgtcaaaagcattgcatttatgccctgttagaacccctgtcacaagcatggtgcctgaacacaggtgcctctgtggtctcttctcatcctcacccaatgggtactatgctagccccattttacagatgaggcaaacgtggcacggagagctccactaacttgcctggatgattcatgcatccatccattcacttagcaaatacttatttaacttctgctttgtgctagctagtggggatgtggcagtggggatgtggcagtggggatgtggcagtggggatgtggcagtgggaatgtggcagtggggatgtggcagtgaggaagacgacagacaggctccttgggaagcagagtaagcaagtgaggagacaggcgggcgtggtgaggctgcgcaggcgctgagatcgagttgctgggggaggcctctctgaggtggtggggcttgagttgattctgaaggacaagaagagccagccctgggggtctgggggaatggtattccaagtggagggaacagcaggtgctgggggcagggaggtgacagatgtgtcccaggtacagagaacagagtgaacaggagagaggagggggccagggcattccaggtggggaaaggcagcaggtggcccggtggtaccacctcttttggcgagggctttggaccttacccggtgtgatgggaagtcctggaagtgtgttaagcaggggagtctttttgatcagattttctagaaaacgacagtgggctgctgtggacctcagagaggcatgtgtgatagtgtgtttcgggctcttcccacgaaactcggctctgcacagtgagacctcatttcctggttctgtttgatgagtgagcgaatgcacatggcaggcggtcatgtcccttgggcctgtgaggtgaggaagggtccctgagccctgtggggatagagactcttccaccattctgacatgatccgagttagcaggcagcactgtccagatggaaatggggatgggagacagaccatctctctcagcgggtccagccatgagccagcagactgtttcccattggcccccatctttcagagtgggatgatctttctaacaaagaaacccacacaggaatttggtgtgtgtgtgcgtgtgtgtattacctttcaggatggaagccggtggggtgtggagcgaggggctggcatggttggcctcgcccagctcctgtaccctgtgtgtgcctagagcatgcacctgctccctctgctgggctgagactcagaggacactgggcaggtggtggggggtaggagggtcgtggctgtgttgggtggggccacatcaggtgtgtggcacagagggggagggggagggggagtggcagtgtgttccacccagcagtccctgtgtttgacctcttcgtacactctctgttgtattagctctcagaatgaaaacgagatacttttccccaatctatgtacgttgttcttaagaatgtacacttggccaggtgcagtggctcacgcctgtaatcccagcactttgggaggccaatgtgggtggatcacctgaggtcaggagttcaagaccagcctggccaacatggcgaaaccccatctctactaaaaatacaaaaatcacctgggtgtggtggtgggcacctgtaatcccagctactagggagactgaggcaggagaattgcttgaacccaggaggtggaggttgcagtgagccgagaccgcgccactgcactccagcctgggcaacaagaacgaaactctgtctcccaaag

SEQ ID NO: 1514 - DNA, 652 bp, Homo sapiens
cgccgccggcgccctccatggtgaatcggtccccgcgatgtcttcacggcgggcggcccccaggctcgctccggcctaagcgctggctccctccacacgcggagaagagaaggaaagactacagttcaactgtcaattggttgatcacccggattttatctacaccttagcctatggttgttcatctcgtctctgcctatggcccattgactcccggatcccagctccattcttcggtactttacgcaccctgcttccagtaccccaaccagaagaatatatatagcagttaactgtcagctggcgaaaaggaggaaaattcaggaagataaaatagctgaatgaattatccccgctccagaacgcagaggaaaaatgaaatggccagacccagatgttaaaaatgtgttccttgctctttcctgccctagcaagggctgttccatgtttaggggatgaatgccgctgagagtattagcaaaaatacatgtgtcattgagtctgaggaagataactgagacatacaggtatttctcataatgcatgtgggcatccatagacatattcttaaatggcttaaggacttggaaactacctctaggaaacctgaaacttgaatgttggtccactagggagaagaaatgttccatta

SEQ ID NO: 1515 - DNA, 1000 bp, Homo sapiens
gcctgattgtcctctcctttccttaccttcagcaccaagaagtttccggtcccggtacagatcagtgaggaagaggctattgacaagtgtggatttgcccaggccagactctcctgagaggagagaggacagaggcaccaaatcagaagggacccttctctgggctgtctgatagtctgcagagacacagctgcttccgtgctctaggagagagggactccttggagatctgatctcactagtagtcgtaattctttggatgggctcagtttgtactgcttcatcctttgggtaagacaaaatcctacggggaactctgactccttgggggttctggaccttggatggtgggtcatcttctaagatttgtgattgtaagttattcttctggtcttgaaaactcaactgatgagtagatttggcatctgggattgatgaagcatgatggccgacctcgcgccctgacttgctctcactgcctcttcgtgctgcttcctctctgggtggactaactttccattgtctgcttgaagcatgggaagccagtgtctgagtcttctggctctttagatggggagaggaatggcgggatgattctgttcttggtccagtctcgggtccccgaggagtgggtactgcatagtgtccaggtcctgactggagggagacagatcgagggtagtctgatgctgaatggggagtggtgggatgtgcagcttctgatcttcggtgggaagggttcagggagactgcagcacttcgatggcttgaggcaagaacgtacccatgtccctgctgaggggatgtgttagtagtaacctcagaccctctctgtgctgaaaccgctaccttggccccaggtttatttgtcttgaccatctgatagattgtgcccttctgagtagatcccgtattttactggctggcttgtattcaggatcctaatgatgcctgaatatttaccctgttttaaagctgctgtttcttgggctcccacaaa

SEQ ID NO: 1516 - DNA, 656 bp, Homo sapiens
caaatcaatcttgtcactcctcggaaagcaatgcaagataataagtagtattcacctgattgctttcctgctccgagacagctggtgacgcatgtcttcctgataaccaggagtttcagatctaaggcagggataaagggaaactggaagctctcggaatctaaatgtgacagtcgatggctgaggagagggtcagaaggaatagaatctgtgacacgtatgagaaaggaacaaaatttatctgctctggttgcaatgattagatgtctctttgtctggctttccttgcagtgggtgactgatcgtacccgccagctggctaatgtcataattaacaaagttgctactacatctgcaaagtttaatcgaaaaatttgccagtgatatgatggccttgtcacagagatcacaagggacacggagttgacttttgctcaaggtggaacgacagagctgtgtaggcaagatgagaaattgcgaacttgttcggccaaaggaggctaataatgaaggggccgggaaggaggccagtgctaccagggttatctcacaacctcagatgctggataagtcgacggaggcagaatcgctttgggatgacattcagaaagcctggagtgattacttgcaagagaaaagcctacctattctttcca

SEQ ID NO: 1517 - DNA, 3192 bp, Homo sapiens
aggtggggaaatggtcaaagagcgatgggcccagaaaagggtcagacccagatggagatgccactggctgctagcagacccccacgctgggtctagcccacccaatcccatggggatgctcctgtgctctgcagacatctgggtgctgccacaggggcccgacagagttggcatctgggtggatctgagccaagtggtgcttctgggcctcagcaagtagctggtgctgattctgggcagccaactgtggcagcatcttcaggtgcgagtgctgctgggtgaagctgcgtgggcagtccagaaagtgacgtgacagtccacagggaccgacgtagggtttccagcccctatctgtgcagatgctgtcctccaaaccatcacggtccctctctggctggggacgtgcgcctgccactgctggcttgccagcatgatcattggttgtgacctgttgagcccatcttgccagcctcacaaaggacagtactagctgcttatgacaggaaagtggaagaacttggcctggatatttctggagaattaccgtgtgtgctagtcagtctttcgtgtcaaccaggccaggctgtggggcccagtgatctcatcgagaggggccgaggtgttgctgtgatcgtgtgctgctggaatgtggtgaacacctacagtcgatttcacctaaagatcatccttgagaatgtgggtgggcctcatcctatcagctgaaagctttaagagcaaaacccgaggtgtcccagagagggaattctgccttgagacggcggcttcccactcccactggatgtccagcccgcggccccacggctgggtgagcccgtcctctcctcgtttctgtctccggacccaccgtgtggccccagaccctccagtgaggacctcccgtatttcttcagagcagcccttgcgtgctggaggcctgggcttcagtgtgtccctgggtgccctggggcatgttctgtgacctcccagctcctcgcctcatggggccgctgtatcaagtgacacagtttgtgtgctgcgtaccatgcctggcacccatttgaggtgttgcaaggaggccatgtttgctcgatgagagcagcctaagatctacaaactgttgttcgagtggatgggaacttgatgctattttcaggctgaatgacaagactccgcgatgcttctcggcctgggctgcacaacggaatctaccagggaggttttaaaaacactggtacttgctggaggtggtggcgcctgtctgtaattgcagctgctccagaggctgaggcggaggattgcttgagcccaagagtttcggtttatttgctttttcagagtcttgctcttgcccaggctggagtgcagttccatgatctcggctcactgcctcagcctcccaagtagctgggattacaggtgcatacaaccaggcctggctgatcttcgtatttttagtagagatggggtttcaccatgatggtcaggctggtcaagatctcctgacctcaagtgatctgcccgcctcggcctcccaaagtgctgggattacagacatgaaccacaacacctgccgagcccaggtgttttgaatccagcacgggcaatggcaagaccctgtcccaacaaacaaaaaaacactggtgcctgaggcccaccccgagagattctgattgagttgatttggatttgaattatctttaaaattttggatgtgaattttttttttttttcttggaatggagtttcactcttgttccccaggctggagtgcaacgggacgatcttggctcaccgcaacctccgcctactgggttcaagccattctcctgcctcagcttcccaagtagctgggattacaggcatgtgctaccatgcccagctaattttgtatttttagtagagacagggtttctccatgttgctcaggctggtcttgaactcctgacctcaggtgatccgcccgcctcggactcccaaagtgctgggattacaggcatgagccaccatgcctggccggatgtgaattatcttaaaaattttcaggtaattctaatgggccaaggttgagaacccctgctctgggcccatccgagcaccaggctgtcacaaacgcatgcatgcactcacgcccgtgggcttggggggcttcggaaatgtgcttctgcttttttgagatggggtctttctgttgcccatcccggagcacagtggcacgatcacagctcactgcagcctcgacctcctgggctcaggtgatcctcccgcctcagcctcctgagtgtctgcttctggttttcatgatgacctggggcccaggcatactacacttgtgctgttcaggggccagtcctgcaccaggagcccatcagccacagctccgccgagaagcactgatatgcagagctaagcagctttgtttccacgtggatcctgcgtaggttttcttggtccatccgtagacaccgcactcctgcagaggatcttctcgggatgccccactgtctctgttttccctcttcactgaacactcagtcggggctcgccatgatgcctctgtgtctgctggcttctcccccattggaacagccttcttggcacgccacactgctagctgctgggcactgtgctttctgcctttaccgttctgccgtgatgttgccaaaatagcagcaacaacaacaacaacaaaggctgggcacctggctcatgcctgtattcccagcagttcgagatcagcctgggcaacatgccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcgaaagca

SEQ ID NO: 1518 - DNA, 2017 bp, Homo sapiens
ggtttcaccctgttagccaggatggtctcgatctcctcacctcgtgatctgcccgcctcagcctcccaaagagctgggattacaggcatgagccactgcgcctggccttgttttactttttaaaatttctgtgagctgctctagaaaactaaaggacgaaaactttactgtcataattccaagttcagtcagggatttctcagaattgaggtgtgcagcatccagattcccctttatgtggatagggatccctgtgccatgtcttgcacttacctaagaactataggaattctccatgtacctcctacagtttttctagcagtgttggacaatggattctaaaggttcctgagactttgttaaatttctcataattccagagggaaggccaaaatattgagaatactcaatgataggatgagtttccactctacttccttatcctcaaggcacacaccagagttccactgggtgaggacagggaagtaggatgtcccaacaccctctgagggttttcatgcattaatcccgccatatgggctgatggttggaactgcctttagttctctaagtaaaggtctaaaaatgcacctgtggtttctgaacttgggtatacgctgatacataaggactaccatagaagttacatgccttaatcctgtaatacttttgtgtggtatcattctgctaatatattgtccacagggccaaaccccaagttacacagcgcaacagtacttgtcaaccactccatctcctcagtgacacaggtgctaaagtacctctcccctgaggcaaagtcccgacacatctgtgattgaatgcaactatagaagtattagcataaaaatatgtggcctggaaggaatctctgaagatactgaagaacctcaagttccctacattgctaggagccaagggaaggagacactgtacacctagagcgctgaattagcagctgaggttttagtatttgaaagcaaataatataaagcgagtaatgtctacagtgggtctcagttaccatttggctacttatttaggactcgattaacttggcaacttttacaaaaaacattcacatcacaacatgcaacttaaaaaacagttaatgtaactatgccactgtcagcaaggccagcttgcataccagagttaagaatgagagtgtctgtctgcctagggcttaacattcaaagatatttataatctgtgttttaaggttaaattttatatgacccagttttccttctttgttcactatacactaaaattaaacgcctctacgctgtgcaagaaatcactatgtgtgattttactatttcaaccaatccatagaccctgaggatttggcagcagaattcaggagaaatgctacctaaagtgattgagctgttgctaattctaccttctgttccactcaagtacctccagggactaacaagggaaggcaagggcaactgtgactgactaggtaaccagctattctgttgtgacagaagaaaccaggtaatacttgattttcaaaagataattttaactgctgccctatactacttttagtatagtttggcttgaccttaatagccatgtccctcatcttagatagaataaccaaattggtttaaaattacttgatctatgtcactgaaacctgaaatatgccatcactaagagaacccccaaataaaaaataaagaactaaaaaacacaaccaaaccaaatcaaaccaaaaacctcattctctgtatcatactttaaaactaaaataaaaatccctgtgtcacaggtgcttgctcagggctgccaacttctatttttcacctgagagacatctaaaagcgcaaactatgcttgtaaaaaccaaaaagtaaatctctacataggacaatacttataagcagacctattgataccacttatatataattagtctgttttctttagaaagtatcagagcagaaacgtctttggttaattctttcctctacatgcaaaataaaatattcttaaacga

SEQ ID NO: 1519 - DNA, 943 bp, Homo sapiens
agaggtggttgggtcctgagagctctgcccttatgaatggattagtatcattattgcaggagtggcttcatgatggagagagtggatttgtcatgaaagtgagttcggccattccttgctgtctcacgtgccacctcttgccatgggatgccctcgccatgggatgacagcaagaaggcccttgcttgagtgagcccctccatcttcggctctccggcctccaggactgttagaaatacatctctgttctttgtaaattacccaggctgtagtactctgttatagcaacacaaaacagactaagacactactatgtagatgaagaaacaggcccaagaggtgaggagtgttgtccaggtcttctggccagaggagcggcagagatgggatttcaaccctgggactgtgtggcttgtgaccactcctagcttcagccctgcccggtgctgaggggtttggggccagaacgatggccagatgtttgggcacactgggccctacccacctggaaagaggctggcctggggttgaatgagaaccagaagtgactcaggctaggacccctctgcaccctccctcaggccgtgggtaattacctgcccaggttaatagcgcccacttcccgccacctttcatcaaggctcctggagctgccaggcagtaattaaccctcacagcacccttctgaagtcagcactggaggcagacgtgtgatgaaacacgtttattacaggaagcaccagttagcccagatgcttctcatctttggagttgagctgcaggctggagacctggaaggccctcgcagcgcctgctcccatcctctcacctcacgaaagcgcaggaatgtgggtttggagccaatgaaaagtactggaatctggctctgctctgtgaccctggacaagtcactgcccctctctgggcttcagtttcctccttg

SEQ ID NO: 1520 - DNA, 588 bp, Homo sapiens
aatgggtttttgtttatctgtattttattcagagttccttggtttgaacctggtgtcctgttccaggcatccagccaggatactacattatgtttagtcattgtgtgttcttaggctcctcttggctgtactagtttcttagaatttcctcgtttttgattgtctggacatgatgatcttgacagttttgaggaaaagtggtcaggtattttgtagaatgtccctcatatgataaaaagttttttagttctttgtgcatttcttgcccccactaacacaaaatagactgtgaaagtgccattattaaagatacattaaagtatgagagaaagataaattcttataagaatctgggaaggcttttcatcacaagtaatgttgtccatgaagtaattagttgtgtttgtgatagaatagggggtgtcacgtgaaaatcaagagtgcaggtcatgttctagtaacagactaatagaattgcaatgtgatgcgagtaaggtgcaattagaagtaacagtgttaaagtttggcaggggcctgagagcttttttccctcctgacaccaaataaatggtatcttttccaacaaca

SEQ ID NO: 1521 - DNA, 448 bp, Homo sapiens
aaagtatctccagggagaaaggagatttgcacccatgatcatctgaaggtagatacagttatacacaagatgaatggattaaccactggaagacctgcactactacaaatgttaaagaaagtccttccaagaaagaaaaaaggcaacttaatggaaacttgtgtctaccaaatggaaagaagagcaatgggaatcctaactacggtacactgaagaacacttttgcagctgactaacaactcttgatattgagaaagttatcagaattatttgcaaatctcctctcagatttgcaaaggatgctggcatttctccatgaggcaggtatacaagcaacattttgtgaaattgtttgtctgacaaaattgtgtgaaattttccagaattaaaacagcatgtaaaatttaacttctataactttctttaaaataaaggaaaactgaatgtg

SEQ ID NO: 1522 - DNA, 358 bp, Homo sapiens
ggataatgcaagtgtttaacagatgcttcactattaaaatattttccccccaagtctcaaatattgaagaatctctaaccagaaggcacagatcattcatggggatgtataaccgaaaccagtcctctccaccgcctggggatcttcactttcgcagtctacgactgcctgtgactccagaaagacaaactgcagattggccaagatggattaagctggaataataaagtatatctatgagatgatttctgtaaactctgacttgctgagaaaaaagtgaaaaagctttttctggaagaaacatggcaacttaaccgttattaatctggactaaataaaacaggaaactgcttcttta

SEQ ID NO: 1523 - DNA, 901 bp, Homo sapiens
acagccaagagggaggccgggccaggggctggtggcttcctccgcgagctctgccagtttctggcctcaggtcctgagttgttatcgcaagtccaggaagaatgaggttactcaggcaactggagggtgaggatggagaagagctttattgagcaacagaacagctctcagcagagaggagacccaaagtgggtagctcctacctgcaggaaggtttctgaagggggccaagatggcccaataggaacagctccagtctgcagctcccagaaagaccaacgcagaaggcagatgatgaattagagcggttgttatcgaatctgccaccagagggcgatccaggctgaagatctctctctctgcggaagccagccaccgctctccaaggactctcgagcagctccatctacagattcacatggagaagaattaagggttcctgccaatcaccagcaccactttgccagccttgtaagtgggccaccttggaattggagcctccagttcctactgacatctgactgcaacatcatgagagaccctgagtttgaaccacccagctgagctgcttctgagctaacccactgaaaccgtgaaagtacctgaatgaaacaacacccagtagccactagcacacctagctcccagatctgtttttgatgccattcttcagtaaaaggaagcaaggctgcttggagaaattgctatcaaggactggggtagaaaatatacaagatgaaattggagcatcttgtagtgcttgaaaacagttggcatctgtgtgaagatgtgaatggaggaggcagagtaggcagtgagtgccgcagccacagcttgtgttctctgcagccctggcacagaagataggaacactcatgggggatgcggccactgtgatgtc

SEQ ID NO: 1524 - DNA, 454 bp, Homo sapiens
agttaaaacctaaatgagcaacaaacgaggtgacgtgcgttatcagttttgtcttccatgtcttcctcatcctgctgtttgctccacggctcttgacaggatggagacgaggaaagaacttccacatccacattcaaaacgtctgccagaactccctcaggcgattactttaaaacatgaaagaaattgcaccttttccttaagggcaagatggtgctgtgggctttcctctctcctgatgagatgatgcaaatggactccatagagaaacgctgcccgtgtaacaatgcagttacgcaacccggtgcatgacacatgaattgcagcgcacctgagatcctgatgaaatcctgggagcctggagctgtcaaacatggttttaaaaaataaagggaatacacccagcccacaccctgactttacaacctttaattaattagaggaaagaaagaga

SEQ ID NO: 1525 - DNA, 3946 bp, Homo sapiens
gggagccggtgtgtccaggacacccttgcggagtgtctgctggagggagccagtgtgtcagtgagatggctatgcccctgggctgctgtgtcccaggtttcctcagtctctaaccctttgttctcacaggggatggactcttgcttcttttcccaactccaccaagagggaccgtcccaggacgtccttccccgggcatctggccctacagctgcctgaggtctccatcaccgttggcgccatcagtctgctgtgcagccagctgttggtttggagagcctgaagaactgcagttcacgtctcatctaaaggagctgaaatgatattgcagctttttcttttggttgcgtgcagtgagaatctgggagctgaacctgttatctgcatggtcttcagaaatcaggcaaactcggaaaatgccaacgccaaaaatgctgatgggtgacaaagtgtcacaggtgtgatgcattacaaatctcaggacttttgttcactggatttgaaaggtcaagcttcacaggaaaatgatgaagtcccaaaagaccagaaatatatttcagaagatgccagttactactttaaatgtcaaaccaacatttcagaaataactttcaatgattatttcctgccaagaaggtgaacgctggagaccttaatggtggaagatggagggcgtctttccttctgttaagctgacaacttggcttccatcttgtgaggacctcaccctacctggtggcagaggacgtctgacgccctcaatcattgccgttacacttcccagcctggtggtcagtctcctggggtctgtgtgttaacaaaccatcgactggacaatcgcagttttccttatgaaggcttactttaaaaaggctctggattttcagaagcgaagtcgctttcatccccgattcagacccatcctagtggaggaaaaatcctaccagaagaagggctgaccataggaacttgccatttccttgaccccatcatatctgaggaaaaaacaacagaaaaggtcaaaacccacgtgtacgcccaacgtcctgattgacgactttgcctgcagcttctgctttcctgaaattcgctgctgcctttagaacccttgtctgcagccagtggggagttcaggacttaggcggagctgccccaccctcctgcttggcaccctgcaaatacatgccctcccttccatcgctgcagacctcagagtgggcgtccggtctcctgtgcgggatgagaatacacaccctcccttccatcgctgcagaccttagagtggatgtccggtctcctgtatgggatgagaatacacgccttcccttccatcgctgcagagtggacgtctggtctcctgtgtgggataatacacgccctcctttcaatcgctgcagacctcagagtggacgtccggtctcctgtgtgggataatacacgccctcctttcaatcgctgcggacctcagagtggatgtccggtctcctgtatgggatgagatacactccttcccttccactgctgcagacctcagagtggacgtccggtctcctgtgtgggatgagatacactccttcccttccactgctgcagacctcagagtggacgtccggtctcctttgtgggatgagaatacactccttcccttccatcactgcagacctcagagtggacgtccggtctcctgtgcgggacaagaatacactccttcccttccatcactgcagacctcagagtggacgtccagtctcctgtgcgggatgagatacactccttcccttccatcgctgcagacctcagagtggacgtccagtctctctgtgcgggccaagtgtacacagttttgttccgtcacaacttccacgacaggccagtgtgaggtttttgagctggtgctgactgaaaactgtcagctgcccaaggacctgggagctctgctccccactcctggtgtgcggtcttgcgcctggcctccctgcctaggttacatgcagtggtcatcccggtcgctcccacacccgtgtgggctctgggatcccctcttccagccagcccaggggacatctggctgtctcaggacccagccatctgtaaaaattaggcaggtcccttcagtatgctcctggtcaacaaagaaaaacttcaattttgagaatggcatctgtattccgaagtgttctctcagatgtttgagttccactaagtagattttcttagtctgctgtatcaatgacacagagagacgtgcattaaaacctcaaccatgtggatctatttcttttcagttaattttgcttcatgtatcttgaagctctgttatcaggtgcatgcacatttgggattgttatgctttcctgatgaactgaccttctttcattatgcaaggggaagaagatgctgcatacaggatggaatatccaggggaagacgtctaaggagagatgcccagctgggagtcctatgcaaggggaagaagatgctgcatacaggatgggatatccaggggaagatttctaagaagagatgcccagctgggagtcctatgcaaggggaagaagatgctgcatacaggatgggatatccaggggaagatttctaaggagagacacccggctggaagtcaagatatgtcagttgtttccattataataaaaccactcatgttagatgagctgaactttcccttttccccagttcttacgatcaaaaagtggctgtcctaaatttcatcactcaatatccttgctagagtcttcctttgtcagccaggctggagtgcaatgtgcaatggcacaatcttggctcactgcaacctctgtctcctgggctcaagcaattcttctgcctcagcctcctgagtagctgggattacagggcgctgggtgcccttccagggtgacctcacgggtgcccactgcagttcctgcttctccccacgggaactgagcgtgccgctgggaacacagcactcactgtgcacagttctgcacatggacttatgtggacaccacctgcttgcattcatcccctcctcctcatctctcccttgctgagaggcagcgtgcctgccgaacgcttcgtgctgtttctgcaatgctcacttgcggtcacatagttagacatccggatgatggatagatgaggagacacagtgcagactgggcgtggctgaccaccacacgtgcccctggagccatgggccgccggcttcatttccagggtggtgttacaatcaaaagaatgaacacatcaagagtgatttcaagtccaaccccttccctgtgttttctgcacagcttggaggccgtgcccaggtcctggatgttcctggtgacctttcctctttgccctttgctctcccacttggagctccatgctactccctcctgttgtactgaacctggccctcgttgccccttacgagggaagtccttgtcctctcatggcttccttcttgtccccttccctcagactcttcgtaataattatacaatactaattccaaatggaaactggaggcatggagcctatgccggcgtctccagcttctccagaggtaggaatggacactcaggtctccactgcatgctggtggatttgggagagtgtgatccatccaagccatgcgaaaatctgcacgactgagtcatgggacagtggagctttgtgatatcgcgtgcttttaaatccgaaaggacagtcatgatttaaggatttgaaagtcacacatttaacatctggattcacagtcataggtcttaaaccatgatagcttgtgcttctgaggtgcactgaattcatgcgtggctttcctagactttatcccatggaaccttcacgtgtcaggctatgtagagccctgaatctcaaagggagagcttggtcccagcaggtctcattattttgtattatattttaatagtttattttccctcttgcttcttca

SEQ ID NO: 1526 - DNA, 381 bp, Homo sapiens
acaggctgtgtctgtggctgccctggcttagggctctggctggcccctcctttccgacctggtctggcagagcagccccgcaggaccagctcgcaaggctcctggggccagtggggctctgtcctgtgaggcggtccctccgcaaggacagagtcagagagaggctgaaaccaggtcctgaaaaacatcacagaaactacagctggaaatttcctgttgaccctgatagactactacttgacaccagccgaccgatctgctggctgcccaccatggtcctgccacaattctgatgggacagagaattggccttactttctttcctgataaatagccatagacctcaagccagccagttttggccagcttatagagactgta

SEQ ID NO: 1527 - DNA, 2798 bp, Homo sapiens
gggtcgtgagaaaatacgcaggaagagataccccgtggacatgtttcccttggaaagtggagggaaccctctgagccgtgattccgcctgaattaagcagtggcgggcactggcctggcaggcggcttctactgccttggatttgcacctctaaggggtcacaggggccacccccgaaacaagacaaagtgtgatcatggacaggccctcggggggccggaagaaggaacggctccagtgatgaaagctgaacgccagctctctccccatcgttctcccggaccaggagagggctgctcggcagggctaggtttaaaaaccttccatgcaacttacgaaggcatccacagtgacttctgctgctgtggtacgttctgccctcccctcctccccgccccatcctgttctcggctacaagttatttatatgtacagtgtcatctgaacgtgcacgggcctatcccaggacatcacacacaaagaggcggcggtgaacccaagccgccgggccggcctgtggctcagtgtgtgtttcagaagtcccggccccaggcagctctcctgaacagagccactggaactcaggagggtcaggaccacagcccaaacaactgcgaccgaaaacaccctacagggcttgagaactaaaaaataaggagggatctgggcagccgagctgcctcctaaagaagccacgtcatagagaaaactgcttgctctatccatgagacggaggcggccggggtgtcctgccagcagacacgggtctgtccatcaccggccaccacgctgcctctgtccttcactcccatttaagggaaaacgatatctcttcatctttctgccctggacattggaaatcagcggtgagaacagtgctcttgctacaaaatgctcaggttctagaatgctcccatctttccttccattccacatggagtttatccaaagcacaaaggccagtcacggcactgacatccgtggtgcccgctcaccggggagtgggaagcacaagcctgtcctcagaggaccgtgactgtgagcccgcagctgcttgtgggtggggccagcccgcagctcctcctggaggcctcgggcttcttgctgctgcatttctgtgacatgtggagggaggatcgttttgacacctgcctgggaagtttcaaaggagatggcctctgggcaggggttttaaactgaagggcaccacacagatccagatgtgaactgtggctgttgtttgcaattgaagcagagatgcagaggatggaacaggagtgctggccatgctgctctatggccttggcccagccaagacctgcagtcaatggggctacgggacccccgctacacagggacctgggaaccacctttgccgcggttgaccgctgggcccgccatgcaccgcccacacctggctgtgcctggagactgagagcagggggtgacggtgggcctggaagagtctctcccttttgcaaacgccagccacagaggtttatttttctccctgagagaaggaagagtgaaggctgagactgagacagaaggacagaaggagaagacttagaagccagtgagcccggaaccacgagacgcgctctgaggacacggggcctcggggaaaccgggcacgggcaggggttggtcttggcttccccgcaacattgccgcgagctcgggtgccgtctccactcgcaggctggcctgtcctctgcagccacgagctcaggcaccgtctccgttcataggccagcctgttctctgcagcctgaggtccctgtggtgccaacatccagatgctgagataattctgccagggtgttggctgatcggtgattggtggttggctgttccgtgagttctgcattgatcttgctggctgagcgtccaatgcggaggggcaggtgctgttagggtctccactcccatccctctccccaggactcatcacccactgcaaccgtaagctgctaggggctcacagccgtgagtctttgggacgggtggtcccacctggcatgtagctcaggctcctagccccaggaccctgccgctgctcccctcccgcccacatcttggcttagccgtcttccctggctgccagccccttcccctggtcttagttggcttgagccactaaactgaaatagcacaccctgaggccttcaacagcagacctgatttctcaccatctggaggctggaggtccaggatccaggcccccaaggctgctttctcccccactcccccacccaccttccaggacacgcagactccaccctcttgctgccctgtctcagggctgtccctctgggcaagcaggcccctggcatccccgtgtgtcttctcctcctgttcttataaggacaccagtcatactggatctgggcccaccctagtgacctcatttaccttaatcacctctgaaagaccttgtctcaaaaacagccacattctggggcactgagggttagggctttaacatgggaatttgagggatgcaattcaccccataaaacccagaccattcccccagtaaatcactttcacaagagctcttctctcaggctttgcttctgggggatcccccttgagatggatccatctagcttcctgcttctcaaagaacagaggggagagctctggtgcgaagggaacgggtggcctcggggacctgcggataagctgctggcactgccaggggacaggctgagctgaaagccaggaggagggcggcgaggcccggggccggacctcattcttctgagtgttataaaatctggctttgctcagaaa

SEQ ID NO: 1528 - DNA, 492 bp, Homo sapiens
acgccacggggccaggcagttgagggcagctagggtgtcagacttgcccagagggacgtgggctgcagcaagtggaaagagaatcatagcagccactggctttgcagccacacggaccaaagttcaaatcccagtaactcacgctctggcagtgtgatcttgagtatcacgaacacctctgagcctcggtgtcctcatgaaatggggagaagagttgaggttctcgtagtgatcagcgagctgatgtctgtgcaggcctagcacagggactggcacacagggactctgatcaggggagggaaagcagtgagagagcatagcttcccagagagctctgaaggggtcgggggaccaaaggggaaagaaaatcacaagctctctttgggactacctgtagggtgagccaggtttcatgagcaaggaaaacctccacttcatttccagtctctccataaagcctgatgttcctccttttgtgttcctctgggttat

SEQ ID NO: 1529 - DNA, 476 bp, Homo sapiens
aaagaagaaggtgataaaggaaaacagacgatagtggttcctatcaagatcttagagaaagagaacattaagggagacaaattggagtgatatccaactaatcagaagctggatgtagctgaaggacttcttgttctaatttatctggctgtgtcttcactgagcggaagtatgctgactgttttacatgtggtagctacaaaaatctcataaaatgtagagcaggatgcctagaggaaactgaggctgagaaagatgcaataacttgctgaatatcacagaaacaatacgtgattcaaagactcacatacagccctcttcatgattgcagaatctcaactttcaactatactgattctccacaatgatgcatttctcgttgtaatttaatataactctacaaggagaacatggaatgggaaaaatctgaccaacattgcataatatgataaaaataactcatgattaccttaaaa

SEQ ID NO: 1530 - DNA, 278 bp, Homo sapiens
gggaaagctgtctgagacaatatgaaaatcaatgatgccactctagcattagctgaagatccccttgatttcatccagcagccaagacactaagtgacccaaaggaagaaaagggtgatcagcgtggctgtgtgcctactcagcgcgaagacaacaaggatgaaaacctttatgatgatccacttccacttaatgaatagtaaatatattttatctttctttataattttttaaataacgttttctctagcttattgtaacaatacagtgtataatgc

SEQ ID NO: 1531 - DNA, 626 bp, Homo sapiens
cagggcctacctgtgcatccacatctggccctttggaaacatgcaatcccatcaactgggtggaccaatcttatcttgccaggagtaactaattgtgggtatctgtcgccatacaagcatatcagcattgccctttcccctagttttgcagccagtatttaacatctccttccgcctccttccatgcagggggagcagaggcacaaataaacttgcccaatatagcttaaggtgctaccttactttcaaggaccagcagtatatcacatgtacagcccacacacgctgaattaaaccatccaaatctccagagacctgtttgcaaatactgcaaaaacccttcgacataaggcctctacttcaccactaatcaccaaagctgccttgctgaatacagtaagtctgcatgatgaccactgtcacagacaatggcagtccacaggaggactgcctttcagctatgctttacaacttgcaagagtggcaaatctttgcaaaagcactttcactcaacccaaatattgcttatttagaatccaacatcatgatctacccaaacaagtggcccgttctccctttcttggttaaacggatgaagaaataaaaatgccattttcatttgtaaa

SEQ ID NO: 1532 - DNA, 487 bp, Homo sapiens
ggctgaaagcaatgatgttgccattcatcctttcacgtattcattatggtctacagctgagaagggctatttggggtttgctttgcctgatggtagcagaagaaaaccaagaggcctctctacgaaagcttgcagtaaggagaaagttctggagactgggaagagcaacacaaagatattcagttgcttggtgagagctgctctctgcttccaaggcggcaccttgttgctgcattctccaatgggaaggaacgctgggtcctcacatgacagaaggtggaaagggtgggtcctaatccactgtaacagctgtccttatatgaaaaagaagaagacagatacctgtgaaaggcagatcctgagaagacacagggagaaggcagccatccacaagccaaggaaagaaggctctaaagaaattaaccctgccaacaacttagtctctgatgtttagcctccagactagtgacagaataaatttctattg

SEQ ID NO: 1533 - DNA, 682 bp, Homo sapiens
tctcgaactcctgacctcaggcgatccgcctgcctcggcttcccaaagtgctgggattacaagtgtgagccactgtgcccggtcggggtctgctttctctttattccccgtcctctcacaaactacatccaggggcggtagctgctaaaaggactcaattctgcaacctcagcttctgacaccttcaaataaattaaatgctggtcctagggctcgctccccagctcttctgatgtcactgccaggttccacagccagttgtcggacatctcctgcttcctcagccaagaacacctctcagatgagatcaaaccgcccagctttcctcttagcatcttcctttattttccacttctggctggtggaagagagatcgtagttctctattccctacattttaactccacgaatattttagattaagtgaagtcttgctgttcttcctgatggaaatggtaattataaacatacaaagatacccatacacacattctttactcagggccctcttgtgctttggcaaatgataaaaattatctctaactcacacaacgaccctggaagatctggacaatgctatcactatttcacagctgagagatcgggagcatttaaagccacagaaggaatagattggcttcgcttcatattgtttccttgtgaaataaaaccagtgaaacac

SEQ ID NO: 1534 - DNA, 3265 bp, Homo sapiens
agggaagaacctggctgagacgcacctgcaactgtttggagctggtgaccttgggcccagcacaccctcgctgctggtggacacagcccctcacaagcagctgcgaggccctcgggcagtggcatgggcgccgtcgcttcctgctaaccccacatcctcatttcccacgcttctccttccaccttccatgatcactgggacctactgcctcaggaaccgcctcagagggacagagggaagcagaccacccttttcttcagagagttcatggcccagggagggaacgctggctggggacgatcacaaagcctctctggtgcccggccagcgacagggaccctcggggctgcggggggagaggacgcccctgccctggccgcacagggttgggttagaggtgagctggggccggagaagccacgggagccatgtggcgccttctcaggaggtgctcccgcagcttcgcctcctctcgtcttccgtgcgcagggagggaccagcccagtgacagctgggagcaaaactggtcacctcccctcgggctctgggcaactgtcaacctgcagctttgagtctctccccctggaatcttctatctggggtatgataatgttattacatacgttggttatttacagcacaacatgaaaaggcaatttgtaaggactggtccgtctaatcggggcgaatcaccagtcttctgaggcatcgtattgagtttagtttccgactgattgctaaatgccttcacgctgcgtggatattgcccagctctgcctcccttgctgcaggtgccctgtggatgctgagcttccacggaggggctgctgccccctctgcccccacagctcagctcgagttcaccagtggggaaggccgagggcctgtggaacgagggctccgttcccccaccgcaaggagtgaacggcaccgaggttcccgccgccgagccgcagcgctgtgcaagcccccgatgggcgacggacaccaggccccagcccaacgcgcttcctttggctcctcctgaactggggggggggcctcgcacccgccttgccagggccctggcatctgtctcactggcctttctcacctggtattccagtgaggagggtgcttcagttttactccctttgagaggcaagatcttctcaacccacaagaagaggcgaccaggtcctgggtgactgtcgaataagcctggtccaactgggaacaagtcttctgggccctaatttcccacatggtgttcttgtctgacaaaatcacagccttccacgttcaagaatcttcattcatctctctctttcagcgaatgttccctaagctctcccatcactgagcactgctgccaacagcccagctgcatgctaccactttggtttgatggagagaagggctcagaacctcgtgcaagtgggaggcaagcacaagtacaaaggcatcttccggagccaaggtgggggcgcagagggcctgtctcagtgagatcccactgtcttccagggtttgccaccgcagcagtaagccctggagtggccccacaccctaagatccacgggggaaaaggtggatgtctcagcatgggtttgtaacattgttctcttaaataagcagaggatgcagaattaggagcaagcattccgaggggtggccagctgtggcttccgaggggcacctgacctcccatctgccttctgagcaccagctgccccaggtgaggtgtgtggagttccacagctacgatgagccgtcgccatggagaacagcagctcacgattgctttgatttaaattgaattaaggtgaaaatgaatcagggcataactctcttctttcagccagacgtctttctgaaccggtgtatatatgacttaaaaaagtcacgagggttttgggcccagggatcaggcaggaaggaaaggcagtgccgtgcaaggaggggtgggttagaaattgtatccagaaccgctgtggcttgtactgaaggaagaaacttcgtagttctgcttctatttctaccacaacaccaaggaaggtgtgtggggtggggagcaggtacacacaggtccttggtattaccagtggtccaggattgtataattccgcttattctacccatcccacagcctgaccctgactcaagtcctgcagccccttggtgccctgagccccctcccctgcctgttcctaagcaatcaatcaccctaagaccccgttctaggtttcagcagatgatgacgagttaatcagacaaataagccatggggtaggcaggggttgtgggtgctgcttcctggtccctctggcaaaccagaagggagctgcctccctgcggtccccaccctgtctccaagcttcccagcagagccccacatccagcaactgggcccagctttaaccagacggaggagcagcctgacgtcctgccagccccagagacagatgtgggcacaggaagggaaggcagggaggagaggaagccaataaaaagtgttagcatccgtcagggtgaccctttgcagaacctgcgtcagcctgaggacgcagggaaaggctgcgcgggagaagccgctgttagcatctgccagggtgaccctttacagaaactgcgtcagcctgaggacgcagggacaggctgtgcggagaagccgctgttagcatccgtcagggtgaccctttacagaaactgcgtcagcctgaggacgcagggacaggctgtgcggagaagccgctggcctttgccgcttgaaagctgggtccctgcggcctcctcaccccagggctccctcagagaaattctcatagaacccctaagcaatacgcggggaaagaacggatgccacccggaagcatgccgaggaagagtccattcatgggaacttccagagccggtcacagaggccagatccacgatcaggtgcatggcaggggcttgtccgcaggaccggaaccttgtggaagatactacattcaacacagacgtactgtgtgcctcctgcgtgtgaggcctggtgctcatggcgcgtgtccttgcatgcaaaattctactcttcatcttgacgtttctagacattcagctgttcctcaggaaacgatttaccttccctctgccttttctgtaaaatgcatggactgaggaattactaatgcataacactttgtttgctggataccaagtagacgcactcttaccatatacagggctgtatctaggcagccagttattagaataaaaacagaatactatgttcatccgctcagat

SEQ ID NO: 1535 - DNA, 1517 bp, Homo sapiens
ggaggagcagaggcggaaggtcccggcggcggcgaggatgcgccccagggcgggagcgggacgctccactttaccctggctgcccgcaacgggccaggcctgccgtctctacctctctacctgtgagttttttccctgcatttacttcagtctgccgcgtcttctccccgcccttctctgtaaggtaaatatgtggaggaaataattcctattaaaggtaaaggaaaggagagcaatttgaatgaagaaacaggtagttgctatcgtcgttttcagccaaagccctctggctgctagagagtatacatggttctctggtgtcaaggcctgttttccataagctttctggattctcagcttagttccctcaaagtgatctctgcaagtcggctcttcggtcagaagacctcctccaaaaacagaaagcccaaagattccctaactcgattgaaaagataggaagatacgaagaaaaactaacctaaagaattgtgtggtttatctgcaaagagttctagactaaaagccaacaatgcaaagatagtatgagttaatatgtttgttgtggctctcttctgccattcccgcttcctcaaggtaatgtgccccgatgcctggtagaactgttttgtagaggcagccaatagtgatccagttattgtctttactggtcagaccacctctgaagtgctgtgttcagcatttgaagactttaatcaagctggcattatatcagggaagagcaaaatgatgacgagaactcaaaaacagggcaagtgaagaaggattgattaaaccttccaggactcacctagaagagagaaaactactggactctctccaaatatgaaatgacctatcatgtgaagttgatttgtttcatgtgatgcaaacttcagggaacagatttaagatcctgaaaagaagatgcccttgtagcacgacccaaagaattgcctaccttagcatgtgtgaatacctcaaccacagaattttgcttcaaggagattctgaagctcacttaatagggacttggtacaggggagccacacatcaacagaataattagttgatggttttgttaaagatatttccagtcttgagattacatgtgtctttggtcctggacttcatagagtttacaagttagttcatgagacaagacaaatgcatcacaaaaataaataatgcaaggaggccaagtgataatgagaggtgctgataagtgctaggaattcacatgacagattattcccatcacagttccagaggcttaagggagaagagaggaactgaaaatagactacctagaactgccctatccattggggtagccaccagttaaatacgtctcttgacatttgaaatgtggcttgtccaaactgagacatgcaatgagtccaaaatgtacaccagatttcaaagacttagaaaacaaatgtaaaatattgtaattcttatgtcgattacatgttgaaataatatataatggatcaaataaaatatgttaaaattaa

SEQ ID NO: 1536 - DNA, 3088 bp, Homo sapiens
taaagctggaaagatctaaataacccaacaggaaatgcggatgaaagtgcaagagttggtttgtggtcatctggagtccatgtctccaagactgctggaccttcaaattctgcaacttgttagatcatctggatgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatctttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaat

SEQ ID NO: 1537 - DNA, 867 bp, Homo sapiens
cgctgaccaagtgccaggcctcactgaagctgacctccgcgttaaccctggacacaagccgagcaggaaggataatgccggcttgacaactccactggtttctgctcccactggccctacctctgttagaggtgttcgccaggcaccccatgcggtcaccagcagacagccgctttctgcacaagttccaagatggactcacagcagtccccgccagccatgacgctgagatgggtgtacacccagctctggaggaacccaaccgcctgtggtctctccacaacggctgcaaaatactgcttcagttttgattctttcatggaggaagacgtaacttcaagttaaaagcagcaggcgcaccgctcacccctggacgctgaggctagacactgggtggaaaccggttccttccggcccccgggccctgcaccagagctcgacccccaccgcctcacctgtcctgatggcgtcctccagcctggggtttctctctccctggagaagctggtggtagtagccgggattctggtccatctgcgcctgggccccactcagcaccatccagacgcgggcacggtgctccagcgggacccctttccggacatagcgcttcactgaaggccgagaggacggacagcgtgtgagctggaccaggggcctgcggggcccacgcgttcctgccacactttccactctcaccagttctcttcttaaatcaaatattaaagagacccagaacttcgtccatctccaccaaaactggtacatatactcctttaaaaattctgctctcctctccctctcaacagagcacaaaccagactggctacagaaccgcccccacgcccacttcaccattcaatgcag

SEQ ID NO: 1538 - DNA, 526 bp, Homo sapiens
gtgcagagctgtgcgtgcctgccgaggctgggcagcagacttcagactggagcttggggactcctccagagaaacagtaagatgagttacaagccgtgaacctgtctcagtaggactgtctagttacagggagctccatattaagagaaattggaagaaacctgtaatccaatcatgaagccggggatggtggggacatcattagagatgccacggtccagaggaaggacacatcggctgatacagctgaccacaggttggagcagtgcatctctggggaacatccatgaagaccaacagagaatgagaaggacagagcagcaaagggcacctgcagggatggaacagccaccaggagccagatgctttaactgaactgacttgagttgaaccctcacaacagacccgccatgcaggtacttattagataagagagccgaggaccaggaaggccaaatagctggcccaggttcccccaggtgccagcggtaggactgcaattctgctcgtcgaagccctctctctt

SEQ ID NO: 1539 - DNA, 820 bp, Homo sapiens
ctaggaaggctgacacatgatgagaagagtcagtggtcctgaggtacagtacttaagataaccctgtgaaggctgagattgatatttgaaattcacaactgatcttggagcctggtacagcagtcatggagccatattggattgtgaaaggaactcagttgacctggcctattgcagatttattctgagaatttcaattcagtctttgctgctgtttggaaatctttcatgaatcttttaataacttccttacatacatcttgttccattaaagccccaaatttggctttgtcagctctctttcttcataatctttaggatttgttcatgtgtggatgtgatggaactgaagtcgctaggttcatgctacctggaacatgagactgacaaatagaggagcactgagtcaaatgaatctcggagaaatggagctggaagaaaactggagtaagcctgtccctgaaagggcactacatttggatatccagcagtgggactcaatattttttcttgttgtttaatctcatttctgttacttgcagccaaaggctcttaatgagaaaatggctctacctagttttctgaaattgcctcagtctctccactcttccctattacaaaggtcatctctttaattcacatccaataactgatagtctcttgactaatctacatcctctcattctctcctaattcacctttcatactgttgccaggtgacttttcctaaaagacaactttcatgatgtcactctacttcataaattcttataatggtttctttttgcttttagtccaaactcctcaggttcgttttcaa

SEQ ID NO: 1540 - DNA, 548 bp, Homo sapiens
aggacttcccaagagtgtcccatggaacctgagttctaaggacggtacatgaaaaaaatcaacatgggttccatgatcaaagaagtttgggaaatgggctaaatgaaaggacttccaaggccttttatctgctaatgagaaagaacaagccctgtgaaaaacaagctgctgtccctgctagaggcatcctgcaatccatggatgtttatcaccaagccattgttaacatgaggtggtttccaaaaggaaaagctttgggagatagaagtcctcgttttgacctctgccctccttgtacaccaggagccagaaaaacttcatctcttttacaagaaacattgagattcctgtaaaattaagaaatcacacaatttgatggtctacattatctaaagcaaatgagacttctatttggaacaaagactaccttgttgggaaatgagtctgcaagttaaagtgttttctggcacctgtgcaattgtttcctactaccctgcgtgctgcttaagtctgatgaagacattcttctttggagtctgacattaggt

SEQ ID NO: 1541 - DNA, 540 bp, Homo sapiens
aaatatgacccaaaatccactcctcacttggacactgctctggttatgatggctgacaagaagatcctggtggttgctggcttgtcttcctctaataaggagcctgaatttagaaggtgatgatatgagaaaacaccaaatattcagaagccatccaggcctgctttggatgtcttttgggacaagagagcatgtgagggtatatccaggctgcaaatagcactgaagatgtcatctctgtggctgttctacgttctacttcactcccaaagaccatgaattacttcaaaatatgcctgatctgatttttttctaaagtactgggcagctgtgcaaacaatattaaaacagaaaaaatattttgtgccatgcactgccttgattgtacacgcccttaaaataggaaacatagactctttctaaaaaatacagttatatcaagacctgctttttaaatatccgtaatgtattattaccttttgtgtttctgttcagtaagtattacattcactgagagtgatttgaccaacaataaaaaca

SEQ ID NO: 1542 - DNA, 2044 bp, Homo sapiens
agaaactaaactggagcactggccatatggttgtgatcagcttaaagtattttcagaaatctgaggggaacatcacctgtgctttattggttattttgacaagtgaaatagaggacaaactgctttgatttgagttgatgtctacacatgtgaactcatgagaaacagcaaagcccacaatccacatggacatcatcatcgttcgggaacaggcatggtctccattctttccatgcacacgccccggcttcaaaaagacatctgaaacactagtgatgaccatcattaccccatctgtgagctccaggcacggcacagccctgcaaggtaaatgttattactgaaggtcagagaagttccgtaacttgcccagtcacatacctggcacggagctaagccaagcttcgagctcaagtcctcctgatgcgaaagttatttccactgaaccagcccaggcaaaatcctggtcgggtctgtgttactctttgctttcaaaacagatagccttgaggagatgtgtgtgtgtgttcatttaaaaaaatccagaaacgaccaaactctggcaactttctagaacatattttgtacctaaatgaatgtggctcagtattgcctttgtttagactttgaataaaattgaacaaatcattagaagccctatccacccaaaacagtaatctgcctaatttaagaagagatggagattttattcatgttatcactgttagaatgctgattgtggaagaaatgcattaagaataaattttgtgtggaaaacaccatggctgatattaaaagtagaattaccatatgattcagcaattgtacttttggatatatacccaaaagaattaaaagtaaggtctcgaagatatatttgtacatccacgttcattgaagaattattcaccatagccaaaaggcgagccacctcatagaggactgctcgtttggggaaaagctgcagaatgttttccatgacccaagagtcactgtctggctgggacaagagacctgaaggagtaggcgccagggagaggggaggagatccttggcctctctctgggaagatagttgctttttacatggtggctgccctgcccagggaggaggcattacgcccagaggggtggcaagttatcagtgacaagagagggaagagaaatacaatttctagaaaatttgccttttgggactgaccttcaagaaaaactgagagagaaatctccaaggtcaacaggaaagcaaagccactagatgtcaccacagccagtgctccggtcattaagtccccagatggaggaaagagcacatcagcatgcctgcacagacatggaaaagctggctaagacatgcacatgggtccaaggcactgcagaattccatttttcctacagttaatatttatggcacaaaaatgcaatagctacagtttaagactgattcattgacacgtgacacttgaaactgtccctctaaatgtggatattatccacatgttactggactaagcatccatgcaagacttggagaccttctgcaggcgcagcctgtccccccacaccctgctctatcggatcccacctcgcaaggtgaaggccgcattctctcaggacaacctggtctgctatatcccctgggaaccatttcgccttggctcctgccagatgctgccctttcccttcaggctggtgtagagtggacacctgaaagtgctccccatcccattcgggttggggcatgcagagatccaggttttgtcctaagaaacaaaagacagagtgccttccacaaagtgcctttgcctgcccagggctgcgttatctcggcatcattccctggggccatctgcactcagctccgcaacgtttctctcagcctacctttatgactgcacacacaagcattcctgagtgaatatgcgtgcagcagttcctaattctaaaaccttctaaaggaaactcttttccctgaagataaatattaacctatgctcacgttcttaagttttgtggtgtacaataactaaaaatactctgtaaac

SEQ ID NO: 1543 - DNA, 499 bp, Homo sapiens
ctgccagtttcgctcccggttagcccaggactttttatagcatagagttttaaagcaagggcttagaatcagacctgggtcaaaatcctgccttccaccttcaccaaggcagtgtgaccttgacgttcctacataagagattaaaatacgccaaattccagcgaaacagctgatgccagccagcttgaagacccctgccacagaagaagggaatcagcatgagaatacagcttcttcatctcgctgtcccatgacttcgccctgtactcttcagccaattaatgatctccacacttgggaccactctaaaacccttaagaacctgagactcaaagtcctcctggagacgaatttgaggtttcctcctatctgtgtttggtggccctatgattaaacctctttctcttctgcaacctggtgtcccagtgtattaacttgccatgggcatcagacaacaaacctatatatagtatcccaaatatggtgctccactttgaaa

SEQ ID NO: 1544 - DNA, 436 bp, Homo sapiens
ggaaggaaggaaggaaggaaggaaggaattagacagagattcacttttccactgttcctccaatgtctctgcccaccctttcttcttatattaattcataaagtatcatctctcctcacttctgctcacttcatcaagccccattccacaaggtgaccagtgttggctttagctttggatggctccttttggctcactgcttgattcaagcatcatcccagatctctgcatagctgtatcttcctatccctcaagttgaagcattatcgaaaggtccatattgcttgatctgagcatactgcaaagtgtcctaaaagccatatgggagatagacttcttcgcagctgcaaaggaaacatttgcagaacagaaaacaccagaaatcacaatacattcttagtcatagtaaaatggaacgcacgcgaaatattgaaaa

SEQ ID NO: 1545 - DNA, 2190 bp, Homo sapiens
gtcttatttcttaatatctgcaaccagctcagagccagggataagtcaagactccaccagcccatgtatggctgcccggctgcccccagccttgccctcagttcttccccgagggcatgtcctgttgagagccggtttcacctgtgcagtgtggcctgatggcccagcacccaggagctctgcgcaccctgccgccatgggccatccgtccccagacctcttcccacagggtcactgtggtccaccgtcctgccctcggggaatctcagcctccctctcacaggtgcacacatggggagcagccaaggatttctgcagaaaaattcactccagaggtcagcagctagaagcacaaatggagagtgagtgagcacgagcgcctcgtggactcagccctcccaggcccagaaccaagcgcccatggacacccctacacgggcagcaagggctggaaccggcagcctggtggacatccgccctgcagggctctccctcgcagagactgcagaagagggtgtgcagtgctcagcgcggaaggatgttctccctgcttttaaggagccgtgactattttgctcagcgtccctggcgtgcctttctctgtacaaaaaggagacttagaggcttccccatcccattaccacagctgggcggcttcttgcatgagggcaccttgctgaactaagtcaccccaagctaccctaggctccctgtgcactgagatgctgagtcctgaggtgccttccagcaccagtgaatgggactaaagtcttctgcagtgtcgcgaccgttctgaagtgagtattctgtggtcatttgttaccctctgtgaagcccaggaagcagggattcagggctgaccagggaccactttgttctctgcccatgcatggaaggtctgcacttgggccccaaagcctgagtaaagtttcaccgtgaacttcttccagcaggataaacagtagggttcagtactgagggtctccagtttaaaccctgattccactacaaaataaatgctagactgggccacatatttaagctgtgttttccttatgcttaaaatggcagtaagattccttccagaggccatgcagggagataatgcccacagaacgctcagagtggggcttggcagagacagggctagacaggggctgttatttagtgctggcatcttttattggtggcgatgttattttattttctatgattatgtaatttcctccttataatctcacccttgttgcttatcttaagagtgatgtttcaggagcaacagcatcaatgtagtgtttgatattctggacaatctaacacaagcaatttctaattcataatccactatttgtatttgttgattatttgtttataataaagaaagcaatgctttgtcagttttccacaatctgccaccaacctcagatatgctttcatgaagctcatcttcaattaaggcccgtgtgctttatttttgtgaaaaatggagatgtgaagacattctgtgctctgctaggctgtgtcctgagaaccccccttttaaaaaggttctcagtattgtaggtgtcacttttttccattataaatcacaaaatgtagtagccagttaacaagacacaggtgttgctcccctgaaagtgcctgcagaatggtgccgaggtcctctcctcacccatagctcttggcatgatttattcctgctgcacgccttccgggaggtccaccaggctcacgtctgtgtctgtggaggtgtgtgtgaacatgtgcacgtgagggtacatccagtcttctaccagctaatacgtcagagaccacataatgttaggctggaagagaccctaaaggttatataaaccaattcccttattttagagctgagaaatttcaggtgcaaagaagggagaggctataacatggtggcactagaataagactgccgggtttgaatcctggtgcaactacttattacctgtgtgatcttgggaaagtgacttaacctttctgggtcacagtttggatacctataaacggcagatattaacagtctctatttgtgtggatattttaacaataaaattaaatcattcacgtaaagaacttaaaagactctcagataggttgtggtgagctatgattgtaccactgcaccccagcctcctgtagcctgggcaaaggagcaagattgtctct

SEQ ID NO: 1546 - DNA, 498 bp, Homo sapiens
caaaccacataaccaaatgtgccaagataatcctgagctcactcattgtcagactttcaaagtggaaaaaataaacaacatcaatgtggtaaaatacctaagaagataatggctgtaaatctttgagaactgatgagagaaagactctaaagtttcaggaaaaatatatcaggaagcctgatatatcctgcaggaacaaggaaaaataaaaagaaacctatgcttactacatcatagcagaactgcaaaatggcaaaggcaaagagaagatcttaaaagtgctcagagcaaaaaagacagatcatcagaaaggaaagaagaaaattgattgacagttgaataacagcagcagtggacaccagaagatagttcaaatactttcaaagtgcttagaaaaaacaaaagccagtccaaaattgtgtatccagcaaaagtatctttcaagaataaggatgaggaccaagatgaggttaacagggatccacctgaaaaaactaa

SEQ ID NO: 1547 - DNA, 1071 bp, Homo sapiens
aggtgatagcggagcggctgggtaggaagcaattgttctcaaacttcactagccccgtcggcgcggacgcttgtcgagaatgcagattcctgggtactgccagatacgaattgagcataccacaaaaaagttctcattttgtgtcctcccatcccattctcctcactaaccaaaggctaggaattatctgtgaatgtaggaccactggatttgcagtcttcatctgacactgtggagagtttctaggaatgaaacagatatatggccttgggtcccctttttttttcttttttttttttttaatagagacgagcatctcactatgttgcctagggtagtcttgaactcctggcctcaagcaatccccacccgactccgcctctcgaagtgatgggattacaggcataaaccaccacgcctggccagaaggtgctttaacaccaaatctgaaaattgttcagaagagaaacattgagcatgaacaccatctgtgcgagtcatttacttattgcccctcacctctaaatctaccttctgtactcttcttccctgtaatgatggggctagttgtcctcaaactgtttctcagacttctttttaagcttgcttcctgttcagttctgccaataggggtcactagagagagactgggaggcagaaggagagaatatgcttcctgttttttctgttcttgttaatgttgcttacaggaccagcaatgcttcttcacctagagacacttctcccagcagtggcagtgccacttcagcttctttcagcactactggaatcagcctcagtgattccccctgtacccgctcagagattatccacagcagccagatggttctaccttccacaaagattgtggttgcaattctgggcttctaagttctggttacttcatatttttccttttgttcctccagccctagaggtggtagctgctttctgaagttattatttctagatgacttttggtttttcagcctttgtattttgcttttcagccctctaatgcctgtataaccaatttccctgtaataaataaatttcctccattgaaatacc

SEQ ID NO: 1548 - DNA, 1553 bp, Homo sapiens
ttcaagggactctcagatcatcaaacccacccagaatctgctcaattttcaagatttgcttataaatatttataatataaacactcaattgctatctgttttttaggttctcctctctctcccagaacagtggtaacaggaactcttgggggcttctccctgttcttgcagatgtggcaggatgtgttcctggggggctcccatgccagtccacaccctctgtggtgtaagcagggattggtaattaatgagatgctaaaccctccagaagtgagcgctcatgtcccagaaacacatcttccacctcagcagccagtgggaaaactagactttgtgtctgcatatttgttcttaaacacactcttctgcagtctaactctgctgaccactttccagtttgctcatatcagaatttcttcggttctaagatgcatattttctttttgtattctgacttgttagaaattagaatatgtcttgcagtcaataaaatctatgacaacatttttttttcttaatggttcctaaaactcctgtagttgatggtgtcttgcttaggtttaatgaaagagattttaatatatggcgtggttatgtggagttgtatctctatcagtattaatgggctcgggatgatttatattcaactgaacccccaaattcaacattttgtgttgaatatttattttatcagttattctttatcctgtactcattttggatacttactaaagtattgtatgtatttgttataataaaatggcttgccgtgtttgaacacactgtgtatctgacaatgttctaagacctaatttgatcttcatgacaactgcataaaatagttactattattctcaattcacaaatgagaaagtgagacacagagatgctaaggaattgcccaaagtcacacagctactgagtggcagagccagggtctgggcccagccagtgtggctccaggtgccgcccactcttgacgtgatacttaccgtcaatgctccttaccagttagggatgagctgattctcatatttttccaagatacattttaattttagctttatttgctgtatcatcatcatcagtatcatcatcatcatcagttttcttgttttaaaatagggtttggagtctcttcaaggctttctgttttggaaaagtaaaacttaaaaatctatagccatgtgaattatacttatggagaaaaagagtcttgttttattaacatcagacatctttgttcctactaattattttggagtaatgttcagtatcgggctaatgatcgatggatatcactcatccaattatgatgcatggattagaccacggccttaaactttgtacatagtgttgaataaattcatcttatttgcagtcttattgtcatctagctttgatacacttgccctttcatatgtctcttgtcactattctgtgtaagattataatcccaaataccactatatgtatttttcttcatattctattattgaacagtattaatgcttaatgttaatatataagtaatatatacattttaaaaatta

SEQ ID NO: 1549 - DNA, 2666 bp, Homo sapiens
aacctatggcttttgggggatacagttcagtccatagcagtggggaaaggatgtgactcagtctagagagactcaaggagggaatgcttagataggagcatggagggcgtgcctggtgaagggaacagtatggcacagcttcagaggcaagggtgagccagcagcaaggggctggctatggccggtacaaaaagcatgtgctcgtgggaaataggcaccaaagaaggcccagagaggtttaacaacttcctcagaatcacacagcttccaaatggttgggttgggtttacatttaggcggtcttgctccagagccagtgctcctaacctttgcaagccacgaacctcaagaaagtggagaaggaaacgctgggaaatctggaagtcagacatgcctagtttatctcccgggagctgacttcatttctaaacgtataggggtttcttagaggagcttcagaatactaatcatcgctagtgagggcacttggacactttgcttcacctcagccagcacctcttttcccagctgtaaaatggtatgataataagcacccctaggaatctcaaggatgttacgagggaaaaatatgcaataatatacaaagcactttgagcttctctgaagacagacgcatataaatggaaggtggtattataaggtggggtaatcactggttacctcccccccttttttatttaattaggagaaaaccagtaattaggaagcatggccttgttaaagctgtggcctgggaaatagttctcttggcacctaatcagaactgtgacatggcgcaaatttttgcaaaatgtgggcagcaggggaccttccccaaggctcagactgtgagaaatttgcgtctaggggccagatcctgaggtggctgagctggctggggaggcttctaaggagatcttcactcaggtctgcaagggggctctgccctgcctcagtagccctcatctctgggggccccaaagtcattctcatctgcaggttagagcttgctgcaggcccagaaccaagcttgtccaccacgtggccttcttggacccactggggcaacttcagggttctgaaaagcacctcagatctagtctggtctctgattcagtagcagagacaaagaaatcccctgcctgttccccttaaaatgggccattgtggagtaggtgctggggccctagcttgctccccactgtgcctttgttagagcattagcctccagcggaacccactgtctctctccttgcgagtcccagtttgcccattctcccggatcctgcttaaaggccgcctctgccaggaggccttcccaggtcttcccagttaccatcactctcttcctcctctagactctgtgtttggtacagtgtggtttttgtgtttgtcctgtcttctctcacatttgactctgagccactggaagaaagggaaggaaagtaagagaaatgaagtattcccattcccaggcacctggccagttgttgcagacagaatgaccagcactgttgtattgattccccctcaatacgttgaaaaagcaaacgggaggcatctggaaaatcttgagataagcagcttcattttcaatgatgagtcttttaaaatacacagaaatggtataacaatcatgtatccaccacttagactaccaatggttacttttgtcatattcactttaaatgtctttttattatgtatttaaaagaagtgaaacttgtagatacagctagggctccccgtgtccactcactgaagtcccttcccttttgtcatattcactttaaatgtctttttattatgtatttaaaagaagtgaaacttgtagatatagctagggctccccgtgtccactcactgaagtcccttccctctcccttctagggtccaccactttccttgtcatctggtaaaggaccctgcatccatggatggacagaggggattgctaaagtgctgaatcgcgtgtgaaattctacgtgtgcctctttctcacacatgccacatccattgcagagatgctcttgactcaaccttccagcagtctccactgcaaccactctggccaaggccaccattttcttttcttttctttttctctctcgccatggttggagtgcagtggtgcgatctaggctcactgcaacctctgtctccagggttgaagcgattcttctgcctcagcctcccgagtagctgagattacaggtttttctcactgtaagaagaggacaatagcctatgatctacagtgcccattccaactcagagaatctttacatctggagatctatagcagggctatccctagtgacatgcgtgaagaagcttggaaatggtgctgggtaggagctgagtgtgcagaatgtggaaaggcattctaaaccaaaggaagaacacgagtaaagatgatgaagcagggataaggctaaaatgaaatttgtgatctgatccacatacaagcacagtgtagtacagctggaatatagagaagagcttgaagacttatgagcaactatcccggtactcttggaggctctgcaaccacagtttgagaaactccgcgttcaaagttaaaaactgtcacctgaatagttaataacatcaaagattgtgaaagcaagtataaataacacagagattaaaataatgaggcagga

SEQ ID NO: 1550 - DNA, 669 bp, Homo sapiens
cattcttcgttgtaaattgcttctaaacacttctgaattttaaattgctaccgagaaggtccagaaaccgttctcatccaatttagtcacttttattacgttccactttgcctcccccaatcactgcggcggctcccagtttcagcgtggccgcatttggaaaaggctgaaggtagaaaactctggaatggagaggctggcgactggagcaggatccaggggctttaaattttaacctgaatgcgatcgaatgcgcgactcccagaagagatagccaggcgtccgcccggccgctcaacccccgccaggactcggaatgccttgcttttggttcttttctacaaggatgtctgcgtggatatccctggacactcgataccccccggggacctgcttttcccgcagctccgcagacgcggcgggagggcgcgctggccccggcgctgctgggacagaggtgagcagcggggtggacattgaccgattcgacaacgttcgggctctaagggctcgggaagggacccggcattttaccctccagattcccaatctatttttaaaaataatgttcaaaacatatgggaaaaataagtgattgctccttttcatggtcacagattgtatttattttttcagactggttttccaacctaacgagggaatgggtag

SEQ ID NO: 1551 - DNA, 275 bp, Homo sapiens
ccgggctctgagtgctcttgcccgtccggccccagccgcggcccgggaatctacgtcacccgaaaagcgactataaacgccggcgcctccgtccccagccgcggctcgggaatccacccgaagagtggctataaacgtccgcgcctccattgcgctctcctcttcacttaggacactggtcctcccacgcctgacaccgacgtcgccaggaccgcggggttgggggaacttggctgtcccacgtctttcaaataaagctgttttgtctaactcac

SEQ ID NO: 1552 - DNA, 1760 bp, Homo sapiens
ttttttttttttttttttttttttttgagatgaagtctcgctctgttgcccaggctggagagtgcagtggtacggtctcagctcactgcaacctccacctcccaggttcaagcgattctccagcctgagcctcctgagtagctgggattacaggtgcctaccaccacgcccaggtaattttttttttttttgtatttttagtagagacggggtttcaccatgttggccaggctggtctcgaactcctgacctcatgatccgcccgtgttggcctcccaaagtgtgggattacaggcgtaagccacctcacctggcggtacaaagaatttctgcattttcttccctggcccctagtcctgcaccgatttctccttttcgaatgtattcctcctgccaccttctctgggcaacttcgtgcgactacagaaccactgtcctgaggagctagaggcctcctctctgaccatccagagcccaaatccacagcttccccaaatttcatcagctgccacttgacgacttctccccgtctctctgaggcccggaaaccacggctggaggtggggaggggatggcggctgaggtccattcctcattctcagacctcattgctcagttgcactatttggggcacagaataatcaccaaaagtgagaaaaacgagtttgggtggctggggaggactttgggactcttgatgcaaggcgcaacttgagaaaattctgggtgtgatatttgcacagacaccctcctttcaaaaacagccaccccccaagctattctcagctccacacctgcagccccagctaaggtaccaggtctcctgagcaaggcagagagaagccttgagccttctctgtgtcttctttcaagaaccccgctgtgtcttctttcaagattttttttttgagacagtttcaagatttttgttttgtttttgagatggagtctcactgtgtcacccaggctgaggtggcagtggttcaatctccgttcactgccacctccacctcccgggttcaagcgattctcctgcttcagcctctcgagtagctgggactacaggcacctgccaccatgtctggctaatttttgtatttttagtagagacagggtttcactacgttggccaggctggtctcaaactcctgacctcaagtgatccgcccgcctcggcctccccaattgctgggattacaggcgtgagccactgtgcccggccttcttctttcaagttatatagaatggagcatgggggtggcagtggctagggacatttcctggggacactctcccctaaccccccagaaggacttcacaaaaacctgtggataatggaagggatgttacggtacaaacgtatatttatgtgtgtgtgtgtgtatgtgtgtgcgcgcgcgcgtgtgcacataggcgtgatgtctgtgaccctcctctcctcgtcacatttcccccagaatgaatgctgtcctgtctgctcatgtttgtgttgaagctgccaaagtcggggagctctggtcctgcccagacccctttggaattgctggcccatcctcccactggagagctggggtgcagctcaccttggggaaggaaacctcatgcctcagagtaatttcttgtgaatgcaaagcctgggggagcgggtctttggggggcaaggagccagtcaggggcttgtttcccctcatagagctccccagacgtgcctccgcaatgcctgaaacccagacctaggctaataaacggttcaatttctg

SEQ ID NO: 1553 - DNA, 580 bp, Homo sapiens
tgtaaatggaagctcaaggaattcagtgagttgtctctggaaaagagcagagcagcagatgcatctgtgtaagaggtagtaacatccgatgttatattcctccgtgttgggagttcactggtcactcaaactgcagagaccacaattgcaggcagtgctattcagatggactaaaaatcaaatgaagacccaggagttgtgtgatgcgatggcctcatataaagggaactgatgccttgaggaatcagatgtttcatgctaatttaaatttttggcaccttcgattacatgaaatctaaaagattgctttctaaataatgacaacagatttcctgacaatgcgaacaacagatgtcaccaagtttcaggtctacagaaattgcacagagagtgcagagagtatatactataaataaggcaccagatgtgattactcaggaagagcgaagagacatgtagagcttaatttctgcccatgaggcagtattacagtgtttcctagaatcaagaaatgctgtatgtgagggaaaaccgggagggacttcccagatgaagtggctcttggactggcctttgaaaa

SEQ ID NO: 1554 - DNA, 339 bp, Homo sapiens
ccggagataagcgctagtgcggcgccgggctctgcctgggctagtggcaccgacttgggaaaaggaaacgccaagacatagaaaaccacgcttttcccgtaggaagaaccgatgatgagccctgatgaaagaaggaagaagacccgctgtctgcgaaggcctaaaggttagaaatacagcaatttttctcatgccgaaggaaaggcaaaatggtctaagaaactgcaagagtgtgatacaagttttcctcaacagcgagctgggactggcgacaatttcttaactcacagcctccgcagtcgccttagtcgacaaagagagcagcccacgcagcggccg

SEQ ID NO: 1555 - DNA, 492 bp, Homo sapiens
actcaggatggggtcatggctgagactatgagggctgctcgtgcatgaccctgcctgctggcctccatgggcccactatctgaatgtggttacccttctccccaggaccaggtgccacctcctctgggaagctttccctgcccgtccacagggtatgcctccttgttcctctcctgccatcggtttacgtgcctgtctccatcaacagaccaggagctcctgaggacagggactgagtctgcctgattcatctctgcattcctagcacttaccttggtgcttagtgaaagctcgaacctgcctgggttcccaccttgtctctgctacccccagctctgtgaactcagagccaactactaagcctgtagcagcctcccaaactgcccagtcttgttcagatgcacctccagaaacacaggggtccaaaatgccccttcccagacaccctgaggagtagaacagtgccagcaggctccagggatgagggactag

SEQ ID NO: 1556 - DNA, 627 bp, Homo sapiens
gattcatcccaggccaggcgagtggaaaagtaccagccgcgcgcgaggggcgggggcgcgccgaggggcggaaaagtacagacggcggagccgcggggagaacaaagatgatgccaccgctgtgttgcggccgtcgaggccccctactccggcagatttcaacctgctttcactcttcaaaactagccggaggtcggcgagcagctccttttcgggatgtgctttttgtacggccatggaaactggactagcggaaaggctaccttttggccagcaagccaggccccttagaaagaggccccagtggggagcccggcgctcctaaggccgtttgggagtccccagttttccactcgctgacacgttgcttctcttatcccaccaccgccgccccgggcaaaggcactgccttgtctgaatgcgggtctgaggcgctttctgcggagcctggtcctttcccttcaatggtgatgtgtgtggtcttgctgagccaggcaactagggggacccttcgctgtggaaaaattggtgctgcgggaaaggcaagactcactcccttgcaggaaacaaagaccccttaggagagagaaatgttcatggaatgaatgaataaacaagtttgaccta

SEQ ID NO: 1557 - DNA, 528 bp, Homo sapiens
tggggtctcactttgtcacccaggctgggctcaaactcttggcttcaagcgatcttctcgccttggtctcccaaagtgctgggattacaggcttgaactactgtactcgactgacttttcctatttctaatgtcagcatgaagaacacaagaagtcagcttcaaagagtctagaagagcaaacattcactttgcagcctcccttgtaccaaggagtggccatgagacaattctgcccaatgaatcagaagaggaattgtgttgaggatttctggaaagactacttcttttcccaagaaaaagtgacagacgcagtaggggctgagcaacttccgtgcctcttccagccttacggatgtgctgttggtagctgtgactgccttgctactacgaggaaaaggaaggccaagagaatagcagagacactcgctctgatgcctttgagccaatgaatcaatgccagaagcagctgacctccagagttcttgttacaggattaaaataaatctctacttatttgccattgtca

SEQ ID NO: 1558 - DNA, 509 bp, Homo sapiens
atgcagtgttggactacatagaaagtacatatccttcattagtgctggcaagacagatgaattaatgcctttcagggaacttccctatttgtttaatatctaactagccctaaggttaatattcaaaattattgataaaatgcattaggagatctgatgatagatgtcttaagaagaagatcagagtttcggaaggacattctcacacagatctcagtttacctcttattccagagggcataaatatgcaatggcactattcataaactcaaccaatggcacaatcattttaatactgacatgcttcagtacaaataaatataattcagagaaaatcttccatgaatattccttacggagctggaaaaaacgttatctgaagcaagatgttactatgggaggattatattacgtgcactgtgttttggcaatgctttgggatacagtcattaaataggttggctgaaaattcattttactggttaattaaatccaagagtttgcaagaa

SEQ ID NO: 1559 - DNA, 1364 bp, Homo sapiens
ctgagatgccgtcgaggatgtaccgaatttgtttgtcaattcgttctgaagagccccccaagcctgggattatgaagaaggtaatactaccagtcatctgagttcttctgtgttctggctctccctgtgagcggctgttgtagaactgcctggccatcctcaaatttcgtgcagttacttcaaggcgtctccaggtggagtgtgtgactcctttttgccaccgcgtggcttctgccactttcttcacctgcttcagcccacttagaggaggttggctgctgccctgccctctcccaagtgaccccttgggaatcctcccagtgaggactttgctctctgtgccagaggtttgccttgtgctgccagtgctctccccattgccactgagtctcttcaccactgtttcactggggcacctgcatgggccccaggtctcctggagccctgaaattactgaagcccacttggttcagggcagaaagggggagaatactactcacctctttgttggggatgtcaaaggaggaccttgtggcatcttgcagagtttgtgtttatcgctccctctccctgtaagtcttgatttgaaatcaaaagaagctagaaggaaactacggacgcaggcacggctctaggctctgaatctgcttccgcgtcggcacccaagaatttcttattgggtcaagctggttcagaagccctcttccctcaggatggtgtctcttgcaggaggatccttggtctcatgcaaatgggctctagactaggttgtccctccagtctccagagacccagacagctctgagatggcttcaggctgaaaccagacccttgcacaacaccaaaacacttatttaccaaacatggtgttaccttcacaatcggtttctttgctttgctaagaagagatctcttcaagatcgataaaacagtgacctctgttgggcatttactcaagttttgtttcgtgcataacatttcaggacccgcctgttggggaaagtgaggtcatccattcttcaccgattgtctaaacagagacggtggtcctctgccgcggtgggattctttggtgtgaaaatgaaaatgggggaggatggctggatggtttcatttttagtgctctcctgtcttaagcaacgtagacactcctgaaccaagttctctttcctgcatgaaacgaagccactgctcccagctccgcagccgtgcactgtgatccgtctatgtaatgtgagcttgcttttactcaactatctattttttagaaaatacaattcaataaatttcaagtacttgaactgagtgacacaatacaacacacagatttatcttttcaataaaaagtgttttttaaataggaa

SEQ ID NO: 1560 - DNA, 626 bp, Homo sapiens
gggtgaaactgcaagtcgagagcgtgggaaaccagcaagttgagagaggatccagaagtaaccccttctaaaacgggaaagatgccttccgaaagcacttggccctaaagagaaaacactaggaggatgggaaccagggacagagaagctacttgctctgcagctgtttgggccagtatgttccctaatcttgatggccatcctgggcttattttcctgagagtctctaagtgactcactgcatcacgtaaaactaagaaaaaggatgtcctgaattttcctgcttagagagcttgtttttctttcctgttgcatcaaaggggtctgttaaactttctaaaagtactaatctgacctgatatctgaagtaacagataggaatttgggctctttaaatggagcccttcccccatacctgcatctcattgaagaggctgaacttcaaaacaaaatcatgttggagaattaagtctcgttcccagatttaatttcttatttttatattgttgcataagaaatctactctataaggcatctattttcaaatttggaaaatcttattttaagttcatttatttaaagaccaacaaacaaaaacaccaaattcactagcccaggtctttatg

SEQ ID NO: 1561 - DNA, 274 bp, Homo sapiens
caagactccatctcaagaaaaaaaaaaaaattagctgggtgtggtggcacatgcctgtagtcccagctacttgggaggctgaggtgaaaggatcgcttgggcctgggaagcggtgattgcaacgctgcacatcagcctgggtgaccaagcgggactctgtctcagaacaaaacaaaacaaaaatacatattcccagatcctggaatgtcctgggaagctatatgtgtgtcatgccctcccagctgcacctgaacaatgagcatagcaaacatca

SEQ ID NO: 1562 - DNA, 736 bp, Homo sapiens
gtgcactggcgggccctcccctcgggcgttgcctcccacccacgcccggcggcaccgcaccccgaggcgcttcacgtcacggagctgctaggagacgggcggggctccggttccggacggaatctcactctgtcacccaggctggagtgcagtggcacaatctcagctcactgcaacctcgacctcccaggtacaagcaattctcctgcctcagcctcccaagtagctgggattacagatggagttttgctcttgtcgccccggctggagtgcagtggtgcgacctcagcgatctcagcgatctcagcgatctcagctcactacaacctctgcctcttggattcaagcagttctcctgcctcaaccacctgagtagctgggattacaggcgcctgccaccacgcctggctaatttttgtatttttagtagagatggggtttcaccaggttggtcagtctggtctcgaactcctgacctcaggtgatccacccacctcggcctcccaaagtgctgggattacaggcgtgagccaccatgcccagcctacacttgggcttcttaggcacaagatccagtaagccctccctcctcctccccaccccttttttctttacactagtgttttctgtaatcctgcaacagaaagagtcctaactgatatatttgtgaccatttctaaaatctccaaaatgtaaaattatacaattaagaattaaaataattttttaaaaccaa

SEQ ID NO: 1563 - DNA, 2280 bp, Homo sapiens
ttctcagaggatctctataggcagttaatagtagttgaaaaaggaactgtttttgaatttttgagttaaacagtaaaactagtttctttgtggtacttctcagagcctacaatctgctaatgtgtgtagtgaatttccatgaggatgatgtgtggactttctcacatttttaaatgtaacccctcctccttttattttttggcagagtatcttattggatttttgtttcatagaatttggtcaatgatatttacaggattagaaataagcattcttgaattttttttgaaattctatgaaatagctcttggatctgggcttctaagagtatagttaatgcttctaaaactttaatatgcctgtacatttgctgggtatcttgttaatatgcggaatttacttcagttggtctccatgggggcagtgattttgcatttctaacgtgttcccaggtgatactgatgctactggtgttttagcagtcttcgagcagtaaggctccagatgtatttaagtgctttcctaggtgaaaagtgttaaagataacctctgccacctggcctggaggtaaggtgtttagagaggcttcaccttagggcactggaagttggagctgagtaagtagttatacaagccagatgatctacttgtatattactaataatctgtttatttttcattgtatactttttcctggctatgagagatacacaaacatattttcagaataaaatagcaaatacctatatgctttgacacttgctatgtgtccaaaatatcccatggccttttgagaggtccttggtaggggagtttagatctctgttctgtaagcaataatattgaatgggaaatacacatgtggaatgcttagttagacctcatttaaccccttccctatctcaacattcatgtcctcagccgaggacaaagacttaactgactttctatgtgaaaatgtatcagtgattcagaaggggttttaattgtttaaggctgggataacaattaaggtttgccttttgtgttaactctatacatttgttcttcaatatctaaagggatgtctatagaaagattcaaggctatggtctgagcttgacgagagtgacacattagattaatgatctctctcctgggcatgggaaggaaaatatcctcacaggagctgagctgcatatttgacacccctgataaagcattaggttatgctgacaccacattgtctacagatgatctttgcaccttctgatttgcttagtatccattgtcaaacacttaaatatgggttaaggctactataaaaattatttacttaattatttacttatgccattttttttcagtactaaaactgcattttaggttgtgtgctcagagtaattgggccaagattccagtgaaatacctgaatggtgctaaaaataaattcaatgaaattcctttaagtcctttctcagtggttagattgtttactcctcaaattccttgctaacaaattcttcctaatagaggtcctgttagagtcaattagttaagatttatttataattagaaactcctatttgcacgcaattgactctttcaaagtctttcagtaggttaagtttgttttctgcagttttgattacaaatacttcatttttgttacaaagttaagctttagtttaattcttggtcatatcaaacattttaaattcattgagtctaaatcatgagttgattatattagatttgtgtaataaagcattaacaatcatgacagttaagatgattcttttatgtgttagttcattggggcagaagacagcataatacagatgcccagtgtaaagaagttagcagattcaaattatccagtggttcactcaactagaaactctaatttttaaagaatgatgtaaaatttgctgggcacttgtgtgtactcgcgtgcatatgttcttgtgttgttggtgtatattgttctgctttgttttgttgttcttcatatacattcaaataagagcttttctgacttggtagtagtaggtcaggataaagagctggggtgtgctatcccctacttgtgagttgtatataatttgttaggattcttttgtgtccacctttttttaagtttagatggctggctctgactgctataacaaggtatgtatcacagctatgtaatgtaagaatgcaaaatctactatagttgtactataaattcagcacctgttactgtataattaagatactgcatttgaagacaataaaaaagctaattcaaatacgtgt

SEQ ID NO: 1564 - DNA, 418 bp, Homo sapiens
agaatataagttagcctcgtagtgaccatgtggaagtcctgacctcgcttgcagacttgacctctggatgtgacaaggtagcttcactacagctctactatttaatcctggaaactaaaaaccaaaaaaaaaaaaaaaaaaaatctaaaagcaagaaagatgcagactatttcctaagaagtcagaagaacccaatgtattctggagggcaaagaaaaacagggtgaggttctgtgttcactgatacatccccttccttcaccgggctcatgaaaagaaatgctgaatcagcaaatagagtgaacgaacaatcaagatgagatggctgctgttgatgtgattctctaggttactacctttcttcctgctgcaaatgctgcatgacactaagcttacaggatctagaagcagactacaa

SEQ ID NO: 1565 - DNA, 698 bp, Homo sapiens
gtagaagaaagaaatgggggcttgtgctgggcttgcactcttggtcctctgcctgcaggcacttggagatcctgaagtcagaggacagcctgaaaacaggagagaagaaacaacaggggtgcagtctcagcatgggagtccctcccttctctgacccccaccttgagctgatcgccatgcaggcagccgtgttggaggggatcccacctcagccatggacggtgcctgaagcggccctccccaccccacagcagctgatgggggtccttggataccaactagatgtcttctttcttgtggcaaattctcttttgaggctgtgtgtgccaggcacacccagatcctcagagacagtccacaagtgttgagcttcagaaggtcatccctgggaatctcagttccaggttgtcttttcggctcctcaatacccaacccttttgtagagcctcctcctccagaccagtgcttttcaaactttaatgtgcggaagaaccactgaaaactgttgttagaatgcaggttctgattcagtaggtccacatgaacctgcgattctgcattttaatgaacctcaattgatgctgttgttgctgctctgaggaccatgccaacaggccccgaatgtctgccatatggaagctcagaattgtcaacactccctctgcttttcctttgtcttccctcagaacacctgctca

SEQ ID NO: 1566 - DNA, 490 bp, Homo sapiens
agagccccagaggcagagctgcccaaggctttgggagcccacctcttgcatcactgtgccctggatgtgagacgtggaatcaaggagattattttggagctttaagacgtaatggcaccctgctgggtttcagacttgagtggagcctgcagcctttctttcggccggtttctcccttttggaacgggagtatttacccaatgcctgtacccccatgacgtgcccgtgtccccttcctccaccacaagattgtaagttttctggagcctccccagaagctgagaagaagctgctatgcttcctgttcagcctgcagaaccgccacttccagcatcgatggtgtcaggtcaggtcctctgggtagaagaaatggagtcagttaggagtgctggagactgagtaagaggtggcagctgaggcttactaccccaggaaagggatgccaccagagaaggcagacaaccaagatggcgactctcaatttttgagc

SEQ ID NO: 1567 - DNA, 782 bp, Homo sapiens
tgccaccatgtaagaagtgcctttcacttcctgccatgattctgaagtccccccagccatgtggaactgataccccatggttctcctaccaccagatgctactgaggctaaactgactggactgaggaaaaatatctgtggggaaaactttctttcagaatccaactttgaaccagagaaatccattctcttgaagctgtctgctgtggagaagttggccttaccaatctgcctttgaagttcaagttatacaggatctgcgaggctacctgtgaatgaatggttggttggtcactacttgcaagtttttcaggagctcctgaaagattactgcataaataagggaagatggagaccagacctctggctactgttgctgccaccactacagataccaccttcacccttatgaaccccctatttactgaacattctctatatgccagatgcaaaattggctaccacattggaaactgatattgaatttctcaacgagtccaacagagtcagttttcctccaacactgaaacagaccttgctttcttcagttgagcaacaactaaagattatggacccagctcgtgtggaggtgccatattgcataaacagtgcatacagtgagccctcgcattcacactcagcatgatgtgattacgacagtatgtatttccatagggactaaatcatgcttaggcagagcagttttacatctttctcatgcccattcactttagggcatgtgtttgttgggtggcattgtcagcattgtttaattatttacc

SEQ ID NO: 1568 - DNA, 591 bp, Homo sapiens
gggtcttgctctgtcatccaggctggcgcgatctcggctcactttgacctctgcctcctgggttcaagcgattctcctgtcacagcctcctgagcagctgggattacaggcaggcaccaccatgctgagctaatttttgtatttttagtagagaccaggtttcgccatgttgcccaggctactctcgaactcctggcctcatgtgatccgcccacctcagcctcccaaagtgctgggattacaggcgtgagccactgcaaccagctggaacaatcttgatattagggtgaacaagtgatttcatagctttctctgaaggaggaaacactgggagcatccacccgagaatcaacactgtggatcattctggggagttaatagttttgagatgtgtcccaagataattgttagcttgaattaccacgtggatggaaccatgctgatcctaagagccaggccaagcctactgctgttagaaaacatatttagaaatcacttggttcttccttgcctgaacatcatctatttagttagcttgtgttgtttagatgtgcttcagatctcaaaaaaataaattatgttatttgaaag

SEQ ID NO: 1569 - DNA, 235 bp, Homo sapiens
ccaggactcacacgtaaaaggagctcattcggaggcaggggcacgcgcttgtccccagaactcaaaccccagagtccctccggcagatgagagtggaggttgtaaatcaccctccatgcaatggttcatcataaaggatatggagcaaaattagaggaggcacgagaaggaaagccggtgatgaacaaggctattgcttaaagactgaatgacatggaccccagagtttatgtga

SEQ ID NO: 1570 - DNA, 591 bp, Homo sapiens
tttctctatgcattcattcattatttcaacaaatatttatcgggtgtttaatatgtttatagccatgtgctaagcactgaggttatactttgtcgtgactccatggttaaactccacagggacaagatccacacaaatattctgtgtgaaggacacataaatagtttgggggtacatcatgcctatgactgatatgaagaaggtgtaaacaaatgtatattgaattaaagaataccttaaatatttgtttgtaagagatatagttttaggatttgttacaatagttagaaaagggtttcatgaatatggaatgaaagcttagactgcaactgttttacaaagcgcttttaaaagtaactactaaaataatctagtaacacttttagagtcatttagaaaagaataaaataatcttagcctagctaacaggatgttccaataaaactattgtgaagtggtaggactcttgattatggtgagaatgggtcagaatggatgaatcaacacatttgtgtaaagaataatatctagaaatgatgacaatgtatatttgaaagaaaagagtattaaaaatgtctttaaattttccaa

SEQ ID NO: 1571 - DNA, 5456 bp, Homo sapiens
tttattttttatggagaaggggtctcactatgttcccccaagctggtcttgaactcctggacttaagcaatcctcccacctcagcttcccaaagagttgggattaaaggcgtgagcccccatgtccggccaacaagacttcctcgtgactataatgtgagcataatattaatagctctgagagagagaagtgaaccagaagaccaacctcagtgtcaggaagtctgggcgtctgtcttctgcatggctgaagacatggggctttgggcaagtcatctgttctctttgaactttggcttcctcacttctgaaataggagggtcagagaagatgtttctttttgctgaaaagttttacagttctctgatctataccccttggtcacacacaaccaaaaagtagaaaacatgagtgcaatacttttccaccagtactcccagtttatacattatcttctcaaaccaataaggaacttctacaaggccctgttagtgatgtgttacaggtgccagcattagggaaactttcagactgttatatctattcgttccttcatccatgtatactattcattctgtatgcagagtaatttatatatgtacaattacatggcagtgaaagataatcagaaaaatgaagttttttttttttttttgagatagttttgagacagagtcttgctctgtttcccaggctggagtgcagtggtgtgatcttggctcactgcaacctccgcctcccgggttcaagggattctcgtgcctcatcctcccgagtagctgggactacagacatgcgccaccatacccagctaatttttgtatttttagtagagatggggttttgccatgttggccaggccattctcgaactcctggcctcaagcgatcctcctgccggcttcccaaagtaccgggattccaggcatgagccaccatgcccagtcagaaggtttttttttaaaaaacacactcctgaactaacaattacaaagagctagtgacaatttcccaaataattatgcataacaggagcccatatattgttctcaaatcataaaccataactgattttgaggaaaagacattctgtcccactgatattcttttcatgagtaagatctggatctgtctggaggcacagaattaatttttgcatgaggaatcccaaccctaccatcattccatggctgaggaattggttattactcctatgggaaattgggaatgttgttggtaccccagccttctcttaagacaaaatttaacaaatgcatacatgctaagatgcttatactcataaggctttgtgggtctcctttctaaggggaatttgaatactaacaagaacaaaggctaaataccaaaagggggctttctaatggtagaatttgggatatcaggtagccacatagagcagggctactttgggggctggagactgcagaaacccttcagtttatacgtgtgagtaaacctaatcacacttgatgtattgctagtgaagtcccagccccctgagcctttgcagaaacccaaagaatgctaaaaagggcaggttttagttcctgccaattatttcatttactacaaatgccccgagttccgaatttacttccctccccaccagaaatatgtcattttggaggcttgtgaaaattaagcattaagaaaatcccgcctccatcctaatacactgcatccacaagtcccaaacaaaatcacttccttggcctacacacataactacctgtttctgtttaggtctgtgactcagaaagtgcctggaagaagtcatgagagggagtcgatcccatcttacctgccataggaagaatagggcctgctcagtagagttcagtgtgtgtgttgaaggtggtggttcttagtccttccctgaattcactaattcgcattgcactcactcttcctgatcaatgagttattgctgagaaatcattgtagtaagtaatacaggtatccccagtaaagccatccctctcctccatacctccgctgtcccttgggttttggctccaggatccttgccccatgtcccaaagaatccctaccttgggcctccctcctcctcttttgtcaattgcacttgaccttttcaggaaaaagaaatcaattgataccttagtcctaatgtttgacccttttctatctcagaatagagaagtccctgtatttgttctttttttactcaagtttaatatagaccacctaggcacagaagctccgtgctatattctgttgcctgtaattgtccttccatctaattgggaaaaggttactctattgaaccatctgctgattcccttaccttttcactcttttgtcagtattcctttaccagtaaattcttggttatctaggtcctgaagtttcattcatgttttttttaaaagctttaatttttcttaggaaaactgtttctctcatcttaaagcagactatgatcttttctactttgttatacaatctgaacataatgaacactctaaagtcaggcatggattttatcataaaagcagatcgtattaagatttttttaaaaaagaaccaggattgaggaatctgtagctaataatttaataattcaccagcatgttttgggctcccacttcatgctggccactgggctaggcactgagggtgcagaagcaaacaaatcagcctcctggccctcagatttgcattccagtgagtccattcataaaacctaactcaaagccagcaacacccccaaaagggctgttggaagctttgtagctcatctgtacagctgtcttgattcctgtacgggatcttactttcttgggaaaatatgttctaaatcctgtttccttgggccattaaaaatccatgctgtccctaatcaatatatagttatgtgtgaccttcttagaattaaaaaaatgccgctggacagcctttgaagggaaaggcagagaaatctgttttgatggcttgaaaataagtgaaaaggtttttagggaaagctaacaagctttcaaagatttcagatctgccagcattcattcattaaggcatgggattaggccaaaagagcctcctaccaagggagagacaggaaccatgtaaggagatctgtgagaccgcagtggaagagtattgaaatagaagccagacctgtagacgtatttgttaatatgtgtgccaagccaaagtacaggaggaggcttggaggcatggagttgtggtggaagcaggttctgaaaagcagaactctgaagctggctcattctcacgaagtcatctggcccagcctcccgcctccaagcacatcctgcctgcagagggtctggctagctgccttttcagctctcgagggatagagattctacaacctccctctgtcatcagttccagagccactcccctttgcactagaagttcttgctttcaaagaatgagggtgtgagggagggaggggtcaagaaacagagtgacaggggaaacaggcagaacaagtcagggcaaaggaccccagcatgaagagttgtggaggtggaggtggggaagcagcctcacatctcacacttccttccttctcttaaatgtgagcagctgactccaagccttgtggaaactctagaaggtagaaccagccatctggggaagctggccttacagatgccccgtctggcatagtggaggttcctgtgctctgagaacgcagtgtgaatctagacatccactgcagcctgggaagagctgtgttttcttcaaaagtctttaactttcacagtcacccctctaaagaaatgttctctgattgaaggcatgcttctattcctactttattgtgtttcatgcattctgccagagtaattacttttcataccaattcttggatgcagagaaatctctggtagtctaaggggatttcgatccaagtaaagctactatctcctattccatccagacttttccgtctgcctccattctctcagtcacatacctagaagcaagccagaaagcctgtccaaccaaaatcactctccaaagcccaagcactttattgttctccctgtctgttatcgagccaaggtgtatttggcctcattttatgccattagttgtctggctttcatggctctgcaccacattacagtcagagcaggaaggccagcagtggagatagaattatggcagaaacccagagtagaggcctctgctggtgagggagcctgcagcactctccacgctggtgggtcctagcatgcccaacagacccccatcccttcccatcagccttgggccttgagtctcattccaactcatcccctcccctttcccttctttccagtcccaggtgacacttgatgcctctgactcctttgaagagggcatcaagaagtgaaagaacaaagtccttttctgttcgggatctgggcccatcctgggagaggtttttggcagaaatggctgcagtggaaccctctgactgccagggtgaaatagtgctccagcaggctgcggtagactcactgccagagtgggtcaggactggcccagaggacagggtcgtctcttgagagtcctcccagctccagggcctgattttaaagcagtaacacgaggatataggttatatacaggctcctggaaggcaggtgccgcagctcctgtgacaccccatatgcctgagcaagcttctccagcacaagagatgatgcaagtatgaatgggtacggggggagcttaaaacctgccaacactgagacttgatgccaggggccgtgcacccgctctgccacctgctaggtctgtgcaatggtcagagcagaggtgtgtgatgagttcagctcccaagcacatccacacttaggaagtgttctgtgtgtttttaaataatccttaccatgtaaagattgtattacatttgtatacaaaatttttttgcattttacttttgtaatatttggggttttatagatttttattttatggccaagtatacttttgtaaggaaatgttgaagtcttgagtatttttattcttttaaaaaactatagttagtgtcaactgtgagcactgataaatattattcatgtgtggttttccttctttttaatccagactttttaagaaactgttttggcatagagctttacttaaaatgctgcttcattttacacattgtgaatactgaagattctaaaaaataaagatgcatttaaaatctctgtgctgttccattgtagaaatggtaatgtgcattgctttgccaaagtggtaattaaatgtttaatggtttagaactcctagttcacaacagggcttctcgtcatcacttgcagcgtgtgagcttccaaataagccgccatttctttggaaaacgcacgcacttaggcatggcgatctcctgttccgttaggaaatacggttatgttgacattatggttactgtgcttgtggttttgca

SEQ ID NO: 1572 - DNA, 566 bp, Homo sapiens
aaaaccaaactcaaagaccatgaccacactaatatccgctggtgtggttattatgcaatgaaaactacaaatacatatggaccaaaagcctactaaaacttgaagaaaataataaattaaagaaattccaagctttaccataaacagctgtaacttaaatcttaaatcccttggacacactttacaggaggcccacatgtgatgaagacaggattctaaggtttggcacttcttcaaattggattagttggaggatgtttcaaagttggaaagttatgtgtgttacccttggcactggatgattgcaacagtaagtggcaactgggatatttctccagagcttctacaacaacaaattgagagtttcacaagcacctggggcccagcagacgttgggaagcctattctgggactcgcctccatctaaatgatttgaaaattcagctcctgaacacagccagattgctgtcagcaattcgaataagttttaacaacactggatccacctcaaggttatttcttcaatatcatacagaaaatattgtaaatgaaggaaatatgatgca

SEQ ID NO: 1573 - DNA, 586 bp, Homo sapiens
cacgctcctccagggcgcagagagcatcaaagcattatcaccgacccaacacacaccggcgctgcgtagtttctgcagcaggtgtggggtgaagagttgccacacagctgtctgacaccgggtgtacggcgtcacccctcacttcctggacaaggcaacattttcctaaaggtcaaaggagaaaaatcctatcatctgaggtgctgaacaaagaattcaataaattcaatcaatctgatgcactctgcagtcgttctaagttcttgtctactaaaatcctcgactactacacatccacaatcgcttctgtgaaactcttgggaccaaatggttcagaatttgtctcccatacatacataatatctatgtcaaggcctgtagtaatactgtggaatctaatacaatgatatttctgtagtgaaacatacaaatgttcactccaagatctaaagattacaaatagcatcatgtcagttcaaatcaggttttatggataaatgagtcaggaaaagtatgtttttcaaagcattttgaatgttagacttgtgcacaagggattgtgagtctgaatcatatttccgtcaac

SEQ ID NO: 1574 - DNA, 285 bp, Homo sapiens
ttacagaacagtttcccaagcagcagcctgcctgatccacccttaattcagctgtgcgtctgacaacatgttctacaggaaagataaccttgtacatcaggtgtttcctgtttccagtaccaaaagtgtcttcctttggctttggtatcaaggtaatgctggcctcataagttgtctccctttatccatgagggacatcttccaaggcccccagtggatgtctgaaaccgcagcatacttttgtccataaagcaaaatccgaagattagtgttaagaaacaggat

SEQ ID NO: 1575 - DNA, 423 bp, Homo sapiens
cgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggcaggccagaaagcagacccagggaggatagcacatgtcttcggctacactggtgaaggcatcgtgcctgctccacagcacatttttattca

SEQ ID NO: 1576 - DNA, 1604 bp, Homo sapiens
gccgtgcctgcaggacttcccttcgcttgggcgcaagccggcgattagcctggtcccctaggacatctccagggctccggggaacctctcctgcgcaggcttggccctgcctcctccaagcgtccgagtctttttcggcttttcgtgagcctcagagagggacgtttcctgccaacgctgctgcgaaggaaagtttgggcggcgttatcccgactgccttcctcgccagcgccggcgagcagcttggggacacagccgacgcccgggcatcctccccgacgaccccccggagcgctcccagttcagactcctttccgagaagcgcgcagaagtgacagccccggagcttcgttccggtgtaggtgtggggatgcgccgcaaggcaggaggggaaggcgctccagttgaagggggcaccccggggcccgcgccgactcctcccggcgcagccttggctcgccggagtcgcgggtcggaggctggcgccgctgcccgccgaccagcaccctggcgccaggcgcccggctccacgccgcacccttggcgacgctgtgcgaggggctctagcgcccgccgcggcgcagtctcgtgaacccccgctccaattttttcctacggaggcgcagaggagggtgaattcgcgctctccttcccgacgccccggcttctgggagcgtcagagcaacggaagtacgtacaggaggaccgagagcagcagggaagtttggcggtgggctggggtcggcggcgaagattccctgccgtgcgctgccccctcgtggccgctttgcgttcccgtcgggaagggctgggttccagtccagggcccagcacaaaccaggattggttggacgctgcacagcgagttcagtcagggctaacatcagaagagtcgtggggggcctgcctatcggccagcctgtccttgtggtttgtgaagttgtatgatctttctgttattattaaggaaaaaagtagtatttgttgaggctaaaaggccaagagcgtgctatatattatttaatcctctaaacagctctgccagataattattttatttatttatatttacttccatagctttagacaggatctcgttctgtcaggcaggctagagcgcggggtgctatcacggctcactgcagcctcaaactcttgggctcaagccatcctttcacctcagcctcctgaatagttgaaactacaggtgcgccaccacgcctggctaaatttttaatttaaattttttgtagcgacagggtctccttatgttgcccaggctagtctcaaactcctgggctcaagagatcctccaacctcatcttcacaaagtgctgggagtacaggcgccagccacggtgcccaacctgtgataattattttaaactcattttacaaatgaggaaagtgatattcatacttgtaaagccattggggctgaattttcatttttgtatccacagaactaacacataaagtttacatgccattagaatgtaagctctctgtaagctacagatcttttctactgtaatatccttagtgcctagggcagtgactagcatatagtaggtgttcaataaatatttgtagaattaatgaaa

SEQ ID NO: 1577 - DNA, 692 bp, Homo sapiens
gatgctgccacctaggttacttgtaggaccctatacggcaacctcctttgccaggaactatttataaacatcctgcaggaaaatgagtcaaggaagcttttcttttgagctatttacagcttttagcaattgagtaaagtatactcctgtgaacaaaatttggaacatatttgtttctctctaactgatttctccagaatttggaactagttaaccaggaaccctctcttggggtgtggatcgagacccctttctggtaacgagagcacagcttggttttatacattttaaggagacatgagacatcaatcaacgtatataagatgaacattttgatctgaaaaggcctctttaaatatacacttctctgtagtgtatgctagaaatggagtggctggaataaaagtggctgaatcatcttcaactctagtagctgagaccaatgatgctgacctccctcaaaagctgcatttctgaatttctgaaggcaaactgtctgcctatattgtacagcaaaataatttcctgtattaaaacgtttttattgctctaaatttctagattaaactctgcttaggtattgctaagagggtagccaagtatagaaacttaaatttactgacagaaatctagagaatgcttaattttttttccagcagtgaagtagaagagacagggatatcccagaaggt

SEQ ID NO: 1578 - DNA, 446 bp, Homo sapiens
gctttgatttatacagacttgtaggtttccctgtgaatctgggagcaggatgaagtgatgctcaaaggatcaagatcaaaaggcagtggaaagaaatgaaggatgcaggagaaagatggacattgtgaataaagggaagagagagaggggtgatggggaaggtaggaagatcaggacagagcaaggaacaacaggatgagattcaaaagaaagcaacatggggaacatgcaagtggtgagggctaagaaatcttaataatgaagaaaccatggggactaagaggaagttgaagaaagctgctggagcaacctagagagacagaagagagcagagaagtgagtgaaaggaataaacctgggatgagagagaggatctgcactgtaactctgatattgaccaagaggattgataacctcccttttattaaatgccacatacatgccaa

SEQ ID NO: 1579 - DNA, 2140 bp, Homo sapiens
gtgttggagatggggcctggtgggaggtgatcggatcaggggggtggatttctcacagatgctttaggaccatcctcttggtgctgttctcatgatagttcagtgaattctcactcgatctggtcgtttgaaagtgtgtggcatctcccccctcgctctctctcttgctcctgctccagccatgtgacctgcgtgctccctgccttcacctgccgccatgattggaagctttctgaggccgccttagaagccaagtagatgccaacatcaagcctctaatacagcctgcagaaccgcttgccctctctcacctgctgccatgtaagatgtgcctgcttcaccttccgccatgattgtcagtttcctgaggcctccccagccatgtggaactctctgtcttttccagaatatcatataaatggaatcacacgataggcagccttttgagtctggcttctttgactgaacagaatgcattcaaggatgtgagaagaagaaaggaggggggagaggaggagaaaaggacgtgcatcatctgaaaatgaagggtgttctttaaagcagcaaagttagctcaacaaaacttattgtgctttatcatggggaactgacatagcagaaagtggaaccaacggtaaggggggactactgtaactatggaggaataaggacaagaattacagcagacgtctcaacagaaaccatgcaagccagagacaacggagtgagatttttaaagtgttgaaagaaaaaaactgtcaaaacagatttctacatccaggagaaatatctttcaaatgtgaaaaacaaataaatacttttgtgtaccaacataaactgaggaagttcagtaatatttcctactttactggaaatattaaaggtagttcttcaaacaaagaatttgtttggaacttagatctgcatacaggacataaatgaagggaaatatgctttatcatatttctcgctgtaaaatatactttatcatattttcttgctataacaagtaacttgactgtttaaagtaataataaccatatattatatggttatggtgtatgtaagagtaagatgagttacaatgatagtgcaaaagatgagaagaaagaattgggaaacactgttgtaagatcttacattacatgtgtggcaacactgttatttgaaggtggacttagattatttaaaattgtatattataaaacctagggcaatcactacaagtgttaacaacacaaaatgtgtaaaaatcaattgactatatttatgtaggtctagttcggggctttctcttctatttcattgatctatgtgtctatccttttgctactgtctttattactatatctttataataatcccagcactttgggagaccaaggtgggcagatcatgaggtcaagagatcgagaccatcctggccaacatggtgaaaccccatccctactaaaaatacaaaaattagctgggcatggtggcacatgcctgtagtcccagctattcaggaggctgaggcaggagaattgcttgaacccaggaggtggaggttgcagtgagccaagatcacaccactgctctccagcctggcaatagagtgagactttgtctcaaaaaaataaaaataaaaataaaaaataaaaaataaaaaaattttaaataaaaggcttgaaattgggtagtgtaaatccttccattttttaaatctctttcagaatcattttgctattctagcatgttttgctttttagaatcagtttgttgatatctacccaatgcttgctggaattttggttaggattgtactggggagaattggtaaatttgccacattgaacctttcaatccgagaatatgttatatctctatacttaattagatcttccatgatttatttgagcagtgttttgcagtttatagtatataattcctgagcacgttttgttagaatttaagtatttcaatggggcaggagatgctattataaatgatactgtctttaaattttgaaatccaattgttgattgccactatctagaaaaatggttgacttttgtaattctgcaacctcagtaatttattaattctaggagcattttggtgggtttctttgggaagataaatatgtctttttggataa

SEQ ID NO: 1580 - DNA, 669 bp, Homo sapiens
gatgtctgaggaatagtcttagtggattatcccaaacttgacacattttttgcaaaatgctatacaaaaagaagatacatgcgattatgacaagattctccacttggtgtgaccagtctcatacaacccaaggctgtgtgtccaaaggcaactgtacttctgggactggaaacaaattgggaacatttttcattgcatatttggctcagatctgccacttagttgaagtataatcttcagcaagtgactcaaaatttctgaatctcgttttcaccatcaatacatgacaatagtaatattttctcctttaagtatttgaaagtgttgagaaagccacaatagcaacacttgcaaaagtgctccattgtaaaatgcaaaggagaggtagttgtgaccctttggggaaaactatagttgccacaattgtctctgaaatgaagcatgtttcttagactgaaggaaagccctgggagagattggtctagctttaggatgactgtgggtagagcttctagggagaagaatgaaacgtattcctcttttccttttctctaggaataccggaaagcatgtatttgtttgctaaattgctctctttccaccagtgatatcaattctgaaatacttttgagatcttgacaataatcaaaaggtagccaggtgcatcgg

SEQ ID NO: 1581 - DNA, 3688 bp, Homo sapiens
gcgggggggcgcgccggccgccttcggagccccccaactcgcgtcctgcaaaggccgccgggccctgtcgagaagacccgaccgcagatggcggggaggatgctcccggcggcgtgggaaccgggtctgactcccgagccaccgccgcttccgcaggggcgccggccccgggaaagtcaagtcataaatccctgaatctaaaactccattctcagagaaaaggcctccaaggacgggcgccgtgcgcggcaactgcctgcagttttgaagccctttgactatttcataacaaagacaaggccgggcggcttggacgcttaggaaaatcctggggctttgcaaaaacaacaggttaatctagtcgtgtgggatgatcaccaaaacaagacaggaaagaagaacaccgtgtcaatgctgaaaagccagcccctgtgagccccaaagtgcacgttttccacagtcccaaggaacacgtgactgtgtgtttccacacttgagaagtcaggataagaccccttggataatggaacaggggatgggggtgggagcaagcaccctacctggtcacctgcttaacttagaaaccagcttttaaaacctgtaactgcagtatgagctacgatcaaatttgtcttaacgtattttttttaatgtttttaatacccagaacacagggcttctactccagggtttcctcgccagggaaccccaaacacacaggacctggagaagccgggtagagctggctcctggccctgcgcttgggtggtcggctgccttaagaagaactgcaccccagagacaggctcgcagctgccgaccttatccactcgccctttctgctggagcccaggcccagtgctccagcaaggaggctgagaaaatgctgaagactgatgcccacgggggacagcttgggctaaggataacgtttgcaaaacaaacctttaaaaacccatagcaacctgtttcctagagcacactcttcatctctccacccccaaactagtcccgactcggatcctccttttcctatcctctttctcttgctctcccgtctcctattcacttttcttctcctttcctcttgattattataaacaaatgctttccaagtcttaccgccatcatatgtgtacatatgcaacccttactgttaccaatttgttgaagtcaagacaggaggaggcaaagtttaaaaatcagaagtattgcaggaaatgaaaatggagtgagtgttgcctgggtatcataattttttttttttttttaacagttcctctacttggctctcctccaaaggtacgcggccacagcaggcaggggcttggcagtgtgggaggagacaccacagaagacagggaagaactaccaggccttggttcatctccacactggcgagagaggacgtgcaggaagtatcggctgccagatagggagctgagacttcaagaagctaaataaggtgtccaacaccacagagcatggagcaaaggacacgggactgcaaatcttcctaactcgtgtgctcatctggctatctcaccagggccttaaatttaatatatcccaaactgaactcatctttaccccttcccactttgcactcctcaaatgtccttgtttaaaatagttacctttatctttcctaacccagaaactcaaaacctggcatcatctttgacttctctctttaccttcacattcaacagtttccaagacttaaaggctttatttgtaggatctctaccactgatcctctacagtttcacacctacatcccattctcgttcccaaatccccataactcctctcctggcccatcccttaacactgaaatcctggcttggaaaatatggtcacattcacagcagctgtccccaagaaggaagccaaggcaacagtatgcacaatgaagtgagtcttcactgatctctccatattttgacattttacagcacttattatctctactttgtattttgaaactgaatccaaaatagttttgcatttgttgtttaacagtcatgtatgtagtttttttttttttttctttttttttggagacagagtctggctctgtcacccaggctggagtgcagtggcgtgattttggctcactgcaacctccgccttctgggttcaagcagttctcgtgcctccctgagcagctgggaatacaagcatacaccaccatgcccagctaatttatttttagtagagatgggatttcaccatgttgcccaggctgatcttgaactcctgaggtcaggcaatctgcccacctcagcctcccaaagtgctgggattacaggcatcagccaccacacccagcccctccatgtgtgtagatatttatccacatccaaaaattaggaaaagcaggacgcattgaacctttggtacccagcagcaggagcctgtgggtcttctgtctggagcacaatcacaaggaccgagcatcagcagcatccactgtcctttcagctccaaattttaaactcccgtaagagagacattattggcccagcttgggtcgtgtgtccacccctttaatcaatcagctttggccaagcagcaggtcatcctggtccaaacatcacagttgggggcctcacttgtaaatagagcttgttcccaaaaaagagggaggcacacaccattcatttgtttattcattcattcaatcagcaaatagttgagcatctatagaaatatatttaaggttctattatgtacacaaaatgtataaaacatggccctgccctcacaccatgaaagttaccacataaaaagaagtcaccagataaaaaaagcataacagtattcataagtactcatgagtgaccatcaattcagttacacatgatggaagataattcattatacctagtataagccagtgacggtaaaaatagttagcagcaatgtgtacatgatcaacaaaagctcacagcagcaccatttacacaaaaacagaaaagtacccagatgtccatcagaggtagaccagataaaatataaaatataccaccacacaatggctaacacctgtaatcccagcactttgggaggctgaggccggcagatcacttgaggtcaggagtttgagaccagcctgatcaacatggtgaaaccccgtctctactaaaaatacaaaaattaaccagttgtcatggcatgtgcctgtaatcccagctactcaggaggccgaggcaagagaatcgcttgaacctgggaggccaaggttgcagtgagccgagatcacaccactgcactccagcctgggtaaaaaagcgagattccatctcgaaaaaaaaaaagtgtatatgtatagtgtatgcatgcacagaatactttacagcaataagaatgagtgttctgcaaatatacacaatattgctgactctcccaatgttaaacaaaagcatccagacacacaacaatgtgtacagtatatgattccattgatagaaagcttaaaaacaggcaaaattaattcacccttatggagtcttaagtaaggggaacaaaaggggccatctgggcagtgataatgctgtttcttgagctgggtgctgggttcacaggtgtgttcagtttgtcacattcatcaagcttacacttctcatacatcttcttttctatatgtatgtcatccttcaataaaaagtttttaaaaaataaa

SEQ ID NO: 1582 - DNA, 423 bp, Homo sapiens
ggatctgaagaaatcttgcaagctgaagcctgacagtttggtgcaaacctccgagggctcaccacttcagtagaacatgcatggttcaggtggttttacaggaacaacactaacaaagtcctctggagaccctttcttggatcccgctccaccttctcaggaggtttatgatcacctcggagttgttcagcaatgagacacttgccttgaacaaaaaggaggctaactacagaggaccaccctgcccttgcatattccaagacagactcatctccatccttgcgcgtgactcccgtaggactcgcagatggctccgttagtgacctgcttgcataaaaccctcggtccccttccttttctttgaggaagttctcattaacgatcattctccttataatagcctgaataaaatcatatatttaa

SEQ ID NO: 1583 - DNA, 1563 bp, Homo sapiens
gttattcttcggtttgcctcctcccagtggcgtggatttgctcccgacccgcttttggggcgtgcctgcttcctcctctctgttagatctcgctctgtcacccaggctggagtgaaatggcacaatcttggctcactgtaacctccgcccccaggttcgactgattctcgtgcctcagcctcctcagtagctgggattacagaattttacacctggaactcctgggtgggaaggtataaaccgtttaaagtctccggcaacacactaataaattgcttcaaaggaaagttctcaaccgttactctcagcagtgtgtgtattagggccatcctcaccacaccctttcaggtagcgagatgagccccagagaggcgaagccacttgagctcgtgagtgacagtcagatgtcaagccctgctctttctaaagcgtgctgccttcagaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggcccttgggcaagtcactgtactttctgagtctcagtttccccatttgcagaatggaaataactaccccggtctaccaacttagaagaattgctttgaggatctgataaggtggtgtggatgatgctgccttgggggctttacagtatggagctcaagggaccccttaagttgggcttacttagtaactccaggggtgggcagaacaggactccaatgagggtttttttctttttcccttttttttcttttcctatctcttaacttttatctttattattttacaatgcccttgtaagatgaaacaagtgatgctgaaatatctttttcttttttaacctttattttagaattggggtacatgtgcaggtttgttacataggtacagtgtgggctgctgaggtttgggagtacgaatgaattagtcaccccagtggtgagcatagtgcccgataagtggttttttcaacccttactcccatccctctccattcttgtgttccccagtgtctgctgttcccatttttatgaccatgtgtactcaatgtttagctcccacttagaagtaagaacatgcccagcactttgggaggccgaggtgggtggatcatgaggtcaagagatcgagaccatcttggctaacaaagtgaaaccctgtctctactaaaaacataaaaaattggccgggtgtggtggtgggcacctgtagtcctagctactcgggaggctgagacaggagaatcgcctgaaccggggaggtggaggttgcagtgagctgagattgtaccactgcactccagcctgggtgacagagtgagactccatctcaaaaaaataaaaataaaaaaataaaaagaatgtggtgtatga

SEQ ID NO: 1584 - DNA, 829 bp, Homo sapiens
ggaagggaggaagcgtagaaggtgccgatgcacttttcctctctccagccctcctgactgctccaagaatttcatcgaacaagactcaaagaggcccagctgctctgcgttttgattcttctccctctctcagtccacactgacctgggaggggcttctcaaacaccacatttcctagcgtgctgtgagaagaggactgtgagctaagaagggagaaaaggcactccctcctcatcaacaaacacctgacctgggtagaccctctgcttaccaagatccagtccaccttttgacatcagcattcatgctgcctctttttacgaaccaagccaaagtggtcccttcctctggaaattataggatacttaatgtacatcatatccagctgcgcgcgcggccgatgcagttgaactggacgaggatgctgctctcccactcgtagaagcactgcaggtgcatccaggtgctgcaggggcagtgctcgttgttgcacaccaccttctggtagtcgtccttctccaggtccaccggcctaccgaagctgcagatcaggggagtggcacatggggcttctgggggaggaataaagagagaacagatttcagatttttggattaggggtactcaacctgtacttgcaacagtatggtataaggtttttctaagacatgaatataatgaaaggcagttccagggttcctttaaagatgaatcactccagtgaaccagggaataatatgatgaagctacttaaccaaccagtctggtggaatctctaaaaaggaccttcaacgcccttcatcctgagctttaggttgtcctgaatacc

SEQ ID NO: 1585 - DNA, 488 bp, Homo sapiens
gactgctgataatctcaccaaccgcttcctgtacaaacaccggaagtcaactctacaaattttagataagaaaaagccatgtcagagggagatgctctcagacgtgcagagactttcaaacttcaccagtacatcagttcctgcaaaatagaccagagaaggtgcttcccgcaaaataaacaggtaagcaaaatctaaaaaggtaatgcaagattgaagaaggcaaagtgtaaataagaacagtgatatttagactagagggaagtttcatgtttttttgttaaaatgcttttgaaacgaaatgcaaatgtaaggacaatccttgccaaaaatactgtataatggaaaaataaatttttaaaggctaattattttcatctggatttaatattcttggtcatttcaatacacttaagagacatcattaaccaattccttcaaaatttaactcatatctcacctctgttccccattcttatttctaacac

SEQ ID NO: 1586 - DNA, 704 bp, Homo sapiens
agtaacactctgggagggctcaaaccacataaccaaatgtgccaagataatcctgagctcactattgtcagtcctgaagattttcctcagataatctttcatctctttgttcctgagactatatattagaggattacagagtggtgttatcacagaaaagaacaaggcttttctgatccaagatctcggattgttcaaatccatgaggtgggaccacactcaagaaaaagtccagggtaagctttccatctagaatgataccttaaccaccagtgaaagaagcaaggtcaattttcattgattcaaattatattcaaagtggatttttatctgagatctacaacttatgaagaatacaaatgatgtatattcttttctactcttcatgtatggactagaggggcttgcacagtagtaagaaaaaaatggctgagacccacaggaacaaagaaacaggacaggagttagatgcagagaagagatttcaacaaaagtttggaaaagatgctaacggtagcatatgagtcacagacagaacattggcacctttgtttaagaaactgaatgttaatgtcacatctgcctttggagattacaaatgaaatggctacctttctactggaaccctgaccagaagtctgccagttagtaagctggcttaagagatcaatctaaaatttacataaggcttttgaaaaaaagaa

SEQ ID NO: 1587 - DNA, 994 bp, Homo sapiens
ttccgggaaaacaagcccagaaggcggcggacactcgcataaagtcacgcagtagtactcggagcccggggtagaacctggacttcaaatctctgcactcccggccgggtggtgggcgcatatcctgggtagcctctaggaagcgctagacacatggaaccaaggcagattcagcctggcagctggcaagtcatggagcactgcctgtccatctgcgagctaacaacagtcgcgctggaagtcaacaagggaaatggaaagggagagacccagcctccacaggggctcacgccctgggacctgtgccagtgtgaacaaggttttccggttctagccagaggaagctgcagccaggcctggcagtctcccctgctcccttccaccagcttggttcctgtttctgctggtcctgggagcccccagcagatggactgcccttatcagccggctccaggccagaggaggaatcctccggtcacgtgtggctctctggagggagagagacctcataaatacatacagcccacgcagaggaaggggggagggtcaaggggaaagaaaccttgacattctggcgactgggccaggattaaagtccaccaggcatagtccttattggctatttctatgaggaatctcaaatccacatggcttccctggatgacaacgctgactttgactagccctgggatctggggcattcccagtgtgctgctggcttgatccaggcctaatcctttgcccaggactgacctttcacagtttacagagcactttatctcctggctcagtgaagtctcacagaaccctccagagagaagggagtttatcatcaccctcaatttacagatgaggaagctgaggctgcgattgtaactgactgactgctggctacgcagctacaagtgaccgagtccagcctgaaagccacatatattctcccacaaaatccagagctgccaaacacatcctcctccatgagtcttgctttgtg

SEQ ID NO: 1588 - DNA, 2067 bp, Homo sapiens
cacacacacatcgggatatttttcttgtttccttcttccagagggtgtaggagttgtgttccaagtttgttcctgcaaaccctccgatgaggccagctgcattcatcggggcctggatggccgcacctctctctccccgccctgtctcctgcactcagtctcatttccagatggggaaagggagacccaggctgcggtgacccactgaggcacaggatcagtgagaacccagccctggctttgcccagacctctcaagggcacttcgtgggaccattgccggccgttgtggcatctgtccctggccttgcccccatccgtctctgcacagcccaggtgggtccgagccagccccaggtctccagggtcccagcccagcctctagaagagccagcagcagggctggaagggagagcacatgctgggccttggggctgccttggacctcaggccgttgacaaggaaaagcggagagttgggaaaaaaggacaaatagctgagcgccagccgcagtctgggggacgggagcctcgtgcgactctcggagtgctggccagattggcagaggggaggagagaggaaaaacccaggctctgaggaaaaacctctccagcccagcgcgtggcctggcattaacccactgcagccccaggaagtggttccaccccaggcagccaacaaggcggtgcctgaactatgtctgtggatgacggagccacgacctgtccctcagggctcagcgctgcggctatgtccagggacccctggctgtgcccacgtcggggcttcccgttccttacctgccatgagaatgagatgtccagggacctccctgctccagctgggacctgtggggctttgtctgttgtcccgagcaccttggagatgtcatttctaacattttaacccaggaatccccccaccaagggacagagtgcaaggacatgatcgaacagaaaaagttctggtacaagatcaaccccgtggggtggtgagtgctgcagccccgggcctcacatcctgccgtccctgtgggagattggagcggtcccagtgcccaccgctgattctctggctccagcaacccctccaggtggatccgtcccacgcagcctggcctgaaacactgcccagccactgggtccagtaagacagagcctcgagtcattctgccaagaggatccagaaacacagactttttctggggtcctggaggcttctggcccatggggagcccctgggtcccagcgatccagccctgatgtgctgagggtgcagggcccagctgcagagcagaggagagtggcccccagggaccagcagcacgaaaggcacactgaggcacactggcaggcctgggctgcagagagcctgaaggtcatggggtagctggtggaagcaggaagaccccatacagcagcgaccactgaggctggtgctgcactttctcagggaattgagtgtgggctcccaccatcccggccactggcttcctccaaagcctcctcctcttacatcagcaaaccttctgttcggtgaccccctcagtgaccctctgtgcttgccttcgtggtcttcctcatggaggatttcgggtcagcgtgggggtcagaggtcatttcccataccccctcaaaggtacttcttgctgtggtccccacactctgacaccctcttctgaaatgaacacttttttgttgttgttgttgagacagagtcttgctctgtcgcccaggctggagtgcagtggcacaatcttagctcactgcaacctccacctcccaggttcaagcgattttcatgcctcagcttcccgagtagctgggattacaggcatgtgccaccaagcccagctaatttttgtatttttagtagagatgaggtttcaccatgttggccaggctggtctcgaacttctgacctcaagtgattcgcccgcctcggcctcccaaagtgctgggattacaagcatgagccactgcgcccggccacaaacacttttttttttttaaacaagtgaaaacaagtttattaacaaagttaagaaataaagaatggctattccata

SEQ ID NO: 1589 - DNA, 4130 bp, Homo sapiens
agcttgcagtcgccctgcgcgcctccccgcgaggcttgttttctagcgcctctggtgggccgcctcccgcaggcctggtgtgagcctggggtccgttctcacagctggatctggggtctgaatgccgcgccctctggagagccacagatgggtctccgctgatgcttctctcaatttcctctaagagcgagagctccgggaaaggagccgatcctggtggaagactacaggtctgagtccactggacgaaaaacgaggctccttggattagagaccatcctgaggacatccttgggagccatgtgctgaagatggccaagccacaggatgaaaggagctgcatctttgagtcaccactggagaaaggtctctctaaatggatttgcagagacgtcttctcgaatactccccttctaagttccacttgtaatccacttcttctattctcccagcaatcaatgtggtttggggaaattccagaatctcataataccttggtcatgggtaaataaggaaaggacctttacatacatgtgatgcaaagcagatcaaaacaagcagagcagcctaagagcagcaagaccccaaaggataagggaagtcctgcagaagagcagagcggtgctgcaaaggcaggcaggtaaggtaagcagacagggccatcaggatggatcctttgggcatgccagcatccaccagggactggtagagctatttagagaaactgataaaaagctctgccaactacagtcacaaaagatggagctcagaatgatgagtagatgcctaaaacatctccattttgttgatgaagaaagtaaagtttatagagcttagattatttgcttttgtacctagcacagtacttagtttatagtagatgcacaataagtatttgtttaatgagtgaatgagtcactagcctaagacctttaatataacatgcttaaacctgctaccagggattgggaactcacctatttagtagtgagtagaggggtgtggtactggtacttaagacagatgcattgtggttgggtatggtgtgtttttgtttttgttttgagacaggttctccctctgttgcccaggctgagatgcagtggcattatcatggctcactgcagccttaacctcccggggctcaagcgatcctcccacctcagcctctgagtagctgggaccacaggtacgcatcaccgtgcctggctaattttgttttttgtttgtttgttttgtagggacgggattttgccatgttgcccaggttggtctcgaactcctgggctcaagctacacccgcccgcctcggcctcccaaagttgtaggattaaggtgtgagccactgtgtccagcagatataatgtttttaaaagtttgagagttaatatgctctctggtgtgccctaggtcccactactcctattgccttaaaactcacgcagtacacatttgtcttccatgggcttcagttgtaagagaaccctttctactctttgctgttcacaagtctccttttaaacagagcttgttcccaatgctgttttgttttgccctctgccatgttcttccggccatcacctcctgtggggaaaagagagagagatcacattgttactgtgtctgtgtagaaagaagtagacataggagactccattttgttctgtactaagaaaaattcttctgccttgagatgctgttaatctaaccctagccccaaccctgtgctccctgagacatatgctgtgtcaactcagggttaaatggattaagggctgtgcaagatgtgctttgttaaagaaatgcttgaaggcagcatgctcgttaagagtcatctccactccctaatctcaagtactcagggacacaaaacactgaggaaggccacagggacctctgcctaggaaagccaggtattgtccaaggtttctccccatgtgatagtctgaaatgtggcctcgtgggaagggaaagacctgaccgtcccccagcccgacacccgtaaagggtctgtgctgaggaggattagtaaaagaggaaggaacgcctctttgcagttgagacaagaggaaggcatctgtctcctgctcgtccctgggcaatggaatgtctcagtgtaaaacccgattgtatattccatctactgagataggggaaaactgccttagggctggaggtgggacatgctggcagcaatactgctcttcaagtcattgagatgtttatgtgtatgcatatctaaagcacagcacttaattctttaccttgtttatgatgcagagacctttgttcacgtgtttacctgctgaccttctctccactattatcctttgaccctgccacatccccctctccgagaaacacccaataatgatcaataaatactaagggaactcagaggccggtgggatcctccgtatgctgaacaccggtcccctggacccctttttttctttctctatactttgtctctgtgtctctttcttttccaagtctctcattccacctaacgagaaacaaccacaggtgtggaggggcagcccaacccttcaacctacctatcttatctcttccattatctatccacatatgtcctctgtatttttttgagtaacatttataagcataagtccttaggtagctatgccacttacataatgaactagaaaaggtaaccaaacagaatagggttgtactcagatataccttctacaagtttgtgttacacatatttacacatatttaaaaatatatacatattattattgtgctgtgtggttattaggcaaactcaataagcagttcttataaagtatactcaatgtaacttttataaacttaccatattttatagttattctgtttttattagctgctataaactacctgggtgtcttgcatgagtcattttattgtaatgtttttgtatctgttgaatgaggagttagaaggcatcatctttaaggagctttacaggtacatgtccagggctcaataattttattattatttcctggacagataaaacctaagcaggtgaaggggaaagaataaaagtgcagggtggaagttgcttgaatgctaactgggtcaacgatctcccagaaaacccctgtaaaagaaacctaagaacctacatcaccaggagaccattgggaccagttcctctggaatccctgaggccagataatcagctgaagctttacattctgtccctttctggtcatgactttctccacagtctgcttggtgcctcctcctctgtgactctaaattcttaggatcaacccctcttgcatatgcacatccgcagtgcctgtgggatacggtgtggtgtggggaggaaactctcttctgccttaatattttcctgtgtgccccaggccttgacggaatcctgtctctccataatgttgcttttcgaggagactgattgattgagatggcgtctcactttgtcgcccaggctggaatgcagtggcgtgatctcggctcaccaacctccacctccaaggctcgagtgattctcccacttaagtctcttgagtagctgggactacaggtgcatgccaccacgcctgacaaatttttttattttttgtagagatgaggtttcgccatgttgaccaggctggtctcaaactcctggactcaagtgatctgcccacctcggcctcccaaagtactgggattacaggcatgagccaatgtgcccgtcctgaggagttttcttctggaattcctgctgggtttttgtagtcagtcctctccccatttcccacattggctcttgcagaccttccttttccccatttctatttgctaccatgtcagacatgacttttgccataggatctctattctactatagaggaaaccaaagccatcagtagaaatttcactaacatggaatcagatttatagaagaaagggggaggaaagttttgccttaacacctggaagggtttcgtttcttttagtagctgggagacagaaacataagaaagtagcttagtaagctttctgctgttcaactgatgatgtgtgagctgtcagtagttcaaactagtcattatctttatgaattaattatgtaataacttaaacaatgtcataaaccttcaaatcag

SEQ ID NO: 1590 - DNA, 2120 bp, Homo sapiens
aaatgcaatgatcaactatgtggaggagatatgtgagaaatgccttagcagatgatgaagaaagagatcaaaaggctccgagaagcaggaatgctacggtggatatgcagtcagctctctgtatctgtgggttcattcaacctcggactgaaaatattcagcatttgggaaaaaagtggcatcccatactcaacatgatgtgaattgtccctttgtccagtggatacacactgtcaacacttccctccagttagccacttcaccatctcggtgatcagatggactgtcgaggtatcgcagtgcttgtgttcaaggcaccctcattttacctaataatggccccaaagcacaagagtggtgatgctggtgattcaaatatgccaaagggaagccgtaaagtgcttcctttaagtgaaaagaaccaggggtcctgataattgacagtggatctccatgaagtcaagtaattacttaatatatctattaccactaccaaatgtccaacctgccagcaacagaaaccaacactgagctcttcaacaaacacagtccccagaggagactaaccagccacttgctagcaacttgatcacatcagattcctttcaatctggaaatggcagtaattgattttgactggaattgacacatattccagagatggctttacctttcctacccacagggactcaggcagcatgaccacctgtaagcttatagattatatgataaactgacatggaatcctgcataacgtgactgtggaccactggccccattttatagcaaaagaaggacaacaatggacatatgatgataggataacaccatccagaaactgcctatctactagaggtttttgacagcacagctaaagtgccagcctgcaggtgatactgtgtccggaattggtgggttcttggtctcactgacttcaagaatgaagccgcggaccctcacagtcttcaggtagctgggtaagaagcggcaaggcaaacaaagggtcctggtaattgaaaacaactgatgagtcaaacctaagcattcggcattgggagcactgtcactaaaactgcagcctcattcaacaacacatccttatcgagcacttgcaggtactccattgaatgttagaaatgcattgatgatggagacacagcaccggctcatgaggaccttccagcctaggcagcaggactggacatacgcactttggtagatttatttttagaaattggcttatgcaagtgtggggctggcaagtctaacaactgcagggcaggtcaggaggctggagacccagggaagagttgatgctgcagtctctagtctgaaggcagtgcagaggcagaattccctctttctcggaggatctcaggctttttctcctaagtccttcaaccaagtggatgaggccacccgcattagagaagggaaagctagctgatatgttatgaggacatttgagcagccccatggagaagtccacgtggaaggaactgaggcctcttgctaccgttatgtgagtgagccatcttggaagcagatcctccagcctggttgatcctttggatgactgcagccccaggtgccatcttgactacaacatcaggaaagattccaaattagactcccccatcccaggcctggcccagagaaagagatgaaagctgacacgcagctctcagaatcacccttgctatcaggtttggcttctggagctgatgggaatctgagagacgtcagggtagaagccgcctgtcttggtgagcttcccgtgctcatctggctttgggaaagactctcagcctcatttgcttatcctccatcacggaccaagcacttggtttgggaataaggggcccttggcacttactgttgtgttcttggcctttggggccttggccaagagtcaggtggaaagagttccaccctaacatcttctcctatgcttcctcccagagcaggggatgggaaagtatggggagaaaaaggctccttagggaattacttcatgttaaaaaatatttactaggcacttaacacgtacgcagaaatttaccagtggctgaagtgggtaatagggatgtatcaattaactaataaactaattaattaga

SEQ ID NO: 1591 - DNA, 3034 bp, Homo sapiens
ctgcattttatttatttcagccttctctctctttttttcttagtctagataaaggcttgtggattttgttttttaaaccagctcttcatttcattgatctttattttagtctttttttgtttatttcttctctgagctttattatttcctttttagattgccaattttgccaattttgagtttggtttgttcctgcttatctctcgcctaagtcttaaagattaagagcttgtgaacagaatattggcagaaatatggacaatgaaggcctttctgatgaggtctcagatggaaatgaggaatatcttattagaaactgaaggcttgagaaaaatgtccttaagtgtcgtaaacttgcatcaaacccacttactcatcaaaccccacttatgacttcccttagaggacaagcgacatttcagctcagttatacactgcttttctcaattcctgccatttttttctcttcctttgccccctggcctacgtctccagctcactgaaaacagcctcccctgatgagcacaccattgttatgtaatagcctaacccttacccctcgcctatcagggggtgccaagcctgcagactcactctgccttcctcaaaactgccctgaggagaaggctgaagactgaggaatcctctttctgcctcccatttgactgcattttctttggtcaaaggcttccttattcatgggacctgcctgggtccaggaccccttgacaggtgctctctggctgcctgtcctctgggcactcttgtcccaggtctattgttttcatgacccaccaggatggcgcttcacttcctcagaaattgtgatccccaggaaagtgccccacaagaggggtggagttgagatgccagaccagctctcttacagcatgcgtttccggggccaaagacacgtgattcacatgaagctcaagaagaacatgatgcccagacatttacctgtttttactgataatgaccaaggggccatgcaggagaactacccttttgtcccacgagactgttactatgactgctacctggaaggggttcctgggtctgcggccacattggacacctgccgtggaggtctgcatggcatgctgcaggtggatgacttgacttacgaaatcaaacacctggaggcttcttccaaatttgagcatgtagtatctctgcttgtgtcagaagaaagaccaggagaggctagtagatgtaagactgaaggggaagagatagatcaagaatctgaaaaggtaaaactggctgaaactcccagagcaggccacgtttatttgtggaggcatcatagaaaaaacttgaaaattcactacacggttactcgtggattattcatgcggaaccctaatgtgtcacatataatagagaatgtagtgattattaacagcatcatacataccattttcaaaccagtttatttaaatgtctatatatgtgttttgtgcatatggaatcaaaaggatgcagtactattttctgctagcaggccaggccacgttgctgtagaactgtttggtgtgtggaaatatcacaatttgtattcagaaatttcacatgatacctcagttgtttttacatcaaatcgacttggaaacagtgagtgttatgccagctttgatggaatatgcacccccaactggggagcaatgtttgtgtatataatgaggtatcacctatttaggggggcatgtgttacagcacatgcactaggtcataacatgggcttgagacatgattctgttggttgttattgttttcgacgaaccaactgtctcatgaccctgttcctgatcttaatgatatgatgagcaattgttcttatgagataattcaacgcaagtttaatcaatgggatccttgtttgagtgctccaaatgttccatacactaattttccatacgtagctcctcgttgtggagacaagatcaaaaatcagagggaagaatgtgactgtggctcccttaaagattgtgccagtgatagatgttgtgagacctcttgtaccctttctcttggcagtgtttgcaatacaggactttgctgccataagtgtaaatatgctgcccctggagtggtttgcagagacttgggtggtatatgtgatctaccggaatactgtgatgggaaaaaggaagagtgtccaaatgacatctacatccaggatggaaccccatgttcagcagtatctgtttgtataagaggaaactgcagtgaccgtgatatgcagtgtcaagccctttttggctaccaagtgaaagacggttccccagcgtgctatcgaaaattgaataggattggtaaccgatttggaaactgtggggttattctacggcgagggggaagtagaccttttccatgtgaagaagatgatgttttttgtggaatgttgcactgtagcggtgtcagccacattcccggtggaggtgagcacactacattttgtaatatattagtacacgacataaaagaagaaaaatgctttggctatgaagcacaccaggggacagacttgccagaaatggggctggtagtggatggtgcaacctgtggcccagggagctactgtcttaaacgcaattgtactttttatcaagacctgcattttgagtgtgatcttaaaacatgcaattacaaaggagtatgtaacaacaaaaaacattgtcattgtctgcatgagtggcaaccaccaacatgtgaactgagaggaaaaggaggtagtatagatagtggccctctacctgacaaacaatatcgtattgcaggcagcatacttgtaaatacaaaccgagcactagttttaatatgtattcgttacatcctttttgtggtttcgcttctctttggtggcttttcacaagcaatacaatgttagggaagagaaaggaaaagagcccacacaatggagtaaattacattgacacttactgggagatataatcaatagtcactctgacaattacatcatcttttagcaattctgatgtcatcttgaaataaaatcacttggcaattt

SEQ ID NO: 1592 - DNA, 2366 bp, Homo sapiens
atatttgagatgctgaactttttaatacttacattcttaagtttttcaaggcttttctaataagtctggcattcctgcccttggcagtgtgagatggaagatgatgtcgcaagggtggccgagaagcagctgggctgagctgctaaaagcacagagaccggggccagactcctcagcctgaaatcctgcttccactaagtaccagctgggtaacttcaggtggagcccagttgacaggaaatgtttctccagaagctgaaaagctgcctggtaaaggcctttcataaaatggtctgcgtttgggaccaggaagacagaagactcctcaagaagagaactggaaccttaacccacttcagacttcttcatgtctgaagcttatttccaccatcccattgagaaccaaagaagcgagctccttggagaatcggctcccacctggaccttctgtttatccttccaatagctgctgcattcatccttcccagctaatgacacttccagcctttcgtgtttcaaagtatcacggactttgcaaaagattccaggtttctatggagcagatagtacttttaacaatcaacatgtgcattattatttcctcctaaggcatacttagacatcaatgcatgctacagcaaggcaacttatctcaccctcaccaagatattctgcactttcagtggcaaaattttaaagaaaaggagacaaaatggaacacaaattcaatatgactattgtcatccttccctcccaggaagtgtaggaatcatccaaagtggtaaaagagcagcgcttctaaactctgacttcacatggaaaataacgcgactactaaaactgataacaatagcagtccatgccatttgacaggggtgtgtaggagaggtggtgagcaagctgaaatcccttcaggtatttgcagaacttctgagcaaaagctaaagctaaaattaacattaaatatgcaaagtatttttaacccaacataaattaacaatgttcctatttcaattctattgctcttgggatgactatgtcctttggaaaatgtttaaataacttaagatttccgtcatgagtttactatttcaaaacttatttttttaactgcaagatacctttttatgttaccaggagtgttaccagctagctgccaaaacctggttgaagttctcccactttatattgtaaatgattacatagtttattagtaattgtgtcccctgtccacccactggtccatttggatgggaaaattttcaaaataacttcataagaaaatgataagaaaaatgtggtcaccggtatcatgaggaacttccagacagctcagcacagaaaagttggttttaaagtcctcgaaaacgttactggtaatgagcttccactcctttagtcgttgtgcatagatacaccacagagtaaggttataaaaataaaagttgtttcaggaaatttcccattgctttattacatgatcaatgagagtaaagagaaatggaagttgacgggataggaatgagggacctgctggaagagtgatcacaatatccaaaggaaatttaaaatgcctgttgaaagtgacacactgactcagcattgtcactaacacagaatcaccacaataaaactgccctgccctgtggctcctggcacctcatgtctctttaggttaagcagagagaggtctgtgttgctttggaacaaggtgcagcctccccctaagctacagagaggctctgagcaaggaccagcccccagggtgcagccttgcccaccctccacaggctccagagcagatggggtggctctagagagcaaatggtcaaaacttctagcgctaaatagagctttaacatgtctcagatactagcaaaatagagaagcctcagatggctttaggtctggaagtgtgttgctaaaaatgctaaaaatttaacaaacttttataaatccttaagagatctttttcagttttctgaagtaccgttaattgcccatgtgtttcaacttgcagacaggcaagaatttggctttgtatgtttaaaaatatgtacatcttggttcataatgatgatttatttccaaaatggtgactcatactaggattacatataaaacatcatatgtgggccttatatgtaataatgtgtaagtatagtatattaattactctgacataacatgggcagagatttgtattaatttatttctatttcatctaatcaatattttacttaagtctaaaaccttatatatatattgacatgtatcatcgtatatataaacattgtatctattgaactgagcaatctgtagtttattttaaattctgatacattaaagatgtggagaactacatg

SEQ ID NO: 1593 - DNA, 831 bp, Homo sapiens
ctgtgatgtggaggccatagctccactggactcatgaggagactgaggctcagagcaatgaagtgacctgctcaaagttaaggagcttcagtttggacccaatttgttctgatcctaaggtcactatccttaatccctctccctgtggggtcttccctatcttgagcctgtggacagctgtgcagtggcaagaaaaaggccttcagagctacgcagacctggcttcaaatcccagcctccctgatgagccctggtggtcttgcatgcttgcccttgggactcagacaccatattgtgaggaagcccaagctacatgcagaggccactatagttgttctggccaacagcccaagcttcagctgccagacatataaataaaccaactcttcaaatgatttcagtttccagacttcagtgcatcccaggtaatgtccagaggagcagagatgaaccatcctctctgagccctgcccaaatgcagacttgagaacaaactaaatgtcattgtctcaagccaccaattttcagggtggcttggtacacagcaccaggtaacaggaatagcccccctcttcctctgcagctctccccaggtacaggcaagctccccaacccatgcttcatccccaccccacagacagaacctggagtcagtcctcccacccacaactgtgccttccaaactaagctcaaagcccagctctgttgctttcagatgggtgccctagggcaagtcaccaaccctatatgacaaatccctctgtgtcaaatgggaattataatagtgcccctgaggagtcttggagagatttaataaagtgcctggaacat

SEQ ID NO: 1594 - DNA, 3519 bp, Homo sapiens
aaaaaatcttagtgtctgcaaaacaggtgggtttaagatttattgatattagggaaagtgaaattaatgagctactcaagtttctgtctttggtcatcactgagagtctatttccataggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaagggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaatgaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataa

SEQ ID NO: 1595 - DNA, 1579 bp, Homo sapiens
agcctccccgagtagctgggattacaggcgactgccgccaccacgcccggctaattttttaagtatttttagtagagacgggtttcaccgcgttagccagcatggtcttgatctcctgacctcgtgatctgccctcctcggcctcccaaagtgctgggattacaggcgtgagccaccgcgcccggccgacccctgtagggttttaaaggagagaggcagcatcccagagggcaaaaagggcttcattcatggagaaagcaactgagctgggcagagcacagacggaatttgaattggaggccagaggcaaagggaactccaagtggaagaagaaacggcatgaaaaaagggattgagaaggaaaaggacaagatggtttggagagagagcaacttcagcctggaaaagcagaaatgagatgcggccaagaaaaagactccagcccagcctgccttggttctaaccctgactgttacttaacctctttctggctcagtcaagaaacttgagcactgcaagatgatcatgtggaatacctacttcaaacggatgttaagaggagtaaaagtgttcttgtttctaagtgcttgaaatgcagctggcatataattaagctatgcaaatatttactttttttttttgaaatgctgagtttactgatcactctaatttttacatatgtgtgtcattacagaagattcaggctttagcgatgactggagggtcattcgctggaaagaatttcatcagttggaactaaatcatggtgagcaaaagaaagtctacctaagtgatatggtttggctctgtgtccacatccagatctcatctcgaattgtaattcccacaagttgtgggacggaggtgattgaatcatgggggcaggtgccccaatgctgttctggtgataatgagtgagtccccaagagaactgatgattttataaggggctcttcccccttcactttctcttctctctcctgctgccttgtgaagcaggtgcctgcttcgccttctgccatgattgtgtttcctgaggcctccccagccatgcagaacttagtgcctcactttggagtcggctgagaagatcattccagacgggagttttgacactgtacaaatgcactgtcttcacatctacgctgacacccctgcctttctacctgcaggtgtctgtggcttacaagctggtgcctcccacagaccctgtagtttggagctaatgaagagctgagaagctaccaggatctgcaactttttgcctgagggttttctcagaagacacagaaactgttctgcctataagccttgaagtgccagggaattaacacctaccttcccacagccctccccacagtgactgatagcattgataacgatacccaagcttcacccctcaggtgggataactgagctgcttgttctataccatgttctagagtttctcccatgagtttaggttctaatcatccacatgtaaattgcttgataagaaaccttcattgactccttgtctcacttcccctccccttatttgttttgtttgcacctttcaaataaactattttcattcaaa

SEQ ID NO: 1596 - DNA, 1795 bp, Homo sapiens
ccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttgtctagggggtgagctgctggtctgttcttggaggcaggtcagggcatggccttggtcaagatggggtactggggttggacagggacaggcagaggtgcctcccactggggctggtggcaggacagtacccatgggcatggaggtggttccatcatgtacaacagttctgggttcatgtagtggaggacgtgggcaggttggagtcagtggggaccctgggaacagagaaggcactgactcttaagatgatgccagtcctgggagagttgggatatggtacttagaggagaggacaggcccatggagaggggtgggaagatgggacagctttgtttaagagcaggaactttggagacagatctgattttgaaacctgcccctccactgcacagctaggggaccttggtggcatctgtttatctgtattctgaacagtatctgttcagagggcacctgaaaggcgctccagctctgaggagggctgccccgagccagcctgctcaccgtgagcactaggtaccagagtagaacatagagtaggggttcctcccctggcctcgtcagggggtgttccagagggaaggggtgggagacctcctgggaaagatttcccagctagctgcagaggtccctggtgtccacaaactcagtgtcagctgatgcaggcatttatccacctccgtgccatcaaagggaccaccaaggccacagcggcctgaagccggtgctgcctccatgagctgcagtgccactaggctcagcacatagccaatcctaccatttctcgagggcagctgaaagtgtttactcaggtagaggggctggacagggtagggttgggtcagcagccagtgcaggttgggcacagccatatgttgttatctaccttgaggagttagttggtagcaccagcatctttgggtagaattgcttctgacccttggtgcccaccagccccaagaggttcagctgcaagtgtgccactgaactgaggacacagcaccagacctgaatccagttcacatggaggctgcggctctacagggtcctaggctgtgaccacccagcacagcggcgtgacccaggaaaggtggattcaacagtgcaggtgcagtgacaagtacagaggcagctccactccttcctcgtggccaaagtttgctcccttcttcagaagtttgggagtgtgagagaatatgggaaggaaataaggaccctggagagaatgaaattgccttcaaagagcaagtgggaagttcctttcatttccagccagtgaaaaatggtcaaggtgtcagcaaacctcacaacaaatcccaacaccaagtaa

SEQ ID NO: 1597 - DNA, 541 bp, Homo sapiens
gtcgatgggtttgtgggcgcagggcgcgaggcgcgaggcggtagctgggctagtcctgttccctggcgtctgggcctttctgctctccgcaaggagctgggtcgcgacctgtcactgccagccgtgcgctcgccctctgcgccccgtctcgtggtcactgccgccctccctcccgccacacctgtgatgatcgctatggagccgcgcctcaggtggcattactataaacctaagaggagaggcgcccgttcgaataagggcaaattatttagtattttgtcttcaatgttcctggcagcttaaagtaccaactgggacacttgtcactagtttgagaagtgcagccatagtgacctcttttgaaagatgaatcaatgaattaagtcatttctgagaaaccaaggaggcctgttgaaggaggctggccctcctgtggcaggtaacccaacctccactgcccttggcaacaggacaaggctaatattttcccaagaagggccttttcatggaatgatctttccaacccgttgactacaacaag

SEQ ID NO: 1598 - DNA, 1535 bp, Homo sapiens
ccgagcacatgggcccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagaggtaagtggcttacctgaggccatgtgctaacagagaagatgaagagatgattgaaacaggcctaagaccagacctaagggtctgtacattttccacatactttccatatctttagaggcctgaccaaagcagatcttttcctttcttctaggtaagtccaaaggcacctgcctgctgggcccactgttttctaactttcctaactttctgatcccttggaggtgataatcaaatattctagtctgaggcattgggatacatggtgctaggttctgagactctgcgtcaggcctgaaccctgcattttgtggaggtgggtgggagaatgttcccctggggaacatgcctagacacgggggacaacagttgccctcatggggaggtacctgtttactcgctgttatgggaccgctttcacaaaaccactgcaggtgagtgagttcctgctgaatatcaggcctggtgtctctagactcattatttcccccacccaacccctatgttagttcatctcgagccacatttttattgccataatccaggcctggacaggccaagatcttttaacaattttaattactgaaaataataactgcattttttttaaagcccaacttttggtagagtcagcccaaaatacagtctttgtgttgccatctgggaactggatttggaattgttcttccatgagactgcagagcagaacggcagggccagaggtcccacgagctggtcagacccggttctgctccttgctggctgagtgaccttgggcatt

SEQ ID NO: 1599 - DNA, 2051 bp, Homo sapiens
tagtatttatgcattgttttatgaacataaaacaagcgaaactgagtatgttgaatgaaaatttagaattgaaacatcccattcctgatgaatatgaattactaaagttttagtctaaaatgactagatgatataatgatatatagcttgagaactgataatagcaagtaaatgaaagtcaatttattcagagaattgaatgggaaactaaaaccatttaagccttttctataaaaaaccatcagctttatgaatcaccaaattaaagaataaatatactaagataaaagtttccccattatattacagagaaaaccatgttctgagctatggacttttatacctggatgtctaatctgaggccatcaaaagaactcactcatagatcagtttgcctcatttcatggtctgccttggattcccccacacccactgatccaaagtctgtggaatagggaggcaccttccagcaaagaaggcagacatgaaagtgtacattgtgatctctctgttacgaagttgaagaactggccaaactgatgtatgttaataggaatcaaaacaggggctgcgtgtggaggggtggacgatgttatttgaaaagttacaggacagattttctgtgttaatggacatgagccatacattgagagggctgctggctactgaaagaaatataaaattttaaaatttctgaaatcatgcagttaacatctgcacacttcactatattttaagtttttgttaatataaaagaataagaaaacagaaaagtattactgttaaacaataatagagaaatgtatactttatttacaaatttctccctctagctgatcatacagttgaccagttcagggtgcccgctgctggttggatgccaggcggaatgtcagggtgttctctggtgtctgttgtggctgtgggatccacggttactgggcggagccctgtggtggctgtggtgccatggaggggctgcgatcttctgtggagctggaccctgagctgactccagggaagctggatgaggagatggtggggctgccaccccatgacgcgagtcctcaagtcactttccacagcctcgatgggaagacagtggtgtgtccacacttcatgggcttactgctgggtctcttacttttattgactttgtctgttaggaaccaactctgtgtaagaggtgaaaggcagcttgcagaaacactgcattcacaggtgaaggagaaatcccagctcattggcaagaaaacagattgtagagactgaggcatctttaaaagatgtcagggtacagaaaaagtctttcaacacccccggctttgtagatgcctacaagaaggtgaatagcaccaacgagatgctgatggagaaatttaccaccctcgttcaagaactgaaagaagagacatcctccagactctccaggcaacaagaggagctggtagagatgctaacaacgctggaggccctgggagaggccatgagagccaccccgtcacaaggagcttttccacacctgccatgcagctgagagccaagccctgctgctctctcccccacgagggggctgggtcttagagcagcactgttcttttcccctccacccaggcctcccgagctgccaggctctgtgctcccacactgactccatctgaggggtccttgaggccagtggatctggagtaccccgcccctggcctggagttcctcctccttctcacgctgacactgcagccagctcctcaatgggcggtgcctccaaatctaaagaatatggaggtcctggagcacaccaagaaatgagggactttttctttgcagaaagtttgaattctgtcttaatgagacagaatgccatacttgagcacctcatcttttgctcaaattgaaatgtcatcgaactgtatttctcaagtcaatggtctgtaaatatgatttatgtattaatctcctaagtgaacaatttatattttatcctctacataattatcgtattatgctttaaatatatatttagtttatcaataaagacattcagtactcaa

SEQ ID NO: 1600 - DNA, 598 bp, Homo sapiens
acccttccagctacagctccctccggtgccccagaaccgcccggcactccggggctcccaggttcatctgggcatgactccgccctcccgacagagccctctgcacaccccctccccaccctggcccatcgcagctcttcacgaagacgcttcatggaatgggtgattttcctaagcacttttctttccatgatctcatttggtcctcacagcacctggaggagggcagacaggctgttgctccattttacagattttccagaccaggctttctgagaggctgttaatgagccaaaccattctgctaaccgtcgttttcagaagggccacccggctcacggttctctttattcaggcaaagccatcaagaccccgggtcttcctctgtggcccaggctggagtgcagtagcgcaatctcggctcactgcaacctccacttcccgggttcaagcgattctcctgcctcagcctcctgagtagctgggattacaagctcctgccaccatgcccagctaatttttgtatttttagtagacatggggtttcaccatgttggccaggctggtctcaaactcctgacctcaagtgattcaccct

SEQ ID NO: 1601 - DNA, 2684 bp, Homo sapiens
agagctctcattttccccccttgctcgggatggtgccacaggaggctgtgcgggccccgctccgcttcgaatggctggtcctatagtacccctcctcaggaatgtctccccagtgcaaggacaaagactgaagagactgctatattgatggactctcaagccaactatgaagttgaaacaaagaaagtgatcacctgaagacacctcctctgctaagaaacacccccaaattgtgcagcttctgccactagaactctcagaacaagagacaatcttttcaagaaacagaaaaactcaataatgacatctagattttcatgagccaagaactttcccttcctcatgtgtattcctctgtttgtacttaaattcatgtgacattcatttttttcctagtatggatatgcttattaatgcacttgtttcaaaatcccaaattgcacaaatgtgttaatattttaagaaacaaaatgaatcctacaaggagaatgatttttagccacacatagggttggatcttgagagtgacctacagaataaaagtacttttaaaataaagtagtcagaggctattcaaagggtaaaataatcatagtaccacattggtccacttgacactaaccaatcgatcatttttttttaatcaagaaagctagattctatcagataaaatcactgcttctaaagagtttaaatctagttagaaaaagttatagaaatgtttgcaaagataagtaacagatagagtcagtagaggataagatcaaaaacaaaaccaagcaaaagatgagttcaggggagtttgccatcaagttggcaaaactgacttacttagggaagaaagttataaaacaggaaaatatgagatgaaccttgagtgatgtggaagatttagataaatggaaaggaaggagaaaatggagttctttaggtggttgtaattggaggaggaaatgaatacacacatcttgttgacttaaacccagacattcagcagctctctatacatatctggaaaagactgcacagtcacctcctgtctctcaccccaggtattacttagaattattatcatatttcccttcctttaaagtaagtaagggtgattggtgacaatatggagaactatgatttttccattaacctaataataattggtatttattgagttctgttaagcattttacatattaactcacttaagcctttcaacagccttgcaaaataggtattattatccccattttacaggcaagaaaactgaggtttaagtaacttgccgaagtgccatatacagggctcacattcagtattgcagttgcaaagctcatgatctatagtgccaagttgcaatattgtagtcaatgtcacaattattacccctttttatattccttgatatttttccatggcaaacaattagctatttcatttaataatcacctaaaacttttcagtcttctgattaaaattacgctggagtgatagaatgtattttcatgatagaaattgggaaaaaaaatggggaatgaagtttatcagcatttcagacttgttttttttttttttttttgcaagactttgatgagattgttcacttttgtctatgtaaaatcccaaatccttgagaataaaaaagggggaggtttaagtcacttgttgcaatgccctttttaatagaggcaataaatctaaaggccataaatttagagtgacttacagaagatcgaactttggagtgtggcagagtaagggatggaaaccgggccctccagttcactatcagtagcttttgcactggtctgcccttcctaaattaagtatgcacttcaatttgatgagtggaaacagtctatctgggcagtaaccagggagctttgtgcctagtagattgcttctgttctgcacttctttggtttcccacctcaatgtaaaaaatagctagcaatgaagtccagaagttgtcaatggttcatccccagaagaatgcataatgtccaaagttgtatgtgtatgatgtcttcaatggtattaagttatttcaaattcttagttcacctacataaatcatttctaacaagcatcttcttaaccaactttatgcacagtgtatgtttgtaagtgcttctgcacgaatgtttatacatgactgtttccatagtacttatgtttttaaaaatattcagtcatttcctactataatcctcatgtatccatgtaactgactcaaaaatacttcagccacagaaagctaaaactgagcaaatctcattcttcttttccatcccctttgcatgtggctggcatttagtaatgattaataatatggccagctgaataacagaggtttgagacacaattctttctcaaaggagtcagctaagctgggtctacttatggacaaacatctaaatgtgtggaagtatctgatatttgacaatggtaaatttccacttagctagctagcattgtcagacttcaatctcctcatggctctggccgtcctgttttaagcatgataattgttggccacatctcacatagttctcattgagtgagttcataaataaacagggtttttttttttttttaaagagcagccaagcacaaagtgtgactttgttgacattttatgtgactttgtcatatgttcctaacccccaataaaagcaatgttgcatcaa

SEQ ID NO: 1602 - DNA, 725 bp, Homo sapiens
gaccacataggattggtatgcaaaattgtatcagaaaattagatgaaacgcaattgttaaaacatagtgaagtctgtttcagacgtgctgtattggcacaactaaccagataggtaatagcagatgctgctgaggaaatgaaggcaactacacaactactgtgggaaacagatggggaccagggagtaaggtgacgatgtgtgcgccaagtggcctaaaaacccgtgaggaaactcacacggtgcatcaaatatgagagtgttcacagcagcactgggagcagcccagctctccatcaaaagtcatgcattccttcagtggaataaataaatgaattacagctacagaatctcaggaacaaaatggtaagctaaaaaccaagtaactgaagaaaacataatatttcacttatataaagataaaaaagttttaaaactaaacagtgtatttttaagagattcaactgtgtgtgggaaaagcataaagaaaaactagagaatgatgaacaaaaattcaagacagtggttgcctctaaggtggggaagggccattatcagttcaaactggaaaatggtgcaaagggaccttcaaaaatgatgatactctcttaaactgtatgatcagtacctaagtgttttgtgctattgatattctttgtgtcatacccatttttttcatatttattagatatttaataaaaccagttttaaaaaatacaaatccaa

SEQ ID NO: 1603 - DNA, 580 bp, Homo sapiens
acttggaccagactcagtgattcaaaacagtttcttggccacatcctttccaattgaagctgaaaatgggcagatgtgtaaacaaccctggacaaagaggaaagcaccaacctccatgtacttattcaaaccagaagccaaggataatcctttagcagtgttgatcataatcctgaaaatggggagaagtaaaagacatagagctcatttggggaacatttcaagtcaagtgagagagaattatgaccaagggacagttgaaatgaaggttgagaagaaaaacctggcccttgttcttagccactttaatgaagcatcacttgccacagagaggggaaaatagcaatttgcattctgagataatttaagactaacctttaactatatgtgcattaatgtatggctaaaaatatgtatcaagattttaaaattattaaaggaagcttacagatgataaagaagataaatatttgaaagaaaaattaatctttgaatatatagtctgctcttaacaagaagcactatgtgattttattctttgatagcaaagattgttataattattaaaacactctcactc

SEQ ID NO: 1604 - DNA, 537 bp, Homo sapiens
gtatgaaaggagggaagcagctataaattagaaaggagataggaaagtgaagatatttactagactctgcctttgcttgcagttctctggcttgattgaggaggttctcactttcatctttatgggactttggctaaaaaaataaactgtcaaaggaactggcatttgctgactggactacagcacatctcgaagaatctgcagactgaaaccttcaaggcattcatgaaatggtcttcccttagttcccctgccttttccactctttctgccatttggatttcacactggaagttcaagagatgacatcagaaaacagaaaagccagtgggaaaggcaaggtataaagaactttcagggaatactcacatcataaattcggtcagtggtgttcaaagcaaattctgctgtttcattggcttcactaacataattaacaatattttcatagacatttgatgcatccaaagccttctgtaccagcccgttcatatctgaactgtgcaacttcctgttaataaacaaacattgttattt

SEQ ID NO: 1605 - DNA, 672 bp, Homo sapiens
agagggaagaatgagaagtgactacttcatggatacaaggttttctctgggggtgatgaaaatattttgacatctgataaaggtggtggtagtacagcactgtgaatgtaccaattgccactgaattgtgcattttaaagtgattgattttatgtggaacaaatttcactttaattataaaaagtgaataaacttttagaagctaaccttggaagaaggtagagactggaagggatcacaagaaaggcttctgggatgttggttgatttctctaagaagtacatgctgaaatgaagataagagtacaaaatatttatcggagagtagtaacacagaggagacacaggatttggcagaaacactaaaccatggtgaagaccggctaaagtctctttgtccaaaggggagctctaaagtaaatatgagccattaagggagccccacactggatggaaatggccaagcctttttacaaccaccttctccttgagacactgcctgcaattcaccctgggaaagcaaaacctcaactgtttctgcctcattcattctttgtcagtgccgtaagaagattgagatttcagcttgtaactgttgaagcaaaacctaaagtggttaataatgggagtttgtcacaactatcttaacacaaatataaaatatttgcatgaa

SEQ ID NO: 1606 - DNA, 561 bp, Homo sapiens
taggtgaagaagcccattggaaaaggctggatactgtgtgattccaactccatgacattcaggaaaaggcaaaaccatgaaaacaagaaagatcagcagctgccggggctgggcagagggtgactggcaggagcacagagtgcaggaaggatactgaattccttgaaacgttgacctccaagatgctaactcaggtgggaggaattcaagacaaggaaggagcctcttttgggttctggttccggtcccgctactgaaaacccctgatacagttcaaggagtgcgacagcgctggtttcaaatccaggtttgcagcctggtctggcgtggagaggttttactcttgggaggcccaggagaggcagagggtctgggccagggagggctggtgtccacggcactcccggttccgggctccaagtgtgtggggggagggtggccactcaaaggagagagcctcagaaggagggcactggggacccaggtactgctgaacccaaagaaatgagccgttaaaaaggagagaaatgtgtgtggaagcccggagctccatgggcaggg

SEQ ID NO: 1607 - DNA, 825 bp, Homo sapiens
ggcggtgctggggtgcaccagggcagcagctacaggccctgctgaaagggttgacaatgaagactctcaggccaccgtaactcatggagaagccctgagcatctggcccgcttggtaaattctgctatgtctcctccagccctgaccaaacttcaaatatgaggaaaataaacattgtcatatatcaaccggccagttcccagcaattcctgcctgcgtgcccatgcaaggggaggtctggtgctgcctcctgtagtaactacctgtggagccagctgaactcattttcccctgaacttcagaaagtgccagaatcaccccagagcacttgagtacttgccctgtgaagacagcaaggaaatgggagaggatttgaaggatttgcttaagagcggctttgaagtcctccaacagggtgagagagccagctcagcacagacccagcctagagaaggagcatttttctagtgggctcatctttaatttgcaactatggcacaaaggaaggagcagctgtggagaccagggcattggtgaaatgaaagcatattgtttccctccatcttccccaccctggggaggccagggtttctccaaggcagacactctctaagtgaaatctatggaattttggaaacaagataaaagacatactcgactgcaatgcacatactcaccgtggagcccggcacgcagggtaaagactcgctgggtttgcattgcacattctcactgaggagcccggcacgcagggttcagactcgctggttttgggttggtggacttcattttctttcacgctgctgcttgcccagtgggtgtaga

SEQ ID NO: 1608 - DNA, 3197 bp, Homo sapiens
agctttctaaaatctctttaggggtgtgcgtaggctcctgtgtctatgcctgcttttgactgcccagttgaagcctcttcctatgccttttaaaatttcacgcactataaggaggaagagctcagggctcccaaaactttttatttagagggaagaatgctagggagatgggtatgcagagggttgaccaaattggaagaaaatatttattctgtagtttggtgttggaaaagggaattttccaatcagccacacctcagtgttgcggcaaaataattcttggctcccctggaaacgcatgggcaaggtagggcagagctgctgctgctgatactgccaccaccctgggcttcctgctgactctgggctactccctggggacaacagatttgcattgacgtccggggctgtccagaggccctcaagagccagttgtgagctgagcccagtatgggaaagatctaccttctggaagctactactacgtggtgcttggaaagaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgct

SEQ ID NO: 1609 - DNA, 441 bp, Homo sapiens
ccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctgttggaagttgactgcagttgaataacagaacaaaaacggagcttcaaaatcatggcgtgcctgcttcttctgggttcttttaactgcaagcaatcagctttgaagagcacgtagggaacttctgatgtgatacaaacttttgtctttttttttttttttgtcttttaagagcattcaaaaaca

SEQ ID NO: 1610 - DNA, 570 bp, Homo sapiens
aaatctgcaaaatctgtcttaaagaaaatggtcagtctttcctttcttctaaacatctctgattttttcatcttgtttcctgactattcacagacagcaacaataacagattctggaaagaaggatttgtagtatacaccacttgcctcactgctttatccaccaacggaccctttatctgggaccaaagattctgagctgaaagggccctcagagcagccaaggcatgcatgagaagagaagggctatgaagtggaagctgagggagcgtggactgcaggcttgggagagggagcatggtgtcctgcagagccacatgctggcagaactgggtctacagacacattttattcagtccctaaaccacagaaagtgaggacttctaatatgtggtaccagagtgtgcagcaaagaaccttctgcaaagagctttggctgcagatgttcaagatttgccatggactccagaactctcaaatcacttggaaatttgtctatgcagcattatctggtgtcatgcctgagatattgaaggaaaagccccagcctttcaggggtttctgagaagaa

SEQ ID NO: 1611 - DNA, 637 bp, Homo sapiens
cagaggaaagctgaggtcaaggaagttaaataaatggtatctgagaacctacctctggtgatggtcatatcggtgtctccgagggtcgtactcgccccccacgtccaccacgatgtcacaggaagcgagtttttcgggatcccgggtccgcacaatctctgcatcctgcgagaatcctgctcttgtcaccgaggctggagtgcagtggcacgatcttggctcacagcaacctccgtctcccgggttcaagcgattctcctgcctcatcctcccgaacagctgggattacaggcatgcaccaccatgcccgggctaactttgtatttttagtagagatggggtttcaccatggtggccaggctggtcttgaactcctaacctcaggtgatccacctgccttggcctcccaaagtgctgggattacaggcgtcagccactgcgcctggcattgttaataaaactttaactcagtgatccactgtggggtcactaacacaaatttagggtctacaatgcatcggtcaatatgctaacacagctgggtgtggtgagaatgagactcttctcggaaaaaaaaaaaacctgctaaccaaagatataaaaacgaacacaatatggtattaaatgagtctgacat

SEQ ID NO: 1612 - DNA, 579 bp, Homo sapiens
ccctctgcccctccgcccctccgcctgtccgcctctctccttctcccttgttccctctctccctccctgctcccccacctccctcccgagtcgtagactcccttccccccggcgctgggagtctccttcccgccccgccgcgcaggtgcggcgacggccgcgtcactggagagtgtgtcgagtcacaggcggtcttccgcgcggagcgtccccggcggacgctgcgcagatggctgcgactgtaggattcttgccggctagtcttcgtcggttccgcctgcgtcaggttactcgtgaaaactcgaataagtgctatcgatgtgaaatccgaggaaaagagcatttgggggaaaagttatttccttccaatcccatcccaaatggaggttgcagcagggtagagtttttggacaatcttgtttactgctgcatccccagtgtcaagaaggctgcctgaacatagaaagtcttcaatatatatttgctgaaataaaagtaaaaattcagtctggtgtctccataatcacagccatggccttgtaaacaggtagtgatgcggacagagccatctgtgctgcg

SEQ ID NO: 1613 - DNA, 563 bp, Homo sapiens
attacgtcgaaatagctcgagctgtaacctagggtaaataataattccttttcgtattcatcaaggtgcttctaagtgccagtgccaggagtcttgctctgttgcccaggcttgagtgcagtggcacgatcttggctcactgcaacctccacctcccgagttcaagcgattctcctgcctcaccctcctgagtagctgggactacaggcctgcgccaccacacctggctaacttctgaatatcaagctgaaattactatcagatatcttgccaccacatagaggctttgagtgaagtctgcatggaggagaacagagctgagagatggaaagatactgaatcccagtgacgtcctttgagatgtcggatcaagctgagctgggcatgaagatagagctactcctatacttttaagataccaataacaagcaagattcagaagtccaacaagtaagacattgatttcattaagagagaactagtaagcaagctatttgggaagtacactctcataagaatattgtttcatgaagtcttgagcaacaaaggaaatagtaagtaag

SEQ ID NO: 1614 - DNA, 1093 bp, Homo sapiens
acaattatacagcaaagtctcctgggagggtttatatgttaagctctgtcagtaatttctcccctagcaagaatgaggaagatgaagagctcgggtatctgagggctggtgtgtctgcatgcgtgtgtgttttgggggccgactgaaggaagagaaggctggagagagggaacatgggtctgagggcacatcgctaaggggtcaagaggcctaaaggaggagtctaaggctctccatcgaacttggacttggtctacattagactttaacctccatgaggcttggactttcaggcttcctccctcacaccgcgggcaggtgaggcgtctgctacaggcctggtctcgcagagggggcccagcgccccccgccgccgccttctcctggagtctgtgtgacagaatgggacctgtgggaaagcagcacgtcagcacccagccccgcttgcgcgccagcagctaattaaagccaggaaggtgatggcgattttcaactcattcccgttacaaacagccgaccttcctaccgagttcaagtaccttctgcctggcctggaagaacaatatctctctgtctccctcttccactggccctcacctgccttcccctgaacatgcattttgcctgacaggagacagaggcagttgagatggagtcttgctatatggcccagctggtaatgcctagattcttgagtccctccctggctcatccctgggagcagcactgaaccccttgtctgacacctgtctggaaatggagcctgcacattgaccctagccatgtgtggtcttgttactaagtgttagccagtgagagaacatacaagaggaggcccatgttgattcagaggatgaatgagagatgcttgcagcttggtccaggaggccagcaggaccagagagaagaccacagcgacacatggggatggctgtcccacaggcagaaatgagcagccgggaggaagcccaggcagccagccacccagctccctccacatcgtggccctagaacggagtcttgaagaataagaagccacagcttgtcagggaatcaggctggaaaaatgttatgagactgagtaagaccagag

SEQ ID NO: 1615 - DNA, 975 bp, Homo sapiens
ttcactggcatctcctagggaagtttttacaaaatggattcccaggcctcacccccagatactgagattctgttggactgaggttggctcagggttcccagccaaatgattccatgtaaaatgtggaaggtccaaactctaagaatccagtcttagacagcaccaacccattgagtccctgcatattctgtcacaggtaagctctttcttgccttagggatttaagctgcagatggaaaatactaattgctgatttaccaacccatagacatactgccctccataatatttaatatgtaacttggaaaaacgaaacaattctgtagaaaacctctgatgtgaattacatcacactaacaatgaaaggggcccaggccttagcaaagcataattgcccatcctgctttcacttctcaggcccgctcccttccatgcgatgcagcttgctgctccgtaactgatctaaggctttgtgacagctcctctgttttaagcaacagtaaattcaccccacaaagtcagaaagggagcttgttgatggctgctgtcaattttattgctttaacctgtttactaggatagactctgtaacatggtgtgtttattggttttatgtattgcatgttgttgctgctctgacaagctactcctataaaaatgtgttattattgcacgatgtagctcagtgagctgaccctgcatttcaaagggtactggagcaaatagcactgaagtccataaaagctgactggcctccatcacagaggactctctgcatgagctgcaactcctacaacccaggagagaattacacctttccctgtgccagcagccactgcttagtacagcacagcccttgaacacaggcaatatctgtaaaattccaagacagaaaactgtcgtgccattcttatttgtccaactctccaatcagtgtagtttgcaattttgatgtttataaaagtatgaaacaaa

SEQ ID NO: 1616 - DNA, 92 bp, Homo sapiens
ggatcgatgatgacttccatatatacattccttggaaagctgaacaaaatgagtgaaaactctatactgtcatcctcgtcgaactgaggtcc

SEQ ID NO: 1617 - DNA, 1544 bp, Homo sapiens
atcttggactcggttcgaccaggtctggtgaccggcgacgaggggccgggctcggcgccgggggtcggggaaagaagaactaggtctggcagtagatcagaatctacctgttggggaaaaccagaaataggaagaagagttattaatggttcattcttggctgagaagaattcagtatggaataattaagaactactatcaatgccttttacaaaatgaggtcattggattgcagagttggctttcgagaagattttgtggcctttctcagctgtctaggtgctgtaggtgctgtgtttctatggctgcaaggatgaagattatgatatggatggatgatggaaggaaggatctatgaatataatatttgagtttcagttactggcctttacttcttccagaaagtcaggccaaaagaacaaagtcctagaaggtcttctggtgagtcacattctgagcagcaaaactggcattgaggcataattaacattcagattgcccccagtttctatggagatgagtctagcccctcgggggagtagtgatggatgtgtaatctccaagataagtaactgacaggctgtattctaggaactcaaaatgaaagaaaaataggatatgtttcttactttagagaccacagaaactagtctcctatattggaccttcttggtaagagccccatcccttcaaaggccacatgaatctgaaggccaatattcaagtcctatgctgttattatcaacttggatgcagcgagtcatctgacctgacctgtggacacagcctctgcatctgttgagaggattaaagaagtctaattcacagttactgcaagtataatggagctgagaggatggtgtgagcaatagcaccaatgtaagagttatcatagattaacacactactggttctgatgcagcacataaggcaagtaccatgggaatgcagaggagaaagaaattagggagatcaacaaggtttcacaaagcagctatggtgaacttggccttgagagtagggttttcctggtgaagaaaaacattctaggcagaagaaatagcatacacaaagactcagaggcaccaaagagtcctgtgtgtgtggtgaataatgaacagaaattgccatagattaggtgggaagtcattggtgttaatttataggtttgatagaagccaattcttgaagggttttgtatgccacagtaaaggacagagttttatttaaggagccactgaaaagcttcattcattctacaaataactttttcggtgagccagtatgtgccaagcatggttgtaagtacttgtaatacatcagaataataataaaaagagtattcatgtacccaccacccaatttaaaaactaagaaattgtcaatccttatgtaagtctctgtgtttcccttgtcaatggaatccttctccttgctccccaaaagtaacccaaacgctaagttttgtgtttgtcattttcttgtttttcatttcagttttactcatatgtgaggaaaggggcttaagaaatatttgctcaatt

SEQ ID NO: 1618 - DNA, 3481 bp, Homo sapiens
cttaagtacccagattttcttatgcaggaaagaaacatgaagtaagatttaagccttgaaagtatcataaatatatcattcttcaaattgattgtgatgaaaggaaataggattctttctccttagaattttcactgatctataatgggatcaaaaaagtagaaaaatcagtctgcagaatgaaaacagattaatgaaatagctagaaaggaggggagagcatttgtttagttaaatgttaaggtaacttgaaaattgtctatgaaatgctaaaactgtaccagagccttattgcacactcaacattttaagcctgggagcaggggaaggtgggaaaaggttggagtgatagaagtgtttgccttatgatctcttgactccttttacacaagaagcagattggtagagcttaagcaggtgtctgtgctgtggtgctggctctgccaaaaactctcatatgccctaggaaagttcctttaacttctctgagcccgagtttatctgtaaagtgaagactttttaaatttagtaatctgtatgtctcatctctgagaattctataatgttttcacattgttatatgtgtatatgtacatgttgctcccctctagtcactaagatgccacatatttctacttgagtgaacagattgcaagtccaaatgttcttgtttctaatactaataattgatctcagcaagacataaaaaagtaaaaaaaaaagtaatcttaccttttattttgaccttggctttaaattattatgatttatcatttcatctttgaatgctgagtgaattacctaaacagaatgtctgttccagttaatcttctctttaaatttttgtagtttaataaacatgtaacaaatcagaagcaagtatatcatgcttatcgatgaactgtagcagattgtaatggtgcatttttgtcacattaaaaagttaatgtccttttggtcccagaagcaattactataatttaaaataatattcacaaaattttgtgaatgtttttgaatacaaaggaggcctaatacagccatattgtagttcattttgctcaggagtgagaaacaaaattcagggataacccaaacatgtctgtttggcaatagtggatagttaggtaaagaagggttatagcttttgcacatcacagataagaggcgactatacctattgaaaaacagcagtatattctggttcttggttttatgatggaaagatattagaatgatactaaaatttggatgcttgggaaattgaataatacagaaatattttgtcatactgagattatttgtccagaagtttagtcttatatcccttccattcagaaaagggggcagtttttaaaggcctctgtcataaaaggaaatgtatattttgactagtggagcaattagttaaaacatttaatctgatcattttggttttatgaatctgaattttcactttaggtgtaattgagtcgcttatgtattactgtgatctttgtgagaagtgatttcgtccatttttttaaatctgatgaaacttgataaatggtgattctagcatattgtgttaatactgtatcttacaacaatttgtgaactgaccatcataaacgaatcatagtagtatctcttctggtaagttgtttctatatgtgatctcttaatgctgggtttgggggtggggatggggttaagtatttagtttactttaaactgtcaaagtgtttttcttaaatgccataaaattgtatgactataagccaaataagaatattctcttttttcacttttaagggcactgtatagaccatttttgaaactatcccacagaatggtataatttcagtttaaaagctcttacacacatacacacacacaaatataaatatatatatatacacattcaagggaaagcaaacagtgtatgtagtatttctaagtgacatgctacacgttataagaatctatttttgaaatcttatacagattatgcagaagtcagaataacaaatacaacacctcaatttttttatagagtctagcgttagtttactataagatttgcttacatcatacttgcaaagatcattcacataatttatttagcattgaaaatctttatatgaagtactaatgtcatctgaagtttagagattaaacaaccaaggtttagaaagatcaaatgactagtccaagataatatggccaataaatggctctaaacctcctatgttctttatactattcactttttgtcatgttatttttatcctgtcactgccattatctttaaaactttgacaaaaatttaattttaaaagttacattgggaattttcagattttagtgcaaagacattgttgctgttcttgtcagaccttttcagatacctccagactatagcccttccacagggtgatattcaaacattttccacctaaacatataagtttgcacaccctgaccacagacactgaattcacttgatgtcagaatgctagactaaaagttgatcttcttgactgacatttctaatctccctttttaaaaatccatcataaggactgacttctgaacagttgaataaagcagtaatcaatccaagaaactgcatccattctgattcagaggaaaaaaaaatccaacctagtgaccatttttcagcatactgtatttcatcacatttattctgtgattagtggaggacagagaagagggactggggagaaaaactgcctttattttaagaaagctcattttcctgtaactattcaaaaagaattgattatcaagtgttagataacaatattactaacatttatcatcattcaaatatttagtaaaatttctccatatatttaaaattttacttaagaattttcccagttaaaatatgactgcttagtttgaataaggaagacattcctttcaattcatgacacaatagtacatttttattcttttctcagacagcagagagacactgttactgctttcccttgtaagtcaacagtctgtgatacatgctgtacttttactgattagcaatgcaatgttactgtgaatatttaactagaacttattatattggaatttaaaattttctaacattgaatttagttctcttcatcaaataagcaagcattatttttatgaaatgaaataatcattcttaagcagtgatgataatggaattctgaatacgatgtaaaatcaaacattctattttttctgtttatcctttgacattgagttgttttaatttattacatattattaagttgaaataagctttataccatgttctctgatgttcttgtcataataattttgggtcttttgttaagtaaatatcagaaaatatctgtgagttttgattatgtgatattttcatctgattgattttttaaatttctcattggatttaaagtgttttctttgctaatgttatatacagaattcaataaaagaccaaaaaaaa

SEQ ID NO: 1619 - DNA, 773 bp, Homo sapiens
tgaggatgaggaacatggtgttgcagttcaaaccagttccagccaaaatggactctagtcacaaacaaatagtaataacaatccaaacttgtggctgaatagagttctgaagttttgagaaagaggtaaagatatgaaatagttgtctaggagcaggcaaaaaaatggcttagagaaattacaattgctacttagcactaaggggccacttgagattagaggtgatacatgaagagtgagatttgaactgagttttaaagaatgttaagaacttggatggagcaacaagggagagaactttagacaaagatgatctgtagacccaaggcctgacattctcatcattattgtttgccttagtctgtgtatcctctaaaagcccaaggcgagcatttatttggaaggggatttcagggaacacaagtgaggaagtgattcagctcaaaagttttgtttagaatctacttcctagtacccaccagcttaggctgagtttcccagaatcagatctgtgttggagatttgtgtgtatgatgtttattggggagcttccccagaaacaacacctttaagtacaggaaacaattgaacagggacaaaaatcctacagtgataaaattataacagaagtcgtaggtaatcctttggggctctctggagctaaaacagcttttccaaattgtctataaattgatgcaagaggaacacatcttcatacttcacgttaaacagtcactgggcacaggctaccctaggagaaagcttgtaaactt

SEQ ID NO: 1620 - DNA, 539 bp, Homo sapiens
accacgcctcagggcatgctcttgcttcctcctgagggagaagtcttctatgtattcctgcaggattttagacatggattcatcaatgcgcagttgcagtactgtacatgggagaagtcaggagtgatagttgagctaagagatagagacatccgtagagggattctttctgttgcaagtaatgaaaactcaactaaaaatggcttaagagaaagaaaaggaagatattgattcataatactggaaagtccagggccacagtgccttcaggggctactggaggctgtgcttcttgaatgagaggacaagccaagaaagaacatatgggacacaacaggtgcagaaggaaacaagtccagcctgaagaagtgggacaccaggactccagggagagacacactgagggcttccatcaccaccatccccactgccatcatgctaacttttaaatcaaggactcaatacccagagtctggcccagatttttcctttgtactttctttattttgaccacatgctgataaagttcctgctcattc

SEQ ID NO: 1621 - DNA, 507 bp, Homo sapiens
atgctttattttatgcttaaaataaaacatatcacatagtagcattgtaacttttattttaataatgatgatgtgagattgggtttatttccacaaatatcctgatattttcattcacctaaaaaattccaaaacatttcagttttagataaagcaatgttataagttttcatcacccagcaggtctatgtattatgaatacattgagcaatgacccaaccctcagctttgttggaatggcacttgtctcatgagtaggcattattttgaattttcccgaaaattttatttgcatgtcccttttaattttttttcttttttctttttcctgttttttgagatggagtctctctctgtcacccaggctggagtgcaatggtgtgatctcagctcactgcaacctctgcctcccgaatctcctgcctcagctggattacagcatagatgctggctcctagggtgggcagattctggtcctgcaccaaccctgactggtgaccttcttgt

SEQ ID NO: 1622 - DNA, 3827 bp, Homo sapiens
ttggcataaaagatatattagggaggaagcctgaagtagggagatgaaaataaggagccatcaaaggcagaatgaaacttaggcagatttcaagtgattttcaaaaatgttgtgatcagaggtaccagataataactattacataacactttctttgttaggagcttatttctcacactgaccaaagcttttgaagtaagtactctttacaccactatataaataaaccttacaaaggattctgctttgaggcatgagagagttaagtcatttgcccaaagtcacagagttagaaagtaatagagctaagatttgaacctaggcagtttggctccagagtctgtgctcttacgctatattaccaccaagaggtcaaataaataccaaagaatgtattttcaaatttaacaatgaggaacttaatcatacaggcagaagtaattccagagcactggagacagaagccagattgccatatgggttaaagagtgtgtaaaccactaggaagtaaagacatagaactactctcacaagtgcttttctggttattgtgacgctgaacttcatggcttgttttaattaagacatcttacaagtgtcaaaatttggaaatatttggacactgtacactctggttatttaaatatctaacaatggttcttgagcattttgagaaacctttgaaaatctgatgaaaggtatgtgccattactctagaaaaatgttcctgtgtacatgcacatcaagtatcacatactgtttcaggctgttcaaagactacaaagtctgttcatgacctaatggtccatgttccctcagttaagagctccagagataaaggatgtggaactcaaaggtaagtacccagagccttgaaaactccatttgtgacttggaagaattctacaatttgaattaactttgtggagagagatatatttttgaaaaattgtgtgtaccaaaaaaatttcatatcaaataatattttcctgtagtgcattcaaggatctggttccacagcaaaaaattgttttggtctcagttcctcaaaatcacatttaaggagcttgagatttatattttctacttaataagtcttacaaaagcaagttaagaaggaaaatggacaatcatttctgcacatatagggtttaataaaacatgtataataaaatatctcatattttaaatttccaccttattggtagctttcatgacaaagggctagggtgctgatggccatacaattaaggtttttggttagttagttagcagaactaactgactcctacctggtgggtttttcttttgtttgtttgtttggttggttggttttttctcagatggctcaggaggaaggtaaatagcagtcattgtatgtgtgacagagtttgagatagaatgagcatattgaatctcacatcctattcttattactgtcaggcagcgttgacctagcagtataaaactatctgaagcaatgtagtcactcagttctcataaagtttatttcaagtactgtaacaattcatgtttggattagaaaagtcactagaaatttgacttccatatagtaatctatacttttttctctcatttccttcattttttgagccgtaagtgtaaggcattttgctggtattattacaatggttatgaggagtttctttgcttgcccaaggtcacatagctagcaagttaaagtagattcaaatccaggcctgctagataccaaattattatttaagagtacttttcactactcctaaataatgacacagatatgtttgtcttacacatttcactttattgtcaagttattagtatgtttattttcaaaaggtattttttgcaatttctttttattattccgtactttttaaatttacttcattatcacgtcttcctttattctttttaaatagtttttgcttttgttattttgttttcccttttttactcttggtttgtaatacctctttccttatttgctcctttctcatttgatctcaatgttaatccaactgttttccacatctgattcactaaaattttagcccttaaaaaaaaaattcctgtttttcctatctccttttgcccattctcttctccttgcctcacttcttttatctttttccattttactttcattttttgtttctctagatgttgttttgacatatgagttaatgtactggtacaattttgcatctgtaaattagagcttcagaatcaactgagtgtatttattctttatttttaggcctaaatttatcttaccttttattgattttataatatactatactctttcattttagtctgcatatgttagccaaagaagatatgcccctgttttaagaaatctctgtaaaaaatgtcaagtgtgacaagaattcttcaagaaacaagctcctctagtttgtcttctatatttagagcttcaacagttacctatattactggtaactcccaaatataccttcaaacttgttttttgggcccaagttttttgcttcatatatatctgttttgaatatcccataaataattgcatctaaagcatacctccactccattgttctcaaagataaaaccaaacctgtgctgcttcttatatttctagtatttaagcgtcacctgccacccctttacctgagctacaagtcacgcattgcattagactcctctgctttcttctttcacctctaactagactattaaccaaaaatttttaaatatataactttcaaaaggtggggttttattacatcatttccatcctttatgtttgggttcaagccctcattaactttaacatggattcttggagtaccctccttactgattttgttacacgtgtccctcttttagtcagtactaccatgataataccatggataataattttttcatttttatttttagtcttgctctgtcgcccaggctagagtgcagtggcgcgatctcagctcactgcaacctccacctcccgggttcaagtgattctcctgcctcagcctactgagtagctgggattacaggcacctgccacagctcctggctaatttttgtatttttagtagagatggagtttcaccgtcttgaactcctgacctcatgatccaccctcctcggcctcccaaagtgctgggattacaggcatgggccactgcgcccggccaataatttttgtgtgtgtgtgtgctaatcatactacattttctttagaataaaagatcacatacttgtttgccattcgcagtctggccccattgtgccattctagacttacctcctgccactccccaccagctttgttttgtcttagccacacaaaataatctagcgtctctaaccagtcaaacattttaccttgtgccttggctcactctgtgccttttctccagaatatctttctgtgtacttttctcccatccttttacctttaaacctgctgctatggtttgcatgttgtttggcccctccaaaactcatgttgtagttcaattgccaatgtaatagtgttgggagatggtacttttaagaggtaattaggttgctaagatggattaacatctttctcttgacactgagactgggttctcctgggaatggttagttcccaagagagtgagttgttataaaacaatgctgcctcttctattttgcgctttttgtttgcacaaactcggtccccttctgtttctctacgatgttttgatgcagcatgaggcagtcatgagaacccaccagatacagctgcctgatcctgaatttcccagccaacagaaccaagtgctaaataaaactctttttaataagtt

SEQ ID NO: 1623 - DNA, 433 bp, Homo sapiens
ttcaataaataattgttaaaattagaacaacgtgattgcgaggtgagatgttaaattgacatcttgaaaagcagaaacttagtatgggcatccaaacactagaatcagcaccggattacgaaacttccaagaaatgtaacgactgaaagtaatggacgagcctattgttctgtgcgagaaaggcgcaaggggagaagaaaagacacacacaccatacttttaaggactgtggaggattcaccaccacaccgggaagcaacagcctgggctccagagtcggacactacactcaccagactacagaggattctcatgaagtttcctcatggtctgggaccctagctcttatcgtaacaagttgtttggcatgagacccagtcacaagggcccttcccgactggactcaaggaacacaaaaaggtcaacttgtgtt

SEQ ID NO: 1624 - DNA, 3175 bp, Homo sapiens
ctagcatggcagcttccccctcctcgatgaagcccagcacctgggtctggaagccctgcagggcggccgcagcatctgcaaacagccggctcaccctctcccgctctgctacggctgcactctgcacaggacgacagtagagggggcaatgagggcaaagaaccgtcccggactgtacccccctccttccctgaccccggcttcccaccggccctcttgaggggacagaggggccagactgagcctgtcctggatctgggccaggtcaggggacacttgtgctcagtaggtatgggcatggtttgtttggagtggattgttccatgctgagggaggggtgtttgaccttgatgagggccactgtgcgcctggactgtgcaatgccagcacccagctcgtccatgcggtcctccacggcgctcaggactttggactgctcagcctgtggacaacaccctccatgagtgtgaggtctggcagaggccacagccctacactcgggtcccaggccttgccaggggagagaagggggtgactggggagtggtatctgtgcatcaggtgggactggagtggccacgatgtcccataatatgccagaggtgcctgcagcccaggctggtgcctttcctgaacgcctggggggcgtgcaggctgactgggtgtctgcctcgggtctctgacaggaggcctagtacagggccgtccgctggtctcagtgttgctcagatgaatttgagaacttcctccggcggggaagaggcagagagtaagccagttaggttgggaggtgggcggcggaggggtgactgcacaaggaggcattaagctgtcctgaggatcactgttcccaaagagcctgcatccacagtccaggcctggaaaaaaggggattccgggcaaatcccctaggtcttatgagtcactgctccaggcaggagaaacggaaaatcccttggccagaggcgccaagaccgggctggaggccaaaggaaactgggggcgggaggtagaggccgcggctcacatgctcccaccactggcccccggaacagctggacagagaatctgtgtgcccggtcgccctctgccgccctcctgccgcctgccacacccatcgaaagctgctgcctcagcccagggcaaatctgagctgagaccggcgtgaccctccgggcgggagcagcagccacgctaccggaaccccgcgggcctaacccggctccctcccgcctacacccccatagaccccggcccggcttcaggtcccctgcccgctcttcgcgtccttgtcctgttctcacgtccctccttcctcccttcccatctccatcaccgccagcagatgaccttgtcaaggctggaagggaccgcaaagatcctcaggttagaggaggagattaagacccaacccgggaagactggggggtccaaggtcctcggcccgctcgcgcgcggtcggtcaccagccccggctcacccgagtgtgcccccggagcccacctcctgaagcgcgcgctcctgctccagcggcaccagctcgtggccgcggtgctcctgtgcggcgcaggcctcgcacagacacacgcgctccgcgcggcagtagcgctcgagcggccgtaggtggcgcgggcacaggctctcctctagccggcgcagcggcggcaccaggcggtgtccgcggagggcggggctgcgctcgtgcgggcccaggtgcgcggggcaaaaggaggcgaggcaggagaggcaggacagcgcggcgggcagggccgcgccctcggggcacgcgtcgcagcgcactggctcttcgcccgcgggccacggctcgggagcgcagggggccgacggctccgggacactgggcagcgcgctgggtgccgagggctccggggccagggcaggggccgggccggggccggacccggggcccgagccctggcggagctgcagcagctcggacagcgtgtggttcttgcggagctgaaggccgtcggggaagggctcctggcacagcgggcagcgggccgcgcctccgggtccgccggctccactcgcgccacgatgcggccagagcgcgcccaggcaggcgagacagaagttgtggccgcagggcagcgtcaccggctcccggagtggctctaggcagatggggcagctgaagggtccactgccgtccatgactccgcggccgcccagggcgccgccgattgtgctccggcctgggagggacccgggccgttcgcgccgcggcacctccccctgggacctaggccagggctccggcccccgcccgcccccagctcggcccgccccgcagcaccgcccgcctgcgggcccgcggactcccagtccccgcccagacaacgcagggaggcctccgagcccgcgcgacccccaggggagtccgcgtggtcctaaggaagggcgctgctgaaagggtgtgaaactgagtgagcgcgggcggagaacgcgagaggtacagtggaaggaatgggaaggactcagcctccatccctctggtccttctgggccaggccagcgctccgcaggggctgggcgcgtctagctgtgtcatgcctgcacctttgcgctcgacccctccctggcacccttagcaaagttcctgagctgctgactgcagagaaaaataactgctgatgtacatatgtttttgccccttagcgactctttttttttttttttttgagacagagttcctctcttgtcgcccaggctggagtgcaggggcgctatctcggctcactgcaacctccgcctcccggattcaagtgattctcctgccttagcctcccaagtagctggaattataggcgcttgccaccacaccaggcaaatttttgtatttttttgtagagacggagtttcaccttgtccaggctggtcttgaactcgtgacctcaggtgatccacctgcctcggcctcccaaagtgctgggattacaggcgtgagccacagcgcccagctcctttagcgactctttaccccaagtagggaacttggacttttctagacctgaaatgggaagttgacgtcattccctaagtcccttgtctgaggaatgtagttctggcccctggacactggggacacctgtggtggggttgggggttccccaactggaagtatttaaagctcatctaattatgcacttaaa

SEQ ID NO: 1625 - DNA, 996 bp, Homo sapiens
ggcggtgcggcggtagcgcagggccctcctgcggggccaggcaggggcgggtgggcgctccttgccacctttctgctctccctgctgtccgagaagttcgtgcggtgccagcccagctcccagctggggacagaacaggaaacgtccccggcgagcctggcgggggtggcggcaggggtgtctgtcgcctgcgctgggcaggacgcgcgtcctaccggcctcccactccgcgggcctcaccagccacctcattcccggagcccgggccgccgagagcgccgcggatggacctcagggaaggcctggcgcgccgcctccgggaagccttccggccttctccctccaccgagtactggggagtctcaggccacggtgaatgaagagcaacgggccggagagacctcggcctctgcccaggagcagcgcccagcaaccccgcccacaggggacccggtggacgccctggtggccactttgccaggctccccatctcccagcgaaccagagaggatttccgttcccctcctgcttggtgcctagcgccagggcggggcgtgggctgagcagcccctcccatggagggagcggccagtctacatattggaggtggggctctggggaaagggtgttgttaggaaggcggtttgaggcagcgggaggtggggatgcgcccggcggggaggggcaggtgtgtggggagggcctggggagcgcctccccagccgggcagcgcttccccagccaggccccgcagctggaccccggctccgtccagcctgggaaaggactccacggtttatgctgaagtggtggtggggtgggtgaacgctgcgcaatggaagggcatggccctgtgctaattgccccggggtgtggggctgtggaggcactgcgggggggatgtgctgtgtcagttgggcaatggcggccaactgtggcgtgcaggccttggagctgcccctccatggagctttaataaaggcactagccctgcaa

SEQ ID NO: 1626 - DNA, 655 bp, Homo sapiens
gcagattcttggcagacctctgttgtttttctagagttgtaggcaagtagttggacaaaaagcaagaagctgatcgatgttgctggctttggattctttgtgaacaaatgagacaaggctgcaaattcagaggatcctcccagaagataagatggagcaggtcaccaccttcttccctgcttcacaccctcaggccccgactcttgtctgctgagatcactctccaaaccaatcttcccttacaaagcccttgttgcaggctatgctttctgaggggaacccaggccaagacactaaaatgacacaccaacatgaagacatgaacacaattgcaaagggattggttggattgcatatctctgtgaatgggactcaagagaagtttgggaaatgctggaccagatgacccttgcaatcatggtgcacagaattaaaaccgtcaagttccccatccatctctgagatggatgagaatctgagtcttccacaagatgcccaagacttgttaaacccgtggaatgtctttgggtatgtgtgacatcaacaagaagcagcagacaaaacaaaatattttcacaaacattcagaaatccctaaatcttgtgagttgtcgtatcatttgtagatataattataaaatggcacatgatgctga

SEQ ID NO: 1627 - DNA, 738 bp, Homo sapiens
agcggttggagcaggggctctgctgcgacctttacggtagtgaggttagggacgatgggagagcagctttgttcctgaagtgccgtcgaggattaggatcgagtttcttcgatcgtgagggcaattattagtggcctctagccccccagatggcatcttgaggagagagaatccacgctacgagaactaacatagtggacatcgcagttgtccgtagccgatttgcgggttacggagttgttgcaagtaaagaaggggaaatccgagcgttctcgcgttggatttcctccacgtgtgaagtgggaatggtagtgatatctcgtgctatctctgtcaagggcaagaaggagaaggaatttatttgaggccctacgacgtggtaggttcaccctcagcctttgttcttatttcatcttatttgtggagaaggtcttttcgttcctattttacaggtgcggtggctcacgcctgtaatcccaacactttgggaggccgaggcaggcggatcatctgagatcgagagttcgagaccagcttgaccaacatggagaaaccccgtctctactaaaagtacaaaattagccaggcatggtggcacatgcccgtaatcccagctactcgggaggctgaggcaggagagtagcttgagcccaggaggcggaggttgtggtgagccgagatcgcgccattgcacagcctgggcaacgagcgaaactccatctcaaaaaaataaataaa

SEQ ID NO: 1628 - DNA, 302 bp, Homo sapiens
ctttcccgcgcgaccggcgagggaggaagaagcgcgaagagccgttagtcatgccggtgtggtggcggcggcggagactgcgggcccgtagctgggctctgcgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatggagaaaaatac

SEQ ID NO: 1629 - DNA, 423 bp, Homo sapiens
ctttggaaaacaaatcgggtcctaggaatgaaggaaaacaggcaataaggcaagaatcgctgtcgaaggagtctgcgccacctgctcgcacagctcacttgtgccttctgagcctgctggagcccagtgtacatatgccgtctccgcgtgattagagattgctgctgcacgtgcccaatcccgtggcggggctggaacacaaacggggtggtgttccagctgcaaccatgcagatgaagactataccctaggagatggaggaacaacagacaagaaagaaacctgggttcctgaataaccacgtggagccaagcagcttacttatctcaagccactgttgcccacctccagattgaactgtctgcaaacaaatctttacttgatgagaagtttaaatataattaaatctagaatattacatga

SEQ ID NO: 1630 - DNA, 488 bp, Homo sapiens
aggattctcctgcctcagcctcccaagtagctgggattacagtttccatcattatcttctatggagttcttcattcccacatctgtggaccttaaaatcctaccgttgagtgcctgccttggatcagcagtcagttcgttaccttggttctcagacgatgcttgcaacaacgccatgcgattcgcccactcttggagaaaataagagaagtatccctgaaggatgaaatatcctcgaatatgaaaaggtctgctctctgaagaccaactgtctcagtctgctttttgctgctgtaacagaataccacagacttgtaggcagagaagccttcagagaaggatcctgactcggtggtttgtgcagtgacatttggcagtgttttctcggcaagcgagtctttgaggctgccctcatgctgctcagtgggcacaccaagaacaagagctggccagggatgacggacgcatctaggccttctcggcctaagg

SEQ ID NO: 1631 - DNA, 387 bp, Homo sapiens
tctcaaaaggccacatgtagaatattcaaaaagtgttgaagtttcaaaaatcttctaatattttaaatgcctaatagacataaaacaaaagaccaaactctcctgcctgctcagcagtacatatggcttttgaatagccacactcaaatgacagcccctgttccccagttcaaactttctgagactgcaagcctactttgcaagaggaaaatctccacagctatgtcatctacctgcttatagggtgtaaaattcaatctatgactaacaaatcaatattgtaaattatattacttggatactcatttgtcttacatttatttatttagcctgctctgtgggtcaaataagaggagaatcttaataaacagtcttactactattgaa

SEQ ID NO: 1632 - DNA, 2050 bp, Homo sapiens
tgatgattgaagtatgtttattgtaagggcagaaatgtgttggcatttggataaaaaactgctaacattatagaacttattacctaacaaaatttcacaccacaaaaaatattttaatggcaaattcaaggtgttttattgcttacaaatcagcatctttgactctttgaacatcaatttgtgtttacattgaaatgacaaaaagacaaactaagaagaaatacagcatgcaagttggaattcagagttaaaaccatgatgttgccgctcagccagctatgtgactgttgaccctttcaagaacacacatggatttaaaagttggatgacatccattgttggggccttgggggatatggtaaagcatgaaaactaaacagccaggagcctgtgaaatctgctactgtattttccaggacttcattccactccttggctaaaaaaatcttggaagtttcacagattatgatgtggacctgtcacctgtaaattgtctcaatctactcagacaagacactaaactgtctttggatactatagatgtcagtgcttatagcagctggaatttggctagtgacaatgtttaaagatgtaatactagttagtatctattgaagcttaaactttgctggtcaggttgtagctattgtaaaagtatttattgaagaagctcacagtccttcagttgtacagactgaaaaactttcatgaaagatccaacatactaatgtaaattatatttattacaatgtatgatattaatgtgtcaaactggtgtattttacaaaatatataatgcatacataaataagagttgtatattacagtgcttttcaaatatcagtgtcttggaatatttaagtcttcacattttttggtctaaaatatgaaaatgtttcatgatacaagtgattaattttccctagtagtgcttttgcatgtttgcctttttatttaagtttttttctatatagacacaatttggtgtcagactatcataagatcgatagtgaatataaaatatcttagccaaatggggtctgtattgtctacattttatatattaaataaaagtttttgttgtcttttcaggaggtttagagtattgtcactaaatatgatcaaagcttccctttccaaatgcaaaagtcttgtcctacatttaaagttgatctgtcatgttttagcagtcaagtgggatgggcattatataaacaacgttacaatgtaaggaaaatctttaaggagatggggagagaaaaaggcagctggtataatcggttactgctgcttagttctacttaattttttgtgttgcttcttcttaaggtgagatagcataatcttaactgttttgagatggaattttaaagtaacacactaccagcgagttcaacactgctattgattttaatctgtttttttttgtttagttgataacttaaattccaagtttcatagtgataattgtatattatttggctgctgaattctgttagagttttttattctgttgtacattgtattatacacataatcacaaattaatatgaaggtgaatatatgttacatatcaaaatttgtgaatttgaattatagtatgttttagtgctattgcaaaaaatgtttatttttatattatctgtgattttaatatagatgattgaactagatttctttttgagtgatagtgccattgaatgagcagtatggaaacagtgttacttgatattttgagctttctcaggtttatctaaatcagtggtagcttaacaaaacccagactaattgtgtgtaattgtatttttaataaaaggaaagtacatttcctataatagcatagtactgtttgcatgtaagagtatgcaaaaccttgtgtgtgtgtgtgtgtgtgtgtgtgtgtgtgtgtcttagtgtgtgtaaggcatggcagccaactttgtatctgctatttttagtacgagcagagcttcataattgtggtcactagaactgtacttaccatggacagttaaaactgaaaaagactcaataaaactatgaaacatgg

SEQ ID NO: 1633 - DNA, 438 bp, Homo sapiens
tgggcctgggaggggtggtggccattttttgtctaaccctaactgagaagggcgtaggcgccgtgcttttgctccccgcgcgctgtttttctcgctgactttcagcgggcggaaaagcctcggcctgccgccttccaccgttcattctagagcaaacaaaaaatgtcagctgctggcccgttcgcccctcccggggacctgcggcgggtcgcctgcccagcccccgaaccccgcctggaggccgcggtcggcccggggcttctccggaggcacccactgccaccgcgaagagttgggctctgtcagccgcgggtctctcgggggcgagggcgaggttcaggcctttcaggccgcaggaagaggaacggagcgagtccccgcgcgcggcgcgattccctgagctgtgggacgtgcacccaggactcggctcacacatgc

SEQ ID NO: 1634 - DNA, 663 bp, Homo sapiens
gtgaaaaaaggacagaagcaaaggctacacaaaacaaagccagacctggagatcattttcaaactcttccctcctcacccaaaatacatgaaaagcccttctgtaaagcaactgatgtcttcaacttactatgaaacggagatgaataactcagcttgatgaaggaaccctcatgtccactcaattaatgattgggcacctaccctgggtcagagggcttttggaggtacagagttcctggccttgacgaaggtaaagaaagagacatgtcctatgctgaccttttggataatagagcatggcaaattggagtcttcaattaagcacacggaatacatgtgctgaattgctttctttgcaaggttcagagtcagaattcctgccctgggttctgagttgctgagtggagacgatgatggagagcagtggagacacgtgattttcagggtgctctttgcatgcatgaaatggagcaagacttatgaagggaaaatgaaagaggaggataggaagatacgtcacctcctgggtttcctccaatcatccagtcctcatctctctatatgtctttgaacactctgagcgccatcatgccaattccatggatgaaacaaatacccatgactcagcatttttctaatgaaaacacgtgcggtctgaccc

SEQ ID NO: 1635 - DNA, 478 bp, Homo sapiens
gtccacatcacatggtacaagaattgtaggtaaagagatttctcctgaagttggcagactcagaccaaccatgggaaagatctgactttgggaaagatatggaagtatgacactctgtggaaatcaggcagaatatgcctagtagccagtctccaaagtggctctgtgattcctgtctcccggtgttcacagcctggtttagaccctttccacattgtaccagaacactcatcctggaagaagccagctaccatgacttgaggacacttagccccaaggaaaagccattagcaaggaactgagacttcccgtcaacagccatgtgagtgggccttcctggaaattgatcctgcagtttcagtcaaggcttcagatgatgcaacccagatgctgaaccagaaacacccagtgaaaccacgcctagattcctgactctcagaaactgtgggagaataaatgtttgttttaagccactaaa

SEQ ID NO: 1636 - DNA, 584 bp, Homo sapiens
agactgcattttgccttgcttttccttctccctttctctctctttctttctttctttctttctttctttctttctttctttctttctttctttctttctttctttctttctttttctttctctctctctctctctttctttctttcctttcttttctttctttcctctttctctttccttctttctttttttcttctttctttccttccttccttccatctttcttttctttctttccattttttttttcctccagaagaatggaaacagtattcttttccgatcagttcagtaatacaatgtccttcagtgtccatatgagcatttcagtggagaagaaaagaaactttgctacctgggaactgaagactacttagtgaagatcccggtgttacacatccaatcgttcacctccttccaagactatgacattccaggaaaccttcactgctaagaggaactaagatctagagtatctcctcgaggaagtacaactgtctgttttcactaaggtggggagcagtatgtgtccagagctctagagggaccgaaaggccaagtgtccacggtggcaagagaatcca

SEQ ID NO: 1637 - DNA, 1710 bp, Homo sapiens
tgtggttttaaatgtcatgtgagctgagttactgacctcaacctactgccagatgaaggtgtgatcctgtgataccaatcttgagggtcccttctagttttagcagtcagtgacttctcttgtttatttttgtttgaaaaagtaaaaggctctctttttggctatagagttgcatcttgaaatttttgacaaattacatagagctgaagaaggatacaagttttgatatcttaaaatcacagggttgaagcttgaaaggacagtattggcattgcagctaagtgggagtgtgaggaagcgccttctctagggcaggtaattgcatctgttaatgtggtccttgggcccctgagttgctgccttccaatcagaattcccttagcattagccagtgacgcctgaattaatctcaggtaggacttctaacttttttccaaaattatttttgtgcagaggtttatctagatttttcttctaaatgtcctcctccccacttgttttattattactgtttttttctctctttaatttttttttttttttaatagagacatggtctcactatgttgcctgggctgatctcagactcctgggctcaagtgatcctcctgcctcagcttcccaaagtgctgggattataggcgtgagccattgcgcctggctctgttactgtttttctaacctgagttacttaggatcatattttcattcttttttaaaaagatgggagttttctgaacttttccttaactaaaaagtggaatgcatcttaatattttcctttttttacttgtgtttctccccagggagggaaaaacatatttattgtgacagaatttagcatattttaggccacattaaaatactgataaatgtattaatcagtgaaaataggttatagtgaaaaatatataccatttgattaataaaaatgttattggaaaaatgcaagaactgctgtaagaattgctaacattgtgttggaaaataaatatactaagctaagaaacaatgggaaactgtcatatgtagggccaacagcctttttttttttaaacccttccaatttattaatatctagtctaataaaccctgatttataggacctctgcaccttttttgactttttattcatccattcttaatattctacactatgacaaaatccttaaaactccattattgatgaaatgggaacagacttttgtttttgtatgttggtgttctctgagtggtgaaggcccagggagaatgttttgtttggtggtcacttagcatttgaaaacatccacttccttgtgacttagctgggtatcttttaacatctggaagccacgtccctgattgaaatctctggagacaacttacctttcaccaacttgtctgccaaattgcaccatggaccaagattgcagtggctgcatcaagtctaggcctgccctgaagtctggatttgtaagtcccccatttcaaatggggcagaaggcagaggagcagaggagccactgtgcctttcgctgtcctggagccagttggccttctggttttggtgaaccctgcttttataagaggactccctggcatcttccagtttcccgctacttgttttatgtattattttatgtctgtgtttgtcctggagtgctgtaactcctttcactgtctgctgtaagttcaacttcttcaataaaagaaatgtttcaaattgga

SEQ ID NO: 1638 - DNA, 1246 bp, Homo sapiens
ggctttatgcagtctttccacctcagcctcccaaagttctgggttacaggtgtgagccactgcgccgggccaattttggtttttcatggaggacttttagcaggtctcaaaagttttcttctaatagttttcttggtgttctatcattcataggtgttgaatttaccaaactttttctatttcaagtattacatttttactttgttcaagtaatattgtatcatattaaatgaacattgcattgtgaaaataccctgcttagtcatggtatgtaatcatccttatacctttttgtattctttttttaaatatttctgagaatttctgtgtctaaatttaaataggatgttgtttcgtaatcatcttgtgattcttttgtctcctttgggtattattggctaatagatgaattaagaaatgttacctcttctactgcttgaagtttttgtgagaaattgatgtttttcattaagtgttgatgaaatgtacaacttaagcagtttataacagctattctatctaaaaagatataatttttttgttctatggatataagtatattctattatatatataatgaaacaattcataggatgttttttcagtttacttttgtaatccatctctatcggtattttttatttcatagtatgtcatgaacaattattctaggcacttgacatggaataatttgaaaaaatagagaatgagtcccgtactacaatcaataaataactcaaaattttttccatttttaggatgaagaatatgaatatagttctgttacgtaatatttgtgtttactgtgtgagacaaatgagttactgaatgtaaaaataattagtaaaactgccctttgattttggaatgtatgaagcaggcaaatgcccctaccttctatttttatcaatatttagataaggcagacaaataaattttaataagatatacagaataatcttgtatttgaagaatgctatgaaaaaagatagtttggaggagtagttagtatttggctcatataatgtgttaggtaactattctaagccattaaacatttgtatgcttaatacctaagagtttaaagtgaagaaatcaaagattcattgaaaaagaaaaattaaattttaaaaaaattctatttttaattgaaaaataatagttgtatatatctgtctacagtgtaatattttgatatatgtttatgttgtaaaatgattaaatcaagttaatgtttataacctca

SEQ ID NO: 1639 - DNA, 613 bp, Homo sapiens
acactcacagatgacagggcttgcggtaccaaaggctctttatcttccagactacagctcctattaatgtgaaaacaggaaaagaagtaaaaattgcacaaaatggcattgaaactttggcgtgggaacctcactttagcagccagaaggttccccacgacccaccactgcctgccaagatgaatgtaaatgaagcagaagtctcacaggctgggcacagtaggaagaagcattctcatcatggccacttagcttgctcgagattacacagaaccatgcctctggtttcctggtacagtgctccggcaggtgacggatgctcctgggtgacatatcacggatctctctgaggtgagatcttcatgattctatatcataggcatctctttatcttcaagttgggcaacatcagcagggttcccatgagtatgtgcccagcgaggctatttagttcctcttatctttttttttttctacttgccctcgtttttcctgagattttatttccttcctagctggcatacctttccctgctgtggtattcagacctaaatagtgtgtgcacctattacctctgcagagtaattactgtttggtaccatggtagagtttc

SEQ ID NO: 1640 - DNA, 1375 bp, Homo sapiens
gtcctcgctcgcgtccccgctccctcctcccctctgcttctccctcccctccactcccccattggcttctacccctcccccttcttcctccgcctctcccaccattggttccctcccctactccattccttctcaccttttcccttttacccattggcgtgagtatttttcctcagcttccctctttctccgtattctgctcctcctcagtcccatcctccacgctttggaagctactgccttactgcccggagcgccgtcgtccccgaacctcccctgcttctccctttccttctgttccggtttctggtcgtaactcaagagcaaaccaccgtactgcaaaggaaccagatattgtgctcgcggttccaaaccgggcatgggcaccgaatgcttctcgataaatccccttatggtctctgagcattaaagaaagcaagggaggaaaacatgcgcccaagctcgttcgcaggaacatgttcgcgtgtctgcgcctgtgtgcgcagccagttttctggctgaggatcgctcgccaactacagacatcacccgcccaggacccggtgccacactcacccagaagacgaaactccacaggagcgagaagaggagtccatttctccgtcggctcggcacggcacggggatgcaggcccctgattcagtacgttctgtgaaagtggagcgagaagccaagacgtggatcgagaagccccgtggggcgggtctcagggtggcccaaaagacccctgttcacgccactaccagcctaactttaggaactgtcgtccacctggcttttattatactgccttaaacatattcacttttttgagactctagaaatttcacaagttttggggtagagcacactgggctttgggtgtgtttctcatgagggcactgacgctgaatggtgcagtgagaaaggacggtagaaaccactgcctttgcttttaccattgaagaaactgaggtcctgtgactttcccgaggtcatcggaatctgccttgcacaggagacttaaaatagttgccagcagataaaagaatgagcaaaaccacatctactccaatttgttaagtctgaaagaaagtaattgaggggggattcctctttggggaaatatttatttcctgcattgaaaatagtttaatgttagtaaacatataaaaagtattttaaattcaagttattctttatttcttatgttacataaggtactgaagttagccaaggttgcttttgtgttataatgatgcagctgctgccaaccagaagtacatttacggtctgtcagtaaagaaaacaaaaactgcctgttggtaaaaatctattagaaaatatttgtcagtaaatttgtcacaatattcca

SEQ ID NO: 1641 - DNA, 384 bp, Homo sapiens
tacttattaatgcatattacctgtgaataagaaaaaggtgcttgcatttcagaagtttgtgtgaatcacgtgtcctcctcatttcctaccagagttcagatacagaggaccaactatacttgtcggactctgaaacttcaacttctcagctccacttgaacctcaggcacagagatggaatctgaagcggaccaaagggtggcttcttggagatggtgaggcgtggccacaggaggaacaggatgcatgacagctgcctcccacacagatataccgcatctaagaagatgtcgccacccccatgagaaatatctactgtatgctcatgtttgaatgtgtgtatatatataggttcaatatatacataagttgcaaagaactgaa

SEQ ID NO: 1642 - DNA, 500 bp, Homo sapiens
gaaggcagggtgggctcccgcacgggaggagggccccgctcaggccattggctgtctcctcgctgaaggtggacggcagatgccccaggcctagcctttaaccctaaccgagatgctcagagcagctttaaaggtcagcctctccctggcccaggatggtactcggctcaccatacgtcaggcacgtcagcaagagcagcggcagcaggaaccagaggaacgtcttcagggacgagaagcgcctggaccacgcgggagggcaggacgggggaggcggaggtgtgaggggagctccaggcctccacgttccacccagggagtaccctgagatgttttcctgggtgctgaactagagctaaggaggatagcttgagcttctcactgtgccagggccagcctggacacgtcagagcctttcctgctgggcaggtcttagagtgatgggacaattttgactgaattttactgatgttattaaaaatagtgtggtctttgaaaaa

SEQ ID NO: 1643 - DNA, 582 bp, Homo sapiens
aaacacagatcctggtgccgaacatgaggacagggcaggccgaaggagaaagtggaaggaggggagcttctctctcagcctcatccttctgggcctggatgctggagagtcatgaggtgcttcagagtactctgggtgaggagggaaagatggtgcccaccacatggaggccagcctaggtcttgtatgaaacctgtgagctctcatgaaccagtacaggcctgcttcagcatagcactgggtccaaaggaaaagaagaaaatgctgagtgtgtgggtggaacatctaacctcttcggacgtacaaggctcctgcctatgtcatcctttcccctggcatggcagcagatgcaactctggagtgggggaagagggcgggaagagagcctgtgctgctgagcacctaccaggacttgtcagggcccaggcaccctatgaaacaccttatgttggttatcccacaccaagctcgcaaacctctgaggtaggcaactttgtcacagagagaggctgagtaacaagcccaaagtcaaacagccaagaagagacagaactgtattaaacttatctactggaccccaaa

SEQ ID NO: 1644 - DNA, 1110 bp, Homo sapiens
tgcgtctgttctctcccaaagaagctggtccttagcctgtgttaaggagcaatctttcggtggccagatggagccggggcatccttcttcaaataatggcttttaattcgcagactagaatgtttcggattacaaaagaaaccggttctcttcacatccttatccttgtgatgcagcattccgcttgcatttggaagccgtttaatatcagagagaagccatatttatgaaagtaaagaggctgctcagatgactgcaaaccagccttccttactggttttatcactggtaatgttataaagacagttgtccagtttcatgaatcttgtaggttttttttttttgatgttgtttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaacattccactccttggttaaagaaacccatcaagatgaaaccccagaacccattattctctcttgggtatgcccaagctcccctttcttgagagtgtactttttgctttgcaataaatctcttctttcacta

SEQ ID NO: 1645 - DNA, 1379 bp, Homo sapiens
tccggccactctcctgcctgggctgctgctcaacgggggctgggggtgtgtggggcgggggtggtctgtccagtgattcagccacatgtgatagatgaccaagtgactgctttcttggagtccgcacaccagtggaagactctcaaagtggttgtgaccgacttgatcaaactctaggcttcctgaactggtaactgtcactttaatataggttactgattaaactcagaaaaatgcagcttaaaatctttgccaggaacttgtgtggacttattccctgttcccccccccaccccccttgttctgatttgttttgtcacaggaatgaaatgcagataactctttagaaaacttttgtaggaaaagcgcctcgtgtgatctggaacaaagacgttttataatcagatttatcaagctgcgaagagggagttttagtgaacggaagcagcagcattctgtcaccaggaaatactcctttatccagaattggaggtataaaccagtggagtttatcattgaatagagtgcagagaaaggaccgcaagaaagctgatcacctcagcaatgaatgatttcaatacgatttcacccaaatggtctcacacaccagcctagtaaaccagagataaggtgtaatgtcatccttccttccttctccctgcctcaactgtcaaagattgacaacttacatgttgtttactttttggcttctatttctgttcataattattatcagaaggcatagcacccacaagcctaatcatactgccttacaaccttattcctcttcattttgtcttctcacttacctgcagaaacccagtttatttttgttctccctttaccacaccagccttgtaactgttatgaatgaccctcaatctcactggaatctgaatcactcaggaattcaagcaaactggatgttttaaccactgttcagctttcttatggaatgacagagaacttgtaaagataaaacaccagtttgcaggaagaaaggaagagaatggaaattgcttctggaaaatactagttttacaatatgttttgtttgtctgctctcttaaataaacttaatcctataaacattttttaagaactagccattaagactgttaagttctcaattataaaggaataaaatgttttaaggaggatttatttgcccttgcttatatgaactgcatatttttagtaggaaatcatgtaatttaaattagtattgattaacagatttaatgtagaaaatggacatataaagaatacaaggataaatgtctacatgtaataatggatggtagtgatataatgcatttttgtcatcccatgctgaattcagtaaaaataaagctaatgacttggagcttttaaaagat

SEQ ID NO: 1646 - DNA, 2065 bp, Homo sapiens
gacatggtgctagaggttgggtggtcagacactgtgatcccgggtgctgtgcccgcactacgggaaggggaagcagcgcgtgggtctcgcatcaggaggcaaggccaggacccgctgacccatgcctcctgccgcggtcagagcccaagtttgtcaagaacgacgtgggcggccagcgcagcctggtcaacaagtggacgacgttcctgaaggcgcggctggtgtgctcggtgcccggcgtcgagggcgacacccacttcgatcagctcctgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagagggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcagaaaaccccagtcctcggccttgctatgtggtcttgggcaccttactagcggtgtcagggcccgagtttctcctgtccaaggttgcctggtgaggattaaaggtggttccggccaggcgcggtggctcacgcctgtaatcccaacactttcggaggcccaggcggacggatcacgaggtcaggagatggaaaccatcccggctaacacggtgaaaccccgtctgtactaaaaatacaaaaaattagtcgggcgtggtggcgggcgcctgtaatcctagctactcaggaggctgaggcaggagaattgcttgaacctgggaggtggaggttgcaatgagcctagatctcgccgctgcactccagcctgggcgacagagcgagactcc

SEQ ID NO: 1647 - DNA, 1983 bp, Homo sapiens
agcggaaatggctccgagaggctttgacgcatgtgtacctttttagtggcggtatctcggccggggattttcgggctccagtggaggtggctatgctcaccccatctcccttgagaggcacagaaggttagagatgtgtgcgaggaacggccaggtccagcgtctcctcgttgctgccccttgagcccgggaccggcgccaatgcgcgcccgggttcttgggttctttcgtcccgcagacctgccttggtgtggcgtccctgggccgtagcttccgaaggctgcagccgacctggtcggggtcctctagcccgccttccccttcccccattgacagatggagaaactgaggcccaggccaaaaaatatctcactagagggctcaccgccatttcctggaaaaattggggctgggactcaacggacgctcgtccagcagcagcgcggagctccgaagtaaaggcgcccgtgaccgagtgctttgtccttacaagcgtggtgttcttgaatgcttccaggcgccttatgaggcccccgatgtacaatctgtgcttaactaaaccccactgtcttccagggtcaggttggccatccgcaggcgtagttgctaggaaggtttgacagatgtccgcctgttgattcagacgttcccaggatttggagcaagaagagcaaggaaggccaggcgcggtggctcacgtttgtaatcccagcactttgggaggccgaggcgggcggatcacgaggtcaggagttcgagaccagcctggccagcatggtgaaaccccgtctctactaaaaatacaaaagaaaattagccgggtgtggtggcacatgcctgtagtcccacctacttgggaggctgaggcaggagaattgtttgacctggcaggcggaggttgcagtgagccgagattgcgccactgcactccagtctgggcgacagagcgagactctgtctcagaaaaaaaaaagagcaaggaggtgttgaaaatgggtttcctggctgggcgtggtggctcacgcttgtaatcccagcactttgggaagctgaggtgggcggatcacttgaggtcaggagtttgagaccagcctggccaacatggtgaaacaccgtctccactaaaaatagaaaaattaactgggtgtggtggagggcgcctgtaatcccagctaatcaggaagctgagacaggaggatcgcttgaacccaggaggcggaggttgcagtgagccgagattgctccattgcactccagcctgggcgatagagtgagactcagcctcaaaaaaaaaaaaaaaaaaaaattcgccaggtgtggtggtgtgcgcctataatcccagctactcaggaggcagaggcacaagaatggcttgaatcacttgaacctgggaggcagaggttacaatgagccgagatggcaccactgcactccagcctgggcgacagagcgagactccgacttcccatcttaaaaaaaaaaaaaaaaaaaaaaaagaagtgtaaagatgtgattatgtggcagggggtaagggttaaaaagaaaacaagaacaagttttcctctgcttagccagcttacttcaaggacagttataacactgaaaagtcgaggccaaaggaatgggctccagacagcctcctccggagcaaagttgaaaagaaaaattcctttactgtctctccttttctgaaccattaaatatgactgtttgccaatggttgtatttagtaagatttgtagactctgtttttcttttgacacagctgcaaggccaacagctgtgcaaagccacaagttatgctaagtcagcagttatgctatagattacatgacctgtgactgtatcattaactgcttttgttttgcttctgtaagtttgcctataaaaaccacactcagtctttgttcaatggtcagcttttcagatacaaatccactgagccggtgtacatctaaataaatcctcctgtttcccgtgtca

SEQ ID NO: 1648 - DNA, 1621 bp, Homo sapiens
cccagcgcttcgcgtaccaggaaggggacggcgtcctgaaagggacatttgaaaaacggaggcaacgcgtctattaattaggtggcggcgcctggggtcgcagcactccagaggctgagagtctcgcccttttgcctagtggaggagctcggctcactgcaagctccgcgccacaacccccctgccgccccaggttcaagagattctcctgcctcagtctcccgagtagactgggattacaggcgagtgccaccatgcccggctaatttttgtatttttggtagagacggggtttcattatgttggccaggctgatctcgaactcctgacctcaagtgatccgcctgccttggcctcccaaagtgctgggattacaggcgtgagccacaacgttgggccaggtattgtatttctatgttattattattttttgtatttctatgtcatacaggcttgtatttctgttaaaaacaagtccttatctctttgagatacatactgaagtttttacaggtgaaataatttggccaggagtaatggttcatgtctctaattcccaccactttgggaggtccaggtcggggtcggggggttgcttgaggccaggagtttgagataagattggtcaactacaacacataaaaaatagccaggcatggtggtgggcacctttaatctcgatacttgggaggctgaggcaggaggatcacttgagcccaggagtttgaggctgcagtgcgctacgatcatgctacagcaccccagcctgggcaacagattctaggacaaggagactggctttcacagaggttcgggttgggttcagttttcttcagaagaacttcagaatgcactacaacaggaaaatcatattctagatggagtcaagtcaatctgtttgtataccagatacatctatgatatacatgcagctactatctgattatgtatcaattaaatagatcataaatgtggaacgatggggactttgagagatttgtaactgaagctgccttcatgcttgttagaatgctggggtggaagagttcccagttttaaaggagaagtacaagaagacctgtaattgttagcaagatatacagaacacagtgcacacagcagcgcacttctcaagtcagctccaggttcaagctcaaaggcctaaagttttgcaaacatctggtgaagaggaagatttttgagactctcccagcctattacataaaggaaacataaccgagaattttgtctaaaggttttcatttgaaacaaagcaagagcttcttttccccactccgaattaaaacacagcgcaacaggggccacatttatttggcaggacagtaccaatatgtgaacatcctcctcctcactgccgttggggtgacttgactcataagcagctgttcttacacaaaatattaacccgaactgctagtgtcacacagaaggaagtggtcttgattgtgtatgtgggccagcatgttctacaaatgctgaaaggtgggagaagcacaaatacaacccactctttaaaaaaactaaataattcaaagtaaaattttctatccccgccccctccccacccttgccttctccaataataaaaagtagaatccag

SEQ ID NO: 1649 - DNA, 543 bp, Homo sapiens
cccagacatcaaagctgagctttctttgtctccggcagcctgggccactccagaggtgttaaagctccagcacttcgagcctgcctcgtgggaaagtcttaggctgagtctgggctggaaacctaacaatttcacttcctagacaacttgctaaaagtcacctaaagacagtctggttactgccaaagatatgctttcaaataagatttggataaagaagggaggtagatgccttttttcagcagtggagtgatgtctagaccagtagatgtacgcatctaagtgaattcatcaccagcaacaatttccagaaacttcctgacctccagattgcagcttcattagtgtgagtttaaagccaactagatgccattctcagattccacgcatatggccaagggtccaggaaataagaagaaacaggttgaggggttggtgttatggggcatttacttgaattttctatgctataattgtctcatctttaaaacggtgataataataaaattgtcagttattaaataaattaacacagtgaaaaaa

SEQ ID NO: 1650 - DNA, 560 bp, Homo sapiens
ccgcggtataaggtcgtcccatcctgaatggccggtgcgcagactcaattgcgactttgaggctgtcagccgccacccggcaaccttccagtgaacaggattctgggtttctcaaagctgtaattggagggccactccagaggtgttaaagctccagcacttcgagcctgcctcgtgggaaagtcttaggctgagtctgtaggtgtctgcagttaagaagccagcggtctgcatatgattgctcaggggtggtggctgggtccaacagcattcactacaggcctgccttgaataccacctagcgcagtgctccgcatatcacaggggctggaaacctaacaatttcacttcctagacaacttgctaaaagtcacctaaagacagtctggttactgccaaagatatgctttcaaataagatttggataaagaagggaggtagatgccttttttcagcagtggagtgatgtctagaccagtagatgtacgcatctaagtgaattcatcaccagcaacaatttccagaaacttcctgacctccagattgcagcttcattagtg

SEQ ID NO: 1651 - DNA, 565 bp, Homo sapiens
gttcagccgggagcagagcgaaccgcaccggcccgagcggagcgccgcacgttcccaaccgcgaggccagacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagaggtcgaggaccctgcacggagctgtatggagggcaagagcttcctacagaaaagtcccagcaaggagccacacttcactgacttcgaggggaagacatcattcgggatgtcagtgttcaacctcagcaatgccatcatgggcagcggcatcctgggactcgcctatgccatggccaatacgggcattatccttttcctgtgagtgccctcagagaaacttctaaagataggggccctaagcaagccaccaatcatgacctcccaggacccgccagttccctgtcccagcatccaggctgcagtgggtgggcacttcttacactaacaaaccgcggctgaaaaaa

SEQ ID NO: 1652 - DNA, 772 bp, Homo sapiens
cattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttgtcctggaggctggaagtgcaaaaggaaggtgtcggcaagatcgtttttttctgagagctctctccttggcttgcagatggcagcctgctcctggcacagtcttttctctactcatgcccaaagttacggaggacccagcaaccatctcctgcagcccctggaaacctcttgactcttctgtgatgtccccagtgatccagcagccctggccttcttttgatggcttgaacatttggtcttcattgaacagtttgtatattggaaacttgccagcctccatccacattccaacctccgtctgcatccctcgaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaa

SEQ ID NO: 1653 - DNA, 777 bp, Homo sapiens
ttggggtttgcatccaactcaccagctggtcctgaggctgcatctgcctctccagggtcttagatacatgatggcactgttggcttcctgaagacctcttcatcctgcagaaggtgcaactccacagcatcctgagaggttggacacaagctgctgggagcacaaaggaaccctgcctgccaggcttgagtgtcagaatctgggctttcacctgcagggacctcaggcctccatcagccaggcttggaaagaatgaatggtgcctctcggtgaattactacaacctgaatcctgtgaccccacctgtgatggcccaatgttattgaaattactgactccatccacttagcaagtggtaaatactctgcaggcatagatttgactaatgtgttctgttcagcgcctatttcaacagatctcagctgcaggttgctttcacccccgaagggacacaatagaccgttatctggctaccacggggtacctcgacagttctgccaccatacacaatctttgcaggcaggatttgaactgcatctgacattctctaggagtacaggtgtaacatcaccctgaagacacccttctttcagcaaattcatttgacacactcaggacattactcacaaagaactcatagaaaaggatggggtttgtgtttccacatggtgggattaaactaaaacaaaaaagtatgggccactgccccaggcatagtacagggatccacaccaatttctggccattgtctggtcagttgagggatgctccatccct

SEQ ID NO: 1654 - DNA, 2677 bp, Homo sapiens
aaaaaacagcgcccagaatggaagttgctactctagctgtggctggccagggaagggcctagaagctctgacaccattctagttctagaacttgctatttctcttcccacagcccaagatccctccagccttggctcaccaccctggggccccacattgtccttagaatctgctaaactcccaggtcttcctcagttaatggctggcagaccctgtctcactgcatcctatggggtttttaaaaaacctttcttattcaaaattccagtagaacgaataaaataactcatatttatctatcaaccagcactgaaaaatcagtgcatgatcaattctattacattctgcagccctaccacatccctcccacactttatcttaaaacaaactccagacatcgtatcacatcatctcaaaatatttcagtatgtctctctaggtggcaagaactcttacatccagtcagtattcaataaatatcttttccccgctggatgttcaaatcagggtctaaataagtccacacttagcatttgggaaatatgtctcttcatttaaaaaaatctataatagttctttttcccctctctatctcccttgctatttatttattgaagaagctggatactttctcttggagaattgcacattttctagattttgctgactgtattccagtggtgttgtttaacatgttcctccgttccctatatttcctggttgttaaatctagaggcctgatcaaattcagggacattcaataggtatgctatatattttctgtggtgtcacatcaggaagtacataatgatttggtgaggtgtgtgtgtgtgtgtgtgtgtgtgtgtgtgtatgtggtgtttatgtataagattggtcaatgggttcagtccaatcggttcatgtgtagtctgttttttaaaaatctggaataagtttgtgtgtatcctgttaaatgtcatcttatttgctttagcccatcatcccattgtttggttcccatgtctgccaccaaatgtctccttcttagattcatatcatctgaaaatttgttaagcctgttaactttgtattcatccaaatccacataaacatgttgaacaggatagagctgaggacagagccctgtggcatgctactaaagactttcctccagactgacatggatcaagcatttttggggtatggtaactcaaccagttctgaatccacttagtatgataacacaatccacaatttctcatgttcttcatcgaaatatcattagagagagacagagatatctagttttcagttagaaagataagattatagtttaatagagagataagggctggagagaaatttggaagcaatctgtatcaggttttgtcacctggctaccacagaatcccctggggaacttcctggcttcacctggagattctgattctgtagtctggagtgggactaagaatctgtgttcttactaagttccccaggtgattcaaatgcagctggtctgatgactgatgttgggggaccacagatctgtatcactgggatagctggggcagagagaatggataagttctctgaggagagtgtttcatggggcgggaggagggctaaggataacactgaggagtgcgcatgggagaaaaggaaagagagccaaagacaaggaacccttggagaagcagtggcaggtggtgcctcaggcctggggcagaaagagggctggatgctgcgcagaggcctggccagcacctaggcagagcccacagcactggtgaccagcaagaaggcagcactgtggagttgtggaccctggagttgcatttctggtttttaaggaaatagtgggtaggagagaaagtgtcagaatcaaattataaaagtgtagcagcaaaagggagacaatggtgttcaagggaagactttctttaaggaggcaagggcaggagcttgaaaacagaggggagggagccaagtggtgaggtaaggagtgaagatacaggagagtggaggaataggaggcagcaggaactgctggaggcaggaaggagggaactgagcaatgtggaggccggggctgggcagcaatgagccttgtgaaggagatggaccccttctccccaggagagagggtacctcctggtgcataggtagatgaggagggcagatggaagacttgaagggggctcttagaactggttcagggaagcagaaaatatgagataaagggaccagacttgggatttgaggcaagataagatgatttggcaggcactgggaagcatttcaggggattaccactagatgatgaaaaggtgctaagcaaggagggtagaggcagaggcagtctaggtgagtgtgtagcgggcttggtgttgataagagttaaaaagagcatggccaggcgcagtggctcatgcctgtaatcccaggactttgggaggccaaggcaggcagatcacttgaggtcaggagttcgagactagcctggcaacatggtgaaaccctgtctctactaaaaatacaaaaattggccgggtgtgatggcaggcacctgtaatcccagctactcgggaggctgaggcaggagaattgcttgaaccccagaggcgggggttgcagtgagcagagatcgtgccattgcactccagcctgggtgacaagagcaaaactccgtctc

SEQ ID NO: 1655 - DNA, 2060 bp, Homo sapiens
gatacgcaaaaagctaccactatgtctccacgaagctgagtattttccttggagtagctttttatttggacatatggaatgaaacttacttaatattctgcagagatcttcctggtgtttccaaaatgtctcaggtatgtctttatcagcatcatgaaaacagactaatacagtaagttgataccagtacagtggggcattgccgaaaagatacctgaaaatgtggaagtgactttggaactgggtaacaggcagagattggaacagtttggagggctcagaagaagataggaagataagggagagtttgaaacttcctagagacttgttgaatggctttgctcaaaatgctgatagtgatatggacaataatgtacagactgaggtggtctcagatggagatgaggaacttgttgggacctggagcaaaggtgacttgttatgttttagcaaagagactggcagcattttgcccctgccctagagatttgtggaactttgaacttgagaaagatgatttagggtatctggcagaagaaatttctaagcagcaaagcattcaaaaggtgacttagatactgttaaaggcattcagttttataagggaagcagagctaaaagtttggaaaatttgcagcctgactatgcaaaaccaattttctggggagaaaagagaaaccaattttctggggagaaattcaagcccgctgcagaaatttgcataagtagcaaggagcctaatgttaatcctcaagaccatggggaaaatgtctccaggccatgtcagagaccttcacagcagcccctcccatcacaggtccagaggcccaggaggaaaaagtggttttgtgggccaggctcagggtactggtgctgtgtgcagcctagggacttggcgcactgtgtcctagccactccagctgtggctgaaaggggccaagacagagctcgggcagtggctttagagggtggaagccccaagccttggcagcttccatgtggtgttgagcctgcaggtgcacagaagtcaagaactgaggtttgggaacctccgcctagatttcagaaaatgtatggaaatgccttggatgcccagacaaaagtttgctgcaggagcgaggcccttatggagaacctctgctagggtagtgtggaaaggaaatgtggggttggagcccccacacagtgtacctactggggcactgcctagtggagctgtgagaagaggccaccatcctccagatcccagaatggtagacccaccgacagcttgcaccgtgagcctggaaaagccacagacacttaatgccggcctgtgaaagcagccaggagggaggctgtaccctgcaaagccacaggagtggagctgctcaagaccatgggaatccacctcttgcatcagcgtgacctgagtgtgagacctggagtcaaaggagatcattttggagctttaagatttgactgccccactgatcttggacttgtatgagccctgtaacccctttgctttgaccaatttctcccatttggaatggctgtatttacccagtacctgtacctccattgtatctgggaagtaactagtttgcttttgattttacaggctcataggcagaaggtacttgccttgtctcagacgagactttggactgtggattttgggttaatgctgaaatgagttaagactttgggggactgttgggatggcatgattggttttgaaatgtaaggacatgagatttggaggggccaggggcagaatgatatggtttggctatgtccccacataatctcaacttcaattatatctcccagaattcccacatgttgtgggagggacccagtgggaggtaattgaatcatgggggccggtctttcccatgctattgatagtgaataagtctcaccagatctgataggtttatcaggggtttccacttttgcttcttcctcatttttctcttgccgctggtgtgtaagaagtgcctttaacctcccgccgtgattctgaggcctccccatgtaaaactctaagtccaattaaaactctttttcttccc

SEQ ID NO: 1656 - DNA, 4382 bp, Homo sapiens
agcagtgccttagccagggacctgcttggccagcgacagatcctttgctgctctgtctgccggttcttgagatggagtctctcactctgttgcccaggctggagtgttgttgatggcaacagtgggccatctggaccatctggagtggccactgccaagatgctggctgcagccaggaggctctgcccatgctgtgagcttcacagagccagagggagcggggacaagcaggagcccagctccttccaagttggcgggtgggagctccccaggcatagctgcagctgcccaagtcatggctgctggctgagcctccctgtgttcttggagaccaggagcaggcaggagccctgctctcctgggtgcaactgcagccacccaagtccttgctacagaccgtgttcttggaggctgggagcaggcaggagtgccaaagcaggcaggagtgctggagcaggcatgagcccttcctgcatcccccacctcctttgtgcagctgtagccacccaggttgtggctgcggaccaacctggatatctctgcactctaggggcctgggaaggcacccccacctcagcaggcttggaggtatctgcttctgctgcctggcctctccctgctcctggtgactgctctgatctaggagcaaggttggggccgagccagggtgctgttgcagcccagccagttgtgcgcatacttgaggcagtgctgacaggccattcctctgctgcttcagccccctccagactttgggtgctgacaaacatagaagggaggctgagggaaggctgaaggcagttcagcatttgcctgcaggtgcttgtccccacgaacagcctgggcaccatagaaagcagtaggaggcgacatgctctgaggcagaaaggggcgggtccccagaaggcctgaagcctaatggccaggccaccagtccccctgactggagggggaactggtggtgctttttcttggacctgcccatggccaccaatggaccaatcagcatgcacttcttcctctctgaggcccataaaattccctggactcagccagactgggggagaagacctgccagcagagaggagctacctactccagggcctcttttctgctgagagctgcagagacaacaggaggaccaacctgcagagaggagctacccacttcagggcctcctctttgctgacagctgcagcgatgatgggacaagctgcctgcagagaggagctacccactccagggtctcctctgagctattctgttgctcagtaaagctcctccttctcagtaaagctcctcttcactttgctcagcctccacttgtctacatacctcattctatctggatgcaggacaagaacttgagacctgctgaatggtggggctgaaagagctgtaacacaaacagagctgaaacatgccccttgctcaccacattgcaggcaaagaggagagaagagctgtggcccttcaggaagcccagaccaggaagctccctgagccaggattgtgactcccgttggggccctgcatttcctggagtctccaagcttctgggcaccactgtggtgtacttagtccagtcacagccttgcagtgagccagggcccgtactggcacctggagctgcccaccctgctgcagcagccagcgtgcctgactgtgtgcagtggccagaccccacactctttcgctcacacatcccttgctacttcacgcctggctcacccttggcaggggcgagatacaggctggtagcattagccaagcacagcctgccaggctgagtgggcagaacgatcccagtgggcccaagcaaaactcaggcaaaggcaccactggccacagaggtttctgactagaaaagcaacaccccaagtatcctgtgacacagtggcatgatctcatctcattgcaacctccacctcctgggttcaagctattcttgtgcctcagcttctggtgtagctggggctacaggtgcgtgccaccacatctatctaatttttgtatttttttttttttagtagagacggggtctcaccatgttgaccaggctggtctcaaactcctgacttcaggtgatccgcctgcctcagccttccaaagtgctgggatttcaggtgtggcctaccatgcccagcctgttatgcctcttgattgactcctttttcataatgaaatgaccttctttatccctgatatatcagtcagtgttcaaccagagacacaaaacaagtaattgaatatatgtatatgtacatatggatttgttaaagagaattggcttacacaattatgagagctagttaggcactcttataatgctgttgtgtctgatgctagaatttgatgttggcagagtagtcagaaaggaagatggaagtaaagtgggagaagtcaaggtcaggctggaagtcacaagtacaaacttgaacctcatgaaaatggactgaaatccatgttagttcttgttgcctttgaccttggtggtgagggtatccttcagaagctggggctgtttgtcataaacacacatacataggccaggagttggagaagctgaaggaggatctagaggatggtagagtagttgcaggccaagctgctacaaaatgagtcaacaaagtgagtcaccagtcagcaacaacatatgtgaactacaaatggctactatttcctttccacattacacatctcccaaaaattgcctttttggcccgcccaaactgtaaacataaaataaataattctaggaaaactggtgcactttaagcaagatgacacattataaaagcatcatggtctgccccttgtcaacttagtaccatacatgtttctttaagccatactttaattctccaaattatgataacaatgaagttgtgctttcaccttacataacactactatcacataactattaacatgctaaccatttcccaaaagaggaaaatagtctttttgttggtccatgaatggcattcattctgctcccagatgataaccctccttctttcatatcctataacttaaatactgacatataaagttaactattaacacatattgtgttagatgataagatgagagaaggaagaaacataaattttcaagtagtttccaaaagaagctgggtgtatatcattgcccaccagaatgttcttcttgaattcaactagacttttagaccttcaagactactgcagatcacccttggcatcagattaacttagaaggataggacagaagccacagctgaccagtaggcagcacctacccctcttcggtggtagtggtactcacagtattttacacaagcatgcagggtttttttttttttttggccttcccattccaagttgacagctcagatgcaaggagatgagacttacattgggaacctgtgggatgcatctggattagaaacttccacaggagctaatatgtcttatagcaactccatggacatagcttctagaatttctgtaagagacatgccaattacaagagtcactatactcagggaggcccaaagttatagtatccattagcatagtcaatatttatagttcatttataattcttttggtaatcaggaaacatttttaccataaacaatattgttgggtaacataattgacctattaataagttttcaataaaacagaatgagaaaattaaccaaaggttaattctcatgtacaaaggtaaagtgttttgttaaccttttacccaaaagtgatgatatgaatgtagatttttttgggtgtttgaccaaggaagccaaaccattctttcagattatgttagatttgtagctttgtggagtgttgccagagatgttgctttctgtgtgtgagtttgatgagctaacctggagtttgtttgttggactggccaaaacaaatctgagccaactatggtccatatcagctgacactgaagaagttcctctcaatgaagtaaatggaattgaagggtttccagagagattagcagtgataatacaggcatgggaagtgatataaaattctcaagaatgaaactgataggccaccaccaatattctacctgaattctatttctcatttcacttgggggaaactaggtcaaactaacatgtgtactaatatatgtctaacttaggcatacgctctagagcagtgattctcaatctttttgagatagtaaatttatttgagaaaaggatgaaaactgcagacttcttcctcagataaatgaacataaagacctacatgtggacttttgcttatcatgtattgtattggaaattaattttctttgatacttagactgtgtaaacaattttcacaaggaagggatttcaatttaaaaatcaatttccagttctgggg

SEQ ID NO: 1657 - DNA, 800 bp, Homo sapiens
atgtgatggggtgaaatcatggcagtgtgattttcaaacaccaacttgccttggaagggaatgtggggatgtgcactgctggaagccatgtgttctgatatgagaagaacttcttcagaaggtatcttaatgcatatggggaaactgaggcccagattgcacatacatgagttgccctggaaaatcccaagtcaaagaagctgcactgcaggaaatcagtatggtgcaggccccaggcaaggcatcactgactacacttgcaagaaacaaacgcctgcaaaaatcaggacaggatgattttgaagctgtgcaaaacagttgtcatagccttctccagcatgtgttccttctgtatttcagacatggcagaggagacacagcaataactaaggggcaactattgcatccagaaaaaaaaaaaatgaagataatgacttctctgcaactaagatgaagatccactgaactttggggtttgaaatgcaacgttagaacttcagactcccggcacctaggtctccagctgctgggtggtgccagcatcagagatacactctgcaaaacatatactgtcttaggaaaaagtgaccctgttgtcctttcaggcccatattccacaagaagacaaatggagatgtaaaaggaaaactgcagctccgactgaagagagagcaagttgtctgttctgatacagccaggaaataagatgttctggttaatatgtgctaaagatgtggtgctgactttccgactcagaatatgatcacatgtttttctcattaaaactatattgaatatta

SEQ ID NO: 1658 - DNA, 878 bp, Homo sapiens
cctcgcgaccctcctgcttccctccccgccccgcgccgcctctctggtttgtgcgcccgtcgcaggtcgcaggcctctttgtcagctggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctgggtggcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctgccacctccgactggtggagaagcctggcaggttaataaacttacttggcctga

SEQ ID NO: 1659 - DNA, 2310 bp, Homo sapiens
agcgggggtgggagctgcggacggccatgtgcgcggcggagaggccgggtggccaccgaaccttcccgcctgttctgcggggcgtctgggcatggctttcccaacctagtaactgcaacttttagcatcctacatgtaggacttgggaatatgtgagacagcgccaagaatttaatccaggagaattgacaagcttaaatgaaatccatattgcccactgattttgtgcagcttcagataagtaatctttctccacttagccttttgtaacaattgatgtaataaaggtttgtagtctttgtgtaatttattaaagcattgtgcctaaaatagaaaaaaagcataggaaccataggctgtgttttcttttgatttaatattttcatttcttcagttaatagaaatttgccaaattctgatgtttttctgtagcattatttgaatgagcattgtttatttgagtgaacattcagctaattgttacagaatcgttgcccccattaatcttaggctgtagaatgtagacaagtaaataggcatcatcagtatgatgagagtgaagctacttaatactgtggaatcaaataaaggaggaaccccttactaaaccaagagggaggaataaaatggaatgggactagagaagcaattagctttaataagggtattatggaagactttctagatgagaagcagtaagtacagatgtttggaggcaaacactagagagattgttgggtaaagaagacaatgctggaggtctacttgtgaaggccttgaatgctatgtgcagaagtcagcttctgagaaccaggaagaagatattgaaagattttaagtagaagaatcataggattgaattcattttagacagatcactgttacacaaaaatttgaggcaaacagaagagtttggagtaaacagtaggctgtgagccagtaatgacttggactgagttggtagcaggtaggtgtgaagaaaataaagtggttattgggagatttggttaactgaaaatgactgagggagatagatgtcaggtgactcccaagtgagttggtggagcagctaggaggatagtaatgtcttcactgagattagaaacaaaataagagaatatatgttagggaaggaagaagtctttgttttgaccatgtaaaatttgaagtgcatgtgagccaaccagtcatatatgtgtagtgtgcaattagatattcattcaacactgttggaagagcacctactctgtgcctggtactgttctacacactgaaataggtaaagcagcagcaaaacaaatggttcctactcctgttttttagagggaaacagcatataaacaagttttaaaaataagaggagagagaatatcccataaattcgtgaagaaggctgggtgcagtggctcatgccagtaatcccagcagtttgggaggccgaggtgggtggatctcctgagttcaggagttaaagagcagcctggccaacatggcaaaaccccgtctctactgaaaaaaattagctgggcatggtggcacgctcctgtaattccagctactccggaggctgaggcaggagagtagcttgaacccaggacacggaggctgcagtgagccgagattgcgccactgcactccagcctgggcgactgaacgagactccgcctcaaaaaaaaagagtttgtgaggaaaattaaaagctgattggataaagtgttactctggggaaaagagagcaaacttttggtggttggttgatcagagatggcctcactgagaaggtattagaaaggacaagaacagtgtgagaccaaagggaatagctgggcaaaggccctaaggtgaaaaatttgttgtgtttagggaatagcaaggtcagtgtatccgaaatctagtgaccaaaagaaggaatgataggaggtgaagtcttcagcctcaataagaaggtgaagtgcactggaagccattgaaggatttaagaaatggagtatctggccgggcgcggtggctcacgcctgtaatcccagcactttgggaggccgaggtgggaggatcaagaggtcaggagatggagaccatcctggctaacatggtgaaaccccgtctctattcaaaataaaaaatttttttaaaaattagccaggcgtggtggcgggcgcctgtagtcccagctactcgggaggctgaggcaggataatggcgtgaacccaggaggcagggcttgcagtgagccgagatcgtgccactgcactccagcctgggcgacagagcgagactccgtctcaaaaaaaaaaaaaaaaaaaaaagaaa

SEQ ID NO: 1660 - DNA, 1236 bp, Homo sapiens
tggatcgatgatgacttccatatatacattccttggaaagctgaacaaaatgagtgaaaactctatactgtcatcctcgtcgaactgaggtccagcacattactccaacaggggctagacagagaaggccaacatccgtttgttgacatgggttatatcaaggcgtctgttcaggcttagaatgtggtctcttatgggtgatgggggtcacaggagagtggtggctcccatgtataggaaatttcttgtttgaaggactgtcagtgagggtgggtaacacatgcattgtctgcaggactaggtgaatgtccatgtggcctagcaagagttagctggtagcccgcctctggttgccaatttgttcttgagtccttgttctgggttctcaggtcccacggaggaaaacagatctgtgtggttgagaggtgggtacaaggccgcatctttgtcatttgttggctaactttgtccttggttgaggacattagagttttggtcaccaggcatagcctatgtgcctttgtgcccgtgttgtatcccacgtgttttgaggacatgtattttgcacgtaaaggtgagctcctgctccaagctggttctgataccaaaggagtccctggcttatcctaaactcatggtaggttaaagccttcctccttaggggttcagggccgcaaggcttttgtgagtggcattgcaggcgttgaagcagtgatgttgagagggatggtcaatgtcagtgctctttagcaggatggtgtactgcaggggcccccagccccgagacgagcatccctgcatccatgcatttctgcctccatgaacaggggaggccagagacaggcagatagtagataaattgcaggggactggatgacatggccctcgtgacctgtgcacctgtctgtctttctgaagcacgcctgtgttaactctgcacctcccaggtagcactggcatggagggcaggcacatgttggtgagggacaattgttaccttgtgtgagctgcggagataccaggaagcccctggacacaaatggcaaaggctccttcggaagttgttggatcccttctgaatgtaagcacttctttcccagagcactctgagtttcctcatttgcagggacaaatactgtgcgtggatcgatgatgacttccacatatacattccttggaaagctgaacaaaatgagtgaaaactctataccgtcatcctcgtcgaactgaggtcca

SEQ ID NO: 1661 - DNA, 577 bp, Homo sapiens
gaaccaccagacaatggaataagaaagcagaacacagtgtaattctcaagcacgaatatagtttaggtttggcaagagaactaggggagacccggagtgaatgccacacccaggatggccatgggaatggaaagccaaacacctctccagggtacactgatgatgacatgccacgatgttacttgcattctgaggccctggactcccactgggacactgactgggagattcttagagcactgaacgattggccctccaccttcccagcggctctttgggaaaagatgcccattgcatgaagcggggcctctcaaggaggagccccaggtcacctgttgcaacagaatcgcctgggagctccaaggcccagccccaacccatacccaatgagtctgaatctccaggaggtgcccagacatctgcacatccagcaggttcccagcttcacattgtaaggctccacctctttccacccccaggatcttcaggggcacagtaaagtgtccaccatgagctgccttcaccccagcccttgggaccatgtggggaccgggtgggaactctgggctcctgtgac

SEQ ID NO: 1662 - DNA, 581 bp, Homo sapiens
gtcagcagcttaattctttctctgggcacgagcagcctgagctgtgtcctggctcccctctgttcatctgcaaagacggacagctctgtctctctctttctctgggttccagcacgcctgtacagtgtcagcaaggcaattatgtctttacagacaatagtggcttagagccaagtgataagccttcccgtgttatggctacatggctgtgataacaggtggagttatacgcctgcactgtaaactcgctgagtcactctggatgtatacctcggcctgtgcttgaccaaagcacagccatgttccttgcagcaattcagctccgcgtactgtgccgtcactgtattccagtacctgtaacctaaacagctttctgtgccctgctattcaacgaggtgtcttcaggggaaggtgtcatgatgaatgtccagtgctctgggcatctccgagttcagccagatgttgatacaggtggccagagagatcgtttgcccaaggtcacacagtacgaggtagaagttggtattttcatctagccaacctatctgattacaaagggatcccctcgcagtacctgggca

SEQ ID NO: 1663 - DNA, 131 bp, Homo sapiens
aaaaagggcttctgtcgtgagtggcacacgtagggcaactcgattgctctgcgtgcggaatcgacatcaagagatttcggaagcataattttttggtatttgggcagctggtgatcgttggtcccggcgcc

SEQ ID NO: 1664 - DNA, 667 bp, Homo sapiens
aaaacaaatgcaaaacctgcagcatttttcgggaattgattctctgtacataaaaatgagattagtcaatccttttggtgtctgtttagcatacaatgagtacatccagatagttaagacccttggaatcaagattaagagaaccatcaattaaggaggcagtgcgcacctctccagggaaatttactccagtgcttcatcctacctcattggacacagccgaccgtgttggtcctggttccctcttcaaatgctggctcctggaaatagcatcaaagcaagcagctgataagacaaaactgggttgttgcttatgctaaggggaagcaccaccttgaaagagtcattgtagagtggaggtcgggagggcaaagttgagatactgaggttttggggtttggtttaaggcaggtcctttgatgtcggacttaatcagggctgggtaaggatcatgttataatagtttaggattgttggtcacagttttgtattggtggtcacagtgaagtgagggcttcaaagactcttggagctttctttgatgctccctgttgaagagctgtgtggttttattaatggattttcctgaactcaaggagtaaggttatttgcaacttttgtgtttctgggcaagcatttcctggaataataaagtcacaataataga

SEQ ID NO: 1665 - DNA, 455 bp, Homo sapiens
tttgtgttaggctggcactgggttgggtgacaatcctcaggaattgtggagcctgactcccttggaagttctctgccagctcgctgaccccagtcctcgtaaacacagttctttgccaagccctttccttgctccaccgctcactgtgatacgagccccactccaaaccccagactcccgaactgatctcatgtaaacttcaggaccatccttttggggtcctgctcttgcggttgcgaaattagtttgaggaggccatgtgagtgaatttctacagcataaaagaaatcactgatcatctgaccaggcccagaagactcctggcttccacacatacccatgaatcacctgattaaggcccactctcaggattattcccctatcaatgcactgaatctactttcaaccaaggtaccaaaaacttcattgctcaatctaataaactcctttcaatg

SEQ ID NO: 1666 - DNA, 710 bp, Homo sapiens
cgcaggctcggcgttggcctccgcggcccgtgcgagtgcgcccttctcgggtcccctaggtcgcggggcagccggggcggaaggggcttgttcattattttgagagtttgttgtgaacgtcataacctttcgtccttaaatattgccgatacttgacctacgcaagagacaatgtcatgtgattcagcctaatatctcagaggatgcagcattcaaggttctatcttggaagcagagactgtgccctcaccagatgctgaacctgctgagcaccctgatcttccacttcaccttcatcagaactggtgctaagaattctgaatttattgaggaaataaatgtctgattgcaacaaaagaaaacttgtctggctttgggaaggaagaggcttaggaaaaaaattaaaggcgtctttactagaagttcaagactggggctgtggctgagatgtcacatggcagataggatcacaaatttctgttgtatctggatggagatcagcaggaggatctatgggtgagaagaagcacagttacagatggattctagagcctgcttgctgacacaggcttgcaactgcggactttataagcttagtttttaatctgctatcagctagcataataccataaatgcataagaaactaagtattcagtcttacgagaaatgctatcttgacctgaccctttctccaaataaattgacaaaa

SEQ ID NO: 1667 - DNA, 750 bp, Homo sapiens
actggaagcaatcgtttgttagtgaactgctagggataatagtgagaagatcctgtcctatttccaccccttgatccccgtacgcatgagttctggctaaggaagaaacagaaatatatgttggatgctgatctagagcatactttgcatcctaaaagaccatacatgagtctccaaaaggacattccaccattctatcaagccagctgcttcagggtgacggggaacacgagaagactgatgtcaacttttgtctcgtaatacacgaatctatgagtttctctcagaaaatggttgtctgccaacgctaactggccagctctgacaggaggtgcgtggcccaggaggagccatcaggccagttctctgggatactgctgtgtctccagctctgcagtttgctcttcgtcactcagcggcagacggagaggcagacacgagccccttgtgagccctcctccttaccgtcatctcacaatgctctgaaataaggaggcaaatggctgaggtcccctcagttgtagatgtgattgagttctatctaccagaagcatatgcctcctggaagcctggttctaacacctcccacaaaatccttcaagcacttttttctgttccaaggtttgcttatgggggacccagtgaagtgcttcagagccctagagatttgctgagtcatatgaggggtcagcaaacttttcctgtaaagggtcagataataaacattttaagctttgtagactgtataaa

SEQ ID NO: 1668 - DNA, 478 bp, Homo sapiens
actcacacatctgcaattgtctggctattgcctgcagctggctgctttgtgttggccttgcctgtatgactggaacaactggggttcctcttcttccaggtttaattcatgaaatcctgccgtaccttcaataccaagatttatccagtctagcacagtactccaattgtgcaatgcacctttatatgtggataacatctggacccctccatctacctgtgccaaagaaagaatcacaggagaatggagaccctccacgctaatacaaatatattccacttctattagaccacccaggccatggcattaactccatgacatgaagaaaatgcaggaggatgatactcaatacaacaggacttctaaagactggcgaaatgcttcatgatatcatcaaagaatgagatgtaattaaatcaagaatctcaagatgaaatcattctggattatccaagtgtgtcctatatccaaagaaaaa

SEQ ID NO: 1669 - DNA, 553 bp, Homo sapiens
aatgtaagcagtaagagagtattatgcaaaaatatcctaaggtaatttcagtataaattataggaccacatttattaataatatacgttatgagaacaatcatttgcagtctcactgtgaaggcaaaaaaaaaaaaaacaaaaaccaaaacccaaaggataaacagaaatagcacagtccaccgaatacactgcatggtgtttataactgtataaccaaactaagtaatctttcccctctctttaacttttatgcaccacctgccattctagatactatcaatcacactaaataataataaaaaccaaccaccttcaatctgatcattctgggcaggaaactgaatacagttttgaccagatcttcgagaaagattcatatacacgaaattaactagttctgttaaaaggctgctataaaaataccatcattacgagctatacagaactttagaatccagctaagagtgcagaaatactgaatttcttaatttatgtggagggggctgtaaacccaaaggtaagtccgctcccggccgccgctcctttgtttt

SEQ ID NO: 1670 - DNA, 1349 bp, Homo sapiens
cctcgcaggggccggagcccggggtctgcggggccaggaggcgagggcggccgcgccgagggctgctagatccggacggggcgggaggggcaggccggcggtccccgggccacggtgcaggcgtcccccggctggctggccgggcgcgggctgcggggcgcgggcgggccgactccggggcgctgcgtgcgcgcaggggcagtcattcagatgaaattccagtccccggccagagacaccagcccgcctctgccttcctcctcccttcacaaatagaaacggaagggggagggagagaagtggaaaaaaaggcaaccggcgagggagggagggagaagccccggcggcgctccggcctgacccccgggcggctacttctgcgctcccccgaggcccggcgcccccgccgcggagagaccccgcgcgcccgtctccgcgctgggcgggcgcccgggctctgccgaggaaaacaaggattgatcaaactagaaaggaatttttctcaactgctaatgaacaggaggctcggctcccggccctcccctcccctcccccggccctcccccttcgcccccccggccccctcctccccactttcttttcttctcggcctctgctggggcctggaaggctcggggctgcggtcggagccagcctgcggcggcggggccaggccgagccgccaccctcagcgcccagccatcttgggctccgcggcggcggccggggtctgggcgcgctcgctgagggccccgcggcgtcctctcgctcctgattcttttttttttttttttggtgggatttttttttttccaaggggagggctggcggcctccaacaaattaggagagagagagggagaaaatgccaagtcccgatttctctccacctctgctccacccaccccggtcctgtccaaaaaataaaagaagatgagaattggaagaagtcggcagaaaggcgagagcccgcggtccccggctgctgcccaggcgacgcgtccggggcgggcccgcacccgttgctcggtccgaggtccgtctgtctgcccgcggcttctcaagggaggggagggcgcttcgggcagggtctccgcagccgctgtcgcctcagagctttatcctcagatcaaaaaagaaaaaacaggaagaaaaaaatcccaaccccaacactctcatcacagccaccttcagccatcttgcgcgtattattatttcaggaataatctgtttaataaaaatacctgcgtatccagcccctcccccgcgtcctggggtccccgcccccttttaataataatctcgataataaaaacgatcggcgggccgggcagtccgtggcggcccttt

SEQ ID NO: 1671 - DNA, 518 bp, Homo sapiens
cagacactgatttggatactcgaggtcctctgactgagtttcctaaacaagaaatgatacttcacatgcctgaaaatgaataatctagaatatttcattaacattcagctgaccagttttaaataagagcagttgggattgcattcaattaaactggagtctataaggaacaacagttaaaaatgggaacagaggtatcccaagagaactcttactgctatagtatttgtgaggtcatgacagtattatcaacatctcgggacctattaatagttttgtcaagaagaaaagaaaatgaatagcctagttcagtaattcccctcatttggaaaggaatcaagaacccctttgtgattctgttgacagctatggtccctctcccaagaaaatgtctactttgcattcaatttcaataaatttccagaagccttgatgtgcatccacaggttctatgtgagaaaaccctcttcttggatgatttctaagtctacagtgttgtatacttcacaggaataaaa

SEQ ID NO: 1672 - DNA, 1223 bp, Homo sapiens
aggagcgtctctgcccggccgcccatcgtctgagatgtggggagctcctctgccccgccgccctgtctgggatgtgaggagcgcctctgcccggccgcgaccccgtctgggaactgatgagtgtctctgcccgatcgccaccccatctgggagaggaaaggccatgtaaggacagagcaaacaggcaactgtctgcaaaccaggaagagaggcctcaccagatatcaaccttcatggcaccttgatcttgatctttccagactgtgagaaaattaacttctgttgttgtttaagctgccctccaactccgtctgtagtattttgttacggcagcccaaacagactaatacatcaagtaaccacacaaatgcatgtacaattaaaactgacctaactgttaagaagaggagatagggcaagagtatatttatcgagggtattctatctggtcagagatgagagagaaagatttttctgggtaaagttaacaaggtatatagggtggggtgaatatggagtggggaatggtcccagatagggccaattgcttgtgcaaaggccctggggtgagacagagcacagtttattagagaaaccaagtggcagctgtgtgattggggtgctaagagtgaagaggaaggtgatacaggtgagggtggagaagagggtgaggcctaacttcccaggaccatgcaggattttcactgctaacttgggccacttgcacaccagactggagctggaaatggtgggtatgggagacagagatcaaaataacctctagatgtccacttgcatagctggtaggtcacgggaccattcatgatagggaagcccaggagagaaccagatttcaaagagaaagtcatgaatttgcacgtgtcaagcttgttgtgcttttgagtcacttagaaagagacatttgtttgcggacctatctacaagtctagactcagacagagacctgagtcatgtcattacactgacaaggtgggagaggtgattcgggacagtcattctcagactttgagtttcaagacccctttacactcttaaaaaccatcaaggacctcaaagagcttctgtttatgtgggttatatctgtccatatttactgtattagaaatgtaaactgaaatattaatattaatttataataaacctgttttaccttaacataaaaaaaagaaataaaacatgcaaaaatattttactacagatta

SEQ ID NO: 1673 - DNA, 648 bp, Homo sapiens
cacgcttgcttgtgtactgctcttagatgatataaaaacaaatcaaattcccaaaccaaaaagctgcactcttttgtctgggtaaatacagctatgacatgtctatttccatggtttagaatatcaccagtgggaatctactgtggaaaattgagtacaacactatcatcatatgatttgttttgctcatatttggctgtgccattggctgcggagccaggcagcgaactccacacaatgaggagcctgtgaaaacgcagagaaggcaagaaaggatgcaaacatttaggcagcatctgatggtagctggcttgtggtttacctggcctttggttagataactgtgcctgatccctatggccaggaaggaagacagtgctaatgaaaatgaagatctgtacaacaaaagtacaggcctacctcagagatattggagtgttcagttccagaccacgcaataaagtgaatatcacaatgaagagctgaagaattcacatttgggctgatgggcctggggtagggatgaccaacagaccacatgcttcttgtctcttctactccctgatcctctgatagacagggctaagtgatcatccactccttccaccctccagcctccgagtgggccacttttcaagcatggaattc

SEQ ID NO: 1674 - DNA, 2418 bp, Homo sapiens
agacgcatcgactgctctccttgtgcccctgctgacattcccaagagatcaatatcctgtaaaagcctgaagattgcttcctttaaatgagtcttattcggaaaaacttaagatttgatcatagatctattttaagaagtgccaagttaactgacatcgatgccatcgtatctggagtccctaggaaatccagggggggacaatgaaccgtaggaagactcggactcgggtctgcctgtagcactcggagcctgcaaggcaacacagttattgagttctattaaaattacttggtgtggctataaaccaaaccacacccctgtagccaatgcgaagagcttcccgtaaaagccgtgcggtgggaaggcctctcgctgtctcctctgcgcggcaggcagacatggacgacaccgaggcgtgaattcagcctgcacctcctaaagatgagctgttgagggcgatggccacagcaagtccgcaccaagtgctctttaaacatgagtgtttctttaaacaaagaaccttcccggcattgaggtctgattaatgatgccccggcacctcctccctcactcagggatcacttccctgcggcgcgttcccagacgcaggcttccctcacggaggcgggaagatttcaggcgctgtctgttcttgtcttttgtcagcacggacaaggatggagaccccactggtcaggcgagccccgcggtccctgttcctcacttcaccacctggggaagcctgatccccatcgattcgcaaaggaacaaggaaagaacacgttttacctggatggatggtccccctcacggtggccttggaacccgcttcagcgggagaggcagcgcctcactcacggctccccctggccgctgctttaccagggagcgccaccccgtgccccgccagaggaagtgcaggcgccagcacagcacgggccgaaagccacactgtgggacccgcagcgcagctccaagaaatccaaagtccattcacaagaggagcttctccgccaaatcgttgaaaaataaaacgagaaatgagtcgccaccggtatccgctttagtcagccgtacgaaaacgcaacccggtcagctgcacttctgctgccagccctcctccagtcaagcaccggcctcgagaagggcaaagggcaggtaggagttccgacgcatgcggccacggggcggagtcacagttcagaggcctcagctgaacctgaagttatcctaagctcgagccccagagtgaggactcggggtcaggcatccgattccccatcagctcctttactaaagctgtgcagagaatccgaggctatgagtgggggtgggggaaagatgtacaggatgctttggtttcactcctgagatacgagaacgtcctctgaacacacatgcagatagctggacttctagacagaggaaatccaaatcgtttctttcctcccagcataagggaacggtccggtaagagctggtgtttatcgatgctacgtgccagaatggggctgagcacggcgcctcactgtatcctaacgtctaatgaggcagggaatgtcactgtcacactctgcagacgaggaagccatgctgtcagcaggtacacatcttgccacaaaaccagtaacctgtggcactgagatcgcacaccggtcgtccactgccaagtccgtggcctccttctctggggtttgcctgcctcttgatggcggccatgcctctgtcctctcgcaggggctggctcttccagtggtcactactttttggttgcaagcagcagagattccctggagggcttgttgaaagcactcacatcaacggagcctcagaaagggagctgaggccatgcacggccctgcagtttctcctcaggctttggtttgcatccctggcctgactttccctcaacaagtcctgctatctccacaaggcggccagcccagccctgtcctcaccttccagccccagctgagcagcccctccccacatcatcttcagctgctgcccaggctccgcagagcaggtgtccaccgcccatccagccattgtgtttagagggcagagcgacctgccgggaccttgacaacacctggccccacccacacgtcctgcaatattcactgaggaatgcacagcagcacatatgtgcctcatgtgtcctgctgtgatgcagcgagtggcacacagcattattgtgtcaatcatgtgtcttgatgtgatgcactggttcagacagtatcatggatgcagtgtttctttaaaactgtcaaatttgaggaaacaatctaacaaaagccaattgatgaacattctgtaaaggtgacataaatacttcaaaaatgtctctgacacagaaagaaaaaaaacaaaaagggagctattccagattttaaaaataaaagatatagtaact

SEQ ID NO: 1675 - DNA, 359 bp, Homo sapiens
cacgcgaaaccagaattccttccggagagcaaatccgtacagaaggtcgtggggggaggaccaggggaggagggattgatcaataaataaaataataaattaatcaataaataaaatagaaacagctcccccgccccctgttcccctagaaccacccccagttgggcacggcctgtggagccccatccctgcagggcaaggccggtttttgtgtccacccccctcccgacatgttccttgggccttatttacagattcacagttggggggcacggaaggggggtggaggggggtcccctccctccccggccccgtggggtcagggcagaggggtcccgttggtggccaggagcttcttg

SEQ ID NO: 1676 - DNA, 133 bp, Homo sapiens
gcgctgtctttgagcccccgccgagcttcctcgtggcgccgggggtcaatctgcagcgctagagcatgtgcttgcgcataactggggccgcctggcctcccgcgggcggcctttttaaccgcgagcgacaaga

SEQ ID NO: 1677 - DNA, 679 bp, Homo sapiens
ccgagccctcagtgggaacttgttccggtgctattccagtttgtggaagcttcgttcttttgctctttgcaagaaatcttgctactgctcactctttgggtccatgctgcctttatgagctgtaacactcaccgtggaggtctgcaccttcactcctgagccagcgggaccacgaacccaccagaaggaagaaactcccaacatcaaaacgaacaaactctggacaggccacctttaagaaccgtaacactcaggcgaggttttgcagtctcattcttggagtcagtgaaaccaagaacccaccaattccggacacgagtgcagagttgatgtgagaagaagctaatatggtatgaaatgcacccatctcggtttttgacctatagtattaaatgcacccatctcagtttttgacatatggcaccaggattacaaagcttaacaagtcatgatttagattcagaagttacaaagagtggaaaaggtcatattctttcttatgaggagacaagaactcaggttgctgcagatccatatggaggatatgcctctggttacatattttggtgccatgtgagcatgtcctactccggtggatttttttttttcatctctgagcttgacctgagattgaccatctgacctgagctataattttgacataaattttgactaaaag

SEQ ID NO: 1678 - DNA, 8217 bp, Homo sapiens
aggatgggttaggattgctgagatgggctggagccggggcagggggcctccagctaagagaggcctcctgagcttacctcatttggtctcagggctattctcattttccagatgagcagtgatgtgaacaatattggaaagcatcaaagaaatggatgtaaagtgtctggcacagagtgagtgctcagtgactgtgggtgccctctcgtccagctcctctctgctctgaacatgcctttctcacggcacttatgagaatgtgccatcgctgtttactccctgtttgtccccctctacatgctaaattctttaggcccagggactgtgttacactcatctccatagccccaggcctagcaaagtgcctcctgcctagtaggtcctcagtatttgctgaatgaatggatgatgatttcatggaagaatcactccctaaagtttccagcaacaggctgaggaaactcaggatgaaaacatcatgtctcttgcccagtcttcaccatgctttttagtggtggtcactgcactgcatgttttctttaagaagggtgagctcatgccaaggacgagggcatggggtctgtgccgggcacttcccagttccacgttctgggtgtagggaagagggaggatgcccacagagagggagggaaccaaatgcaggaaaggagggcaggaggggcagtgttggctcctggcgggcctggcatatggctgtgctccgagttacttctggtcctgtgtgtggggctgaagcttcagctgccaccagacatccctgccatgtccctcttgagagtcctaacctcactctcaagactcaccccgatgctctccatgaaaataaaacgcaccttccatgaagtgtccccagaaagctccacgggggaggaagtgccacttagaaatgagaaccaatcccaggtgaaagtcatgagctgaaaggcccatatcaggctgtcgtggatgaccttggatgcccctgaggtgtccttaaaggaggcagcattcgctttctcccagtgtgtgtgtggcagaccacatgcaagcttttgggctgacccagttgtgactatcactgtgtcctcgggtttcatcttggggaagggagttgtaccagttcttactcctggaggctgatttcctaaagtgcaaaattgggccagtctgttgaggcccaagtgttctggaaaagatctctgacagatacatggaaactgaatttagttgctggttaagagctttcatgggagcaaagctcttggctgtgggtttcttgattgtcaggtatacattagggcagtggtccctaaactttttgaccgtggagactggttttgtggaagacagtttttcatagattggtttcaggattaaactgttccacctcagatcatcaggcattagattctcataaggagcgtgcaacccggatccctcccatgcacagttcacaatagggttccagctccgatgagaatctaatgccaccgctgatctgacaggagttcaggtggtaatgtttgtccactgctcacctcctgctctgtggcctggttcctaacaggcaatggactggtaccggtcttcggcccaggggttggggacccctgcatcaggggacagaacaacattttgcagaagggaaaaactggtcttcctccttctccttttttctgtactcggccttctctcacttgtggacacttcgtggacatagaagaggggtgcaacactgcatctggttcctccaagtgtggtctaagacccgcaacctctgcatctcctgggagcttgtcagaaaggctgaggctcaggcctcagcccagacccacaggatcagaatctgtatcttgacaagactcccctggtgacctgaatgcacgttcaagtttgagaacattgatctaatcatggagataggtgttttgtgacccaacagccctcatttggattctagacccaaatccgtaacacactaactgtgtaactggggcaggttactctgaggctgttcgagtctccgaatcctcatttgtagaatggcacagaagtgcccactctattatagagttgttaatgggattaaattagtgaatgtaaagctcttggcacccagtgctgggaagggcagctatggagatgataatcattcccctttgccccccttcccaatcctggcacccaggaccaaggccagtgctctcagcaggagggaagcaagagcactggcttgacccattggtgctcaggacgggtagcactaaacagtccttccaatcaacttcacgtttcaagtgcctcaccgaggatgttgatagcaatgggtacagttgagtaacagtttactcgtattatttcattagatatttttattagtgccgttatttccatgcttttgaaggaattcatgagttttcaacttgtaaatgcaacacagtttaaaatagcagtctttaaaagttatggttgtaagttttaggccctctgaattaatgtcctgccctatgtgtctgggcatgaggccacagatgccacacagactgtacctagtgctgagtggagcctatgtggaagggctgcagggttcagctagaagtatccactggggcaaagctagtgttggaaagatcctggtctggcagcagaatgggcatcaacgttgtaagactgcatgtagcagggggtggctggatcacctggagcccagggacaagccttggcacatctatcccttctgattgattttacatattgaagtctgctctcatgggtctccttgccttgaagataattttctctcttttctgctaaggtcctgaacgtttctggcacattacttggacctgatggtaaacccattgctttgtcacaaggcactgggaggttatcagcactgagatgctttccaatgtgcagtctcaacccagtgccctcggcacacccacttcacttagacagtgggacctcaataaaaatgtgtctgaaaggacactgtgccatcattatcggtttaacggccagggccaatggggagaagggagcaatagttgagaagtgtaaatgtgagggatatctcacaaagcacgtaggaagccaagaaatgtaggtgaaatggacaggaaagatttcttttttccataagcctcttcatgtttatcttggaagtgaagaattctgagactactccatgaattgtcattgtggtagctactcagttattcttagataaaaccagcggtcccaaatctcagataactgtcaggaataatgttagaaaagtcaagatgaaatctttctgtgcttttgagcatcacacttggttttgatgcaggtggccaaaccacactgtcctgcaggatggccactctgtcagttggtgacttcttgctccagggagccctgggagctgataactcttggttggggaatgttcctctagctttttaccaattcagtctttcactgactggttattcttgcttttgtgggcggccatacaaatcatgtgctgtggggaagtcatgtcaatcatttcactgtctacaggattccctggaagcttgaagcaatttttcagataattaagtccacagaatacttttttttcctcaatgattgggatatctcaagtgagtcaaaactttattgcgattgcctcaattctccattttcctggtcatatatcaaaaaagactttctgcttcctatatgtggggcttagcatccacattgtaattcaccagagactctctggagagcttggcttggtcccatgtatcctagtacaagcttgccactggtctaagttagaaaatatacagatttggggcccacagaaatgtccaattttatactttttttttttaaatggagaggagtctctgagtgagagaggatttggaaaaatggccagcagataacaataacaatagtgactaacatttattgagtacataccatgtgttaactgtgtgaaataattttcatgtaaaccttttggcaacctaaggttggcagcatggaagctttgagagtgtaagtttcttgtccagaattttataactagaaagtgacagagcctggattccaacctatacccatggacaccagagtgtctatatgtgtctttccagtgagcgatggttcacactcattggaaacatgagtgccattggaacatactagtcaatatgatgccgaaaacagtaacagaaagagtgcaggtgttgaatacgtgttccttttcacactggaaagaaagatggtgagaagttggcatgtcttccacgcaattccatcccatcagctggtctccaaattcccactcctcttggttcccacttctctttgtctctttccagaaggaaacaaactccctgatgaccctcactgaaaattcacaaactttacaaatttcaatagattagctgtggcttctttttaaaatactcataggtagctgggtcctggagagctctaaagccctctaattttgcttgcagacggaagaagggaaactcgagtcactggagacaaaggggcaaaggcatgggtttggcggcagagggaaagaaatggtctgtgaccagggcttaagctgcctgtgttggctctgagtgacagtatgctcttgctccaaggaccttaattggctgatagagtgattgctttggccaaaggtccaattaatactcaagatttgaggactggttttccaaccccagttggatgactttcctggcaagcaaaggttaccgctgtaaattcaacttgcttccttaactgggcacccactctataatgtgaggctatcattctgtctggttaattccagacaagactttgtgagcagatggggaatttggattttcaaattcgaaaaaaaaaaaaaaaagcataagtgagtgtgagttttatgtagttacctcgatgctccaccttgtggaaaatgtgctaaatcccaatgtaggaggaggcaggattgcaaatgtgaagcagagtggttggcccaggggtttatgctcactgagaatgttctcatcaatagcttgctgtgattggctatggacctattgaaatcaccattaaactagaaaacaaagttactcagccctcgtgtggaaagtgtctaagacagtaatgcagaggccgtagtctgaaggtggcacctcgcactacagaacaatggtaggagctccaggttcggatcatggttctgaatttactagttgtgtgcacttaagttgcttagtctaattaataaagcagggatgataattcctctttacagctttgttgcaaggattgcattaaagaaaacatgtaaaagcataagggcattcaattaatgttacaagagcccttccctcaaccccaagggcggctgcagctgttcagcctgacactttatgtgtgttggtcacagtgctgtcttggagaatcacatacgggatagtgcttacctccccatagcagccacgtcatagcaaatagctcattagcatgcagtttcttccctccctgttcagcagcccagcagacaagctgtctcagagcctggatttcagcatgttgcactcaccgcaaatatcctgcaggctgcccactccattctgctgcccttcgcaaggcttcactttgccctccaaccctttttttctcttgtttaccagatggaacgaagtctgtttgtggaaacacccttcccctctgtttacttggacctgattttgaaagtaacaagtcactttatttgggctggaggaaaaagcactaaaccagatgttgaggtgaccgggattcctggaagacattcttctctccaacgagacacatgatgcatgaagtaggagcccctggcaaggagcccaggctgccatggcctcgctcgctcctgcttcccggcatggccccgaggctagctgcctctgtactgcctgagcatcgtcccctggcgtgtcaccagactacccactacctgtgcttgcacctgcaggtgggcagttcagtcgttgcaggctgaagctccctgtcacaggagtccatcagcactggagtttaccaaatggcccagtccaggtctgtgtcatattgttttgcaaaagcaagaaaactcattcagagcttgttacttttatccctgacttcctaagtgagcagtgtagccagagaactacatcccctgacatcctttaagagccatgaccactcctgcccttgctttgtgacaggcactcctggatgctgaagtgctgttgctgtgcaccactatgcatcctgtgtgaggatgagcactccagtccttgctccctcttcccgtggctggctcattagccagagcaaactgtggccttgaaggagcagaaggagcatttgactcttcccagctctcagtctttggaaaattgagcaaagtggaatgaaagccatttattcatttaactggcagttatttattgagcatctattatgtggcaggcaccgtggtgacactgaaaagagaagggtgaacaaggacagtcctgagctcaagcaggctgctggcaggtggtagtgggggcagacaagcaaaggggcacccatgccatggcctgcaatgcaccacctccaggacaaggtttgggacccatccctgggtcttgggggacattctaaaaggaagcagtggctcagcatagacctgaaggacaagaaggcaccagtcatgtgtggagtgggttggtggagatgcgcagagtgcaaggaggtctggaggtgagacctccaggcagaatggagggaggtgtgtcccatagcatgtggactctaaggggctgggagatcttaggggtccctggaggctgactgaaggctggccagggagcctgcctggtaagggcctccaaggtcaggtttgggtgtaagagtagccatttctagcactggttgaggtgcacttccctgtcagtgccccaaaatccttcagcagtgtctgatacgatgttctagactggcattgtttccagtgcaggccctgtctcattcttcaggaagcatgctcatggcaatacccggagtctccactgcaagaccagagtgacggaggcagcagagctcctcagcaggccaggagtctccagaggcactgccgaatgtctaagaagcaacctcattgtattcccaagacctgggaatccaggtctcgcagatacgatgatacaatctatagccaggacatctcttcatgtgtagttttcaatgaatactaggataagcaactatcccagtcttcccaggattgaggggcttctccagatgctgcacttctggtgctaaaaatgagaaactgaaatgaattagtcacccaaggaatgctgaccctgtgctatatgatcacatttactctttaaagcaatgctttgagaacaattgagctgcatagtccctgcaatcttataaaggcatttggcctggaagatgctctgcagccatgtgccaagaataacggctatagggacaatgtttcattaaccccaaagcagcaacctgaacctcttactgtacaatatctgctccgttcagaattagctcgacttgagtcacaggatgaagcttaccaaaaggaatttccacgtccaaggaaggaaccaagatcactgagaggttatagtatgaaaagtgaagagaaaaaacctattctaaacattttattaattgtcaataattattttaaaatatttaatatagtctcctacctggtccactggcatcaagctgccaaatttacacggtcactttgggaagccagctggcaggcaaacatggaaagtgctggctcctagcgtagtgagaagaccacagatagatggtaattttcttctttgttttatttttctttttcttctctccctctttttcttccctcttgcctttccctcccattgcccactttctttttttggctgccgaagatttattgcctttcagtacttatagatgatgttttcataagttctaatgaggtcccagcagtttttaacaataacaggacattactgttcctaagatatattatgtgttttccctcatctttctcccttgaatgaaatgcttagaagtaggctaacccccaattcccttccctttactatgataaatggctccattacttaatagggctaaatactctgctgtgacttttatactgctgatttgaataaaatcttacgaaaagct

SEQ ID NO: 1679 - DNA, 398 bp, Homo sapiens
aggtgatggaaattagagtcctgcttaaaaaatacagatgttctggaatatcaagcaacaatttcaagctttcacacttctggattgaaacacagtttaaagagggaataaaaacctgaagaaagagccacaggactggactgagctaaggcatgttaatagccatgttctagagaaacgatctatgaactcctctgctgaggtccccacacctgtccttgttctctttcttcccgaggctgagtgtctttcctgctgttctgtgatgcttttgcaacactaatgaataaatctctctccaggaattgttttctttttcatgaaacacctctctcctcccttatctcaccacaaaaaagtaaaaaaataaaagaatatttaatgttcagaatccacaa

SEQ ID NO: 1680 - DNA, 950 bp, Homo sapiens
gccagccagcgccggcacttcggagggaggaaggaagcacctaaggcgctgggggcggaaacgctgaggaggaggggtgcgcctcaggcgagagctggccggcgccgacccggcctggggcagcggccgcagctccccgcccgggaccgcgcaaaaaggcccaaggtcccgggccgcactcaccgaagtccaggaactgcttcatggagagcggggacggcgagaagcgcgcgtagaagtccacctggcccggaacgccgcgctcggacgccgggctggagcccgagtccgagctgaagctgcggctgaagccggcggcgcgcagccccgggcccgggccggccaaggcggctccgcgaagcagccgcgccagcctcatgccgagtcccgctagagaagccacagccagtacgccaggtttccccgcgcctctgccgagtgggttgaaggcaaatacttgaagttgcaatcgaaggtcaagaaaatggaatcaagaggtcacaatccttctctgatgatggcttagaaagctggaagacactcaacattgaatcctggggctctgtgccatgcttgctaggagaaacagccaccatgagtccatctttcagatctcaagtgaacagtcattctccagctgggattgagaacaaggggaagctggccatagagccaggtgaccaaagatggaagacaaagggtgggctgtgattcccagagctccaagccttgttctgtcttgtcacaccaactgttactgatgaacagaaaagattttcttggaattcctatgcccctggccttgactctggagccaggggtcaggtgactcacagctgaagaagtgtggctgctattaaaacatgccagaggagagcttacgacggccactattgttaagagtatcattaacggtgtcaaaattcttgtcaaaaatcctgtgttgcccc

SEQ ID NO: 1681 - DNA, 1889 bp, Homo sapiens
caccccagaagggtcagctctaagcagaaagtcattgttgacaggaagaggggtcagactttcccttttccggccagcttcctgggtaccaaaatagcaacgcggcacaacaaagagttggggcggtggaggcctcccaaatgggctggaggacacaccgaccccaccccatgctgcccacccgcctgtgggatccaccatgccacatgacagccagcctgacagcaccagtcgctggtgagtctggtagccctggaaaccctctcacagccagccgagatgtgagggacacagagagaggaggtgccatttcagacccctatgcctggcacgttggggtgagaaggacacaccagtcagagctggttctgaggctcgcatccggagggagatcctggaaccagggctgaggctcgcatcctgagggacatgctggaaccagggggcatccgagttggggacacagtctgggaaggtgtctaaaggaagtgagaattgaaggagggacagagcgctacccagaagggcataactagaggctgggaccaggtcaggaaacatgtccctcaggtgtagaagctgcaagtgagaaaccaacgtggtaggaacctcagcaggctggctccagctccagaagctgttggagttgaggatttgttctctgtagaggagcaacatcacctgtgtagtctggttcctaggctaggccatcctctagaattctgtgtgagccagaatgttcaactaataagagaaggctgcacattgtgggtggagagcgggaaagagagggggcttgcagcatctgcaggggccagaaactacatgcacagagaagctttctcaatcggaaaagagcttaggaaacattgaactggagaacaacggaagcaaacctgtgtccgggagtggctccagtgaaacccacctctttctctgtgtatggaattccaaacacccgttgtacaggaggaagcagctacagatcgtcctactcaccagctgggtggcaccaccggctttaagtaatgggtaaactggctcaagcaagcctgggactcagagacagatgtgcgaagcagagatgttgccatgcctaggctgagggctttcagccaatcggtgaggggaatggaggagaaaggagagaggggtgttgggttgagggccgggatgttaagaaaaggattgtatcctgggagatgggctaaggatcaagaggatgaggagaaacaccccctcccacagcctctgcagcacccagagttgcaagatccaaagagatgttcctttctgtcctctctttgctgtccccctcccctcctggccctcccagcattgcagacccttgcctctggtttgcagctgggctaagggcaaaagcagaagcaagagcctgagctgctttttcctgcctggatttctgttcttgcagttgccacagagctggctccttctcatcatgctagtcttggcttaaacgttacatcctccaagaggcctttgctggccaccgcagtgacgtattccaccctgacatcactatcacagtccctgctttagttttaagacagcacttaccacgaactggtattttctctcgtttccttgtttatttttgtctctgccatctagaatggaagctccccgagagcaggaaccttgtctgtgttgttcatggctatatccccagcactcagaacagggcctggcacagagtaggtgctcaaatatttagttgattcatgatgaataataattgctaacattggttgagtgttactacatgacaagtacttatttcacatattaactcatgggccagtgagctataggcctctgggcaaatccagctccctgcttgtttttataaatacattttattggaa

SEQ ID NO: 1682 - DNA, 1005 bp, Homo sapiens
tgagccggctcagtgaggcggagcggccaagccttcagtccactcccactccccgatgaaaaacccaagaccgggtagcgcagcccctccgcgcacgcgtaacacgaggagacaccgcccacacgccagacgcgctgtgattggccccagctaccctcggaccgagattcctattggtcccaggtgtcgagcatgcgcactttggtcgtgggcgcgtgtgtggaatgggaggaggtcgcgctgtccatgggcgtccttggcctgcgccacccagagatgataaatagccaaagacgtcaatggcacccatggacatagtaagcatagtaggagctgaaaaactagaagcaatgacaatgtcaactattttgagcaaaaagaagcagtgtcttcggaacatttgatcataaaaccagaaattaaaggatgagaaaaacatttttctgaagcttatactttcacatttcctagagagcatatttgtgtggatgggggtgggtaaacactcaacaaaagtttctttaaaaagaagaaaccatcctggtttgatgtaatcaatggttgcccactgctcccttcctgtgcctgtgacccttcccaaactgccctgttgcttgcaggctcgcctgagctgaaaggcagccctcacatcccgtcggcacctccctggggccttctttacaccctggagaacttcacagggaatctgtgtctgtaacacaaaggcttcctggtccagatgtagatactaaggctgactggttatttaagtcctgcggacttactctgccaaaattatttaatcatgtaaaaataatttataattcttataaagtatccccttcataatataatgaatgttggtgctattacatttaagtgcacatgtacagtatacaagattattaataataatgttttcaaatagttattgtcaaagctatttttcttatgtttatgaaagtgcttataaaattcatgttttatgaggctggagatgtatat

SEQ ID NO: 1683 - DNA, 480 bp, Homo sapiens
aactcacttctttccaagcaggattcctgcagcaggaggtgctggctttcactttctgtggtcttggctgccagtgtccccagcaggacaggggtgtgccctgtcctgccatgggtggggagcagggggagttctggtgggtgtgcagctttagtctctgtcagcctgcacttgtctctcttgtcctcattcttgactaaatttcagttgaatttcttcttttttttttttctttgagacggagtaagacagaaaaaaaaaacagggaaaggcaatgcatgtgaaggtgctcacaacagcttacttacaataagggaaaagctgacagcgggggaagtgtctgagctaagcacattacagcccacctcttccacaggttattgtacagccactataaagagtcatgatgaaggtaatgcaaagtgatgaaagcctgtgagcaagaaaaagacgtgttcaggctgtggtcagaactcttgg

SEQ ID NO: 1684 - DNA, 774 bp, Homo sapiens
agaagtgcttatttccccttcgctttccaccacgaatatttttcctgaggcctcccagtcatgcttcctgttttgcctgcagaactgcatttatgaagtagggacctggaattgaagagactcctaaaggagagacagaagtttgaaagagcaagaagagtggatgtggatccagacagaaaaagagaacagcaaatatttgaaagagcttaagacgtactcctcaaggggtttctccttttgcgtctttctcatttcttttgctgccaccgtgtaagaagtgccttttgcctcctgccatgattctgaggcctccccagtcatgtggaactgtaccacagatagaagccttgagaagcttactttggtcagaaattttgcctttgtctgcaggcttctaccagttcgattccatctgtgggtcttaggtttcagttacctgaagtcaaatgtggtccaatacacagactggaataagagacattggagactccaaaagaatattttctggtagactgatatatttctcctaaaaaatttggaaaaattttgtgatgaagaagctacctgggcctgaagatatcttttctggacaaagtaaatgaatgattgaagacctgcaaactgtgtttgtaacgactttctaagattgatagcctccgtgtttcaatgctcatggagcagatggatatgactgacactgcccttaatactacagcatgatccaaagcatcaccaaagtcttcaaagagaaagtaaaaaaaaaaaaatgcc

SEQ ID NO: 1685 - DNA, 130 bp, Homo sapiens
cctggacctgttggcaccacagacagttgctctgctgtgcctgtggcctcggggcaaagagaaagtggcgatttctacactcagtgctcgggaaccagtgggcactgagaatggtttatggcctgacatt

SEQ ID NO: 1686 - DNA, 748 bp, Homo sapiens
ccgcctcggcctcccaaagtgctgggattacagatgtgagccactgcgcccagccttctttttatatttttaaatgtgtcttccccaaatataaatggttggtaagcatgccaaatatattcaataacccccctcctttatttttttttgttgaagtgaggctctccctatgttgcctaagctggtcttgaactcctggtctcaagcaatcctcctacctcagcctcctgctgtgttcatctacaaattgataagagtgaaagtcataatcctacaggaggattaccctatttatttcacaaaccctatttctaccggattttcatacaaggaatacaggcatgtgtttcacctcattaatttattttttcacttagttttgatgatattcacatatattatcaagtgtgcaaacattaaattcttgtgtacaaaactcaaatggtcttccaaataattccccattcttttttcttataaactttcacagctttacccttgacagactttactcaaggaaatctaagttggtcatatgtggctctttcactgattgctatttacttcattgtccagtagcttatgtatgaaaatataattataaaatgtaagggtcctacttccagtgaaactgaagggacttaggcccacttttatcctttactgagagcttatctctacttgataaaatttctactgtattcttggcttaactcaggtcctgtgattaaaaaaaaaatgcaaagta

SEQ ID NO: 1687 - DNA, 564 bp, Homo sapiens
aaattatcagaaaatgagaagcaccatttatagttcacaagaaatgcaacatggactccaatagaagtagatatcaataactgatacttcctctgtttatgaccccaaacatgctaaaatgctaaagtaatgcttgcaaagaatatgaatgacaaatgttatccagcagctttttggtttaaaatgattgccaatgactagcagcttcaatggtaacagtagggaggaagaacccttcagtacctaacaacgctgctgtctgctcctaagtggctttagttagagtcccatgttttaatggtaatactgcattgattttaaaggcatatgcagcaaaatgcggggggagggagagaaactggaagaaacataaaagttatatggttagtgtctttaaagtctaaaaatttaaactattgtttaaaaaaccttacatagttcacagctatcggcccacacagtaagcaaatatctgtgtgtaggatgggagccttcactttggagtggtttttgtaactctgtttacattaaaaaggacagaagagtgttttgttgcattgacaa

SEQ ID NO: 1688 - DNA, 4684 bp, Homo sapiens
ggcctccctgcctaggttacatgcagtggtcatcccggtcgctcccacacccgtgtgggctctgggatcccctcttccagccagcccaggggacatctggctgtctcaggacccagccatctgtaaaaattaggcaggtcccttcagtatgctcctggtcaacaaagaaaaacttcaattttgagaatggcatctgtattccgaagtgttctctcagatgtttgagttccactaagtaggggaagaagatgctgcatacaggatggaatatccaggggaagacgtctaaggagagatgcccagctgggagtcctatgcaaggggaagaagatgctgcatacaggatgggatatccaggggaagatttctaagaagagatgcccagctgggagtcctatgcaaggggaagaagatgctgcatacaggatgggatatccaggggaagatttctaaggagagacacccggctggaagtcaagatatgtcagttgtttccattataataaaaccactcatgttagatgagctgaactttcccttttccccagttcttacgatcaaaaagtggctgtcctaaatttcatcactcaatatccttgctagagtcttcctttgtcagccaggctggagtgcaatgtgcaatggcacaatcttggctcactgcaacctctgtctcctgggctcaagcaattcttctgcctcagcctcctgagtagctgggattacagttccaggtactgaatagaagctttacaaaagatcccggtaccggtaatagccctggggcgcccacttcacggggcctgcaggaagtcctgggaagggactgtttccacaagtggaacaagtgggccccccactgccctcgctgcctgcccctctctcctcattaaaccttcagagaacacaaaggagccgagagccccttttctctccatcttccaaagaagacttttcagtataaaaggtgccctaaatcctttgtgatgccgcccacaagcagcgtgcgctgacacaaagcaacgccgccggccactgctgcctgcagacaagaggccgactcttgtcctcgtctcgggtcccaagaacgggagtaagtttgtggactggcacgcagacttgtgtgcggggcagcccctggagacacaggcagctgcgatgtgagtgtgtcaggcagaggttcagctttacgtcagtgttaaagaaaaaaacctgtgaagaaactattcaagacatgcaaaaggaagtgtttcccacgcacccagggcaggatgctcggtgaggggtggtggagccgtagagcaaacatccttcgagagccaaatgtgcgtgacctttgacctttccccttcaggagtgtacagtgagggaatactcgggtaagcacagaaacacctgcaaaaacaactcacacattcgccagcagggagtcggtcaaaccaaccaggcccaggctgtggaatgttaggcggcggttaaaagtcacgagatacgcaccttcagatgggaaagatggacaccacctgtctcagcgggagaaagacagctgcagaagcttcacacaatttagcccgattcccacgaataaacagaagaaagggcagacaagtttgtaccgacggaggaaggcactgggaccccgcttcagtcgggcacgagtttcccccagagaggggaggaggcaggcagaggacttcactttctatgtaatctttgcctacagagtttgacgttttgtaactgtcctgtataatttgtcatctgaaagcctgaaaaaaatagccaattaaaaagctgccattggtgatgagaaagaacgaagctattgccacgggtggaggaggggcttctgcagatcggcccccggccctgcaccttctgcctcccatcagggctgagtctcctcaggcggctgaatatttcccacctcaggcaaatggacactaagctcctgagtcagacaaaacagtgactccctggagggctgtgtgcccagccccttctcccccttcccacctgctttgctcttaggaaagtcaccaaaggctggttggtgtggctcattctaggtttgactccttaggaatgtggcttttaccagcgtgctgtatccctcctgacaacacagccatctggtggagcgtggagttcattggaaatgcattttatttgcttgtagcatacatgtggctaaggctcagcacacacggagattcgcatatgtgtgcacacgccccacgcacacacccacacacgcatgtgcatcacatgaacgcgcgtgcacacacacactcctgcactcagtcctgctctattaacaggttcttgggctctgcagagctgacagaggccgtgttgggtgcggcaggacaaggctgggcgtgcaggcgcctcctccacagggcactgctcatgcgtcacagctgccagacggaggctccccaatggcgacgctctgacaggggtccgtgactctcctcagggagaggtggctgtttccaatgtcctccctggtgccctgtggctggcaggaccctgcccaccctctccctccccgtccaagctctgttttcatctgaatgcagcagccacgactaacacgccaagtgtgtcctccatgctccagagcctcagatctggtcagagcaagttcttactcagcatgcagatgtgaagtcaggctttattgaagtatttacacagctcattcccgccacgtggaggagtctgcgacattccacacacaatgacagttaaagacacctgctgaccactgggtcctgcttcccctgctcaccaggcatctgtcaggaaacagccggcccctctaccaggagaaaccagtcagctccgctgaacagtggcacatgtgcggttgaggggagattgtcccctgagcacacctgatgactgatgactgcccacacccaaccaccgaccatcaacaaccagtgcctggtaaccacctgacacgtccactcacgcccacttcctcagcgtcccctctgggtcacagctcagtgtcggcacctggccactgacccaacaccttcagttaccacaaatctttgtttcctcaaaaacctgagagtaggtgggggatgctcccttttgtcctttgaaagctgggcaaggctgggggtgggtctgtccaaaccctacaggggaggaacagccgaggggccgcactgaacctggggtctgcagcgtccacctgcctccctctcgctccacatgctcagccgtcctttcctgggcacctggcctgggccgtttactccccagtatccgtctgtgatggatcctctgcggcccccagaaatggtgggttgttctgtagatccgaccgcctcacctgtctccccaaaccaacctcgggttcattctcccagaagtccagggatgagcttgttgcagcagaggggtgtggccggcgtggcccagggtgtgcaggacagggtgcggacctttggggattgaggggtctctggacactgctgctttgctgtcctaacagcccctctgtccggcctcattttaccggggatatgggttttgcaaaccaaggtgacactgacaggatgtgtgagcttccctgtggctgcctcccggcacagctgtcccgacctttgacatcgcgccccagctggggtctgtgatgccaccaatgcacaggaacaagacattcatttttaagggaaaagtggagtcaaatgtgctcagaacaactgagtcccacagtcggggcacctgggccagggctgggcagcttgctgaggtccatcgagcgctgtgggggccagggcttggcacacacatggagactgtgccctgatatccccacccttctgcagctggctcagcaacgtccccagacaccctccccacatctgcaaaccacccttcgcctgaaggagcagccgctagggctgctgagcgccagctctggggaggagggcttgaaacagttttatatgttgttaaaataattcttatcctaagattatttttgttaaaaagagaataggtttccggttcccactcagctgtatcccgcaccccacgtaaccccatcaccaggggcccgcaggcctggccgcagctggcctggggctgagcgtcaggctctgcggctcccacagggcggcaggtgacctcctgaggcagagccagagctgctgagggtcccacggaacacctgtgtggagaggtcccctccttcatgaccttgctctcctgatctggttgtctcctcagcccgccttccgtggggaggcaaaacagccctgtggagttgggtggggcagggctcagccgggccgggtgggcgccccaagagagaggacgggctgccctcctgttgatttctcctggtcctaacgtcaggggggccctgactggcttccctctgtcctgcagatgagggggctacccttatgggacctgggaggccgccctgatgtgggacggatgtcacccggtggtcgcccaggctcgtgctgggccacacaactgcgtttccacatttcctccttggctcccctattctcttgggccgggcgcagtggctcacgccttaatcccagcactttgggaggccgaggcgggcccatcacgaggtcaggagatcgagaccatcctggctaacatggtgaaaccctgtctctactaaaaatacaaaaaa

SEQ ID NO: 1689 - DNA, 651 bp, Homo sapiens
gtggttccccaatgcccccacccttccgtggccccagccagtggggctcagctctggccaccctgacatgaaggggaaggtccagcagccaaaccccaggggctctgaaggaatcggcctgtgggtaggagatgccgggtacctgcttttgtttctttttaaatttcccccaggtggttctgttgtgctaccaggatgccaaatcccccaggccccttaacctttgtaggagcacacgctcaaaagcaatcgctgcagtcagcctgcacacggctcccccacagaggcccaaacacacctggccacacactgcacacgtgctcacagcaccccacactcacacccacgccgggacctggctccctgaggacctggatgcacaaggagggacatgcgcgtgaccttcaagctgagggtgggatcgcactgctcgaacatgaagtcccagatatccagggttccgtccatcctggtggtaaagaaaacggtcggcctcacggggctccaggcagcatcagtgaggaggaggacaagggagacccaggttctacgacacaggtccaccaagtccctctaggaaccagccctgcgaaaggcctatgggtgctgtgctcgacaccctgctcctttcacacagccctggcagcctgc

SEQ ID NO: 1690 - DNA, 1571 bp, Homo sapiens
tgctcatagggccggagcaggagaccctaacttcctggctcccgcactccccaggcgcaccacatttcagcacgacggacagcgcagcactggggcgcgactggggaggcggggaccaataccacgctgtttcagcccggctttttcaaatctctcgggtctccgccctcatttccgtgcattttcgaaacgactgtcacagcaaccgaagccacaaaaacacattcacagaaaacggggaagctccagggttcgcttaccgtctgacaagtcaatcagtccgaggcaatttctccaaaggtttaaccagtccctaatcttctgctagctgagtgtaaccatcactggcaacatctcatggcatattctctcggcagctcagagaaaacgtgtgtcagtgtagaccatttgaaagacatacagaaagagccccattgctttagatcgcagatagatggagagatgaaagatgctttttcaaagggacaacaatttgtcttcacttcccagtgaaaaacccaacaagctggtctggaacatatgtggtccctgctttgacacagtgaaatgtccctggaaactgtaccaccaggaaagctatggaaatcagcaaggcagttgctaaacctttgtcagcttgaaatcagccatggtagggtgttgacaccacagaaatgctacacatcagtgtttcttcaccctccccactgtctctgaattaccaggatgccacgctaccattccagatcccatctgcccagaagaaaacctgagaaattcacctgcccagaggtttttctgacttactgtgtttcctctcctctggggccctagcaagtgtaataattaacccactgggcttaatgggattttaggcattcacatatccagatatgcggaactaaattagaagcaggaagacttccatgtttctggaaagaatgatgcaagaaggcagagtagtggttcccactgtctgctttgctgttactgtgtaaagacttacattcttccaagaattctgacttcacagacagctccccttctggattgtctcctaaccttgaactttaggagcaactgtgtctcaggaccctttgacatttcagtaccagaaatcaaatgtcgcttcagaagcccggccctccaaagatgtcacaatccaacctcccacacgcacaggagaacagcgcgtttggagggatgaagtaactcaccaaggtcacgcagtcctgcagagccaggatcccaacccaggaagtcctcagagccggccctcgccaccgactccctggaggtatgtccatttcactcaaatacccaacagattgagggtttaaatgtaatatgcccattttttgagacgtccgttctgttcagagtttgatatcttattttataaagtggaggtgatcgtggagccagtctcagggctgggtgttgtgggggcgtggatgaggtgaggcgggtgaacacggtatttgcgctcagtaattgctgggctgcctgtaactctaagcagagtcgaatgtcattctggaggggaaattaaagatgatctaagcagaagg

SEQ ID NO: 1691 - DNA, 4271 bp, Homo sapiens
gagtccgtcatcccaagcagtggcaccttccacgtgaagctgcccaagaagcgcagcgtggagctgggcatcaccatcagctcggccagcaggaaacgaggggagcccttgatcatctccgacatcaagaaaggcagcgtggcacacaggacgggcaccctggagccaggcgacaagctactggccattgacaatatccgcctggacaactgccccatggaggacgccgtgcaaatcctgcggcagtgcgaggacctggtgaagctgaagatccggaaggacgaggacaactctgatgagctggagaccacaggtgccgtcagttacacagtggagctgaagcgctacgggggtcccctgggcatcaccatttcgggcacggaggaaccttttgaccccattgtcatctcaggcctcaccaagcgtggcctggctgagaggactggtgccatccacgtgggggaccgcattctggccatcaacaacgttagcctcaagggccggccgctgagcgaggccatccacctcctgcaggtggctggagagaccgtcacactgaagatcaagaagcaactagaccgtcccctcctaccccgcaagtcgggcagcctcagtgagaccagtgatgctgatgaggacccagcagatgccctgaaaggaggcctgccagcagcccgcttctcgccggctgtgcccagtgtggacagtgctgtggagtcttgggacagctcggccaccgagggtggctttgggggcccagggtcctatacaccacaggcagcagcccggggcacgaccccccaggagcggaggcctggctggctgaggggcagccccccacccaccgagccccggaggacgagctataccccaaccccagctgacgagagctttccagaggaggaggaggaggatgattgggagccgccaacgaggcatcctgtgtcaccgctctccaccccgtctcatctgcccctgttctaactggccaccgacagtcctggtcgcccctaactgcgtctttcccctattccgtgtcaccaaccactgccccggggccccagaactgccaccgaggacgcccgcctgcctgcccgcccacccaccctatggcccctcgagcccaacgctgggccctggggccccgaagactcctcaggccccagcccgcccacccgcctgccaggagttgacgctctctggttcctacgttacagcccagcccctggccctgcccgagaggagggcttctggcgcatgtttggagaagctctcgaagacctggagtcatgtggtcagtcagagctgctgagggaactggaggcatccatcatgacgggcaccgtgcagagggtggccctcgagggcaggcctggccaccggccttggcagaggggccgggaggtacgagcctctcctgcagaaatggaggagctgttgctgcctacacccttggagatgcacaaggtgaccctgcacaaggaccccatgcggcatgactttggtttcagcgtctcagatggcctcctggaaaaaggtgtctatgtccacactgtgcgccctgatgggccagcccaccgtggaggcctccagcccttcgacagggtcctgcaggtcaaccacgtccgtacacgggacttcgactgctgcctggcggtgccactcctggccgaggcgggtgatgtcttggagctgatcatcagccgcaagccgcacacggcacacagcagccgggccccccgatcgccaggccccagcagtccccggatgctctgaagtcagcatgtgggccgaactcctaaggggccacccaggcagatcctggctcccagacacgtagctgggctggagaagcggccacccactcattcatctgttggtctggcagactctgagcctgggatgatgcttggtctctgttccccaggtctgtggtgactggggtgccaggcagggaggtcctgccctagttggagtgacagctggggtctctcgccaagttgggtctccaagatgcccagaggagcctcccttaagaagggttggcacaggctgctcagccgagaggagagaggcctgggggctgtcccaggtctctgtggggcctccttggagaggtcgaagatgtagggagcacttcctcccagcaaagccatggagctggaatgagctgcaaggaggagtgagttctcggtcacaggaggtgagcaggcaggagctggataccccagcgcagtcatgcattggggtatgaggcattcccatgatgcgtgcacacgcgcttgggggttggcttcctgatggggagccacttcatctagagactcggccaccaggaaggatgctgcttcggatgggagcccagctccttcgcttctccagaataggggtttggggcttgctagtcctgagattctgagattcccagaatctggtccccacttatgagactcttaagttggggcgtctgggatcccaggaagtgctggccctttgattctgaaagtgggtgattctttgatttcagcatctcagtctgaagcttctgggacttgagactgtggttctgggcccattgggcaggctctatgggccttgggctctcagccctcctgcttcttctgtaggccgtgtggccactgacccatctgcacgtccgctcagcccaagcccctccatgtgggaggggtcattttggggcaaaagaccctggagcttccattcacctgccatccagtgaaaattgaaaagcgatggacgcaggacctgtgaggcggtagcgctcctctttacagccagatcagtggaggaagaggagaaagagggagggagatgggagagaaatgggccagagaaaaagatgggacactcttgcccagtggagggtgtccaaagtgcttattcaaagaagtctattcccacttgaaatctggaagcaccagcatcccttaaaatcattgtcctcagtgtccacaaatcagagaccctcttcattttgagaagggtgtgggcctcccctggtggtctagtgagtggtgcctgggatggagtgggcgggcaggtgtagccagggctggggatgtgctttgcctggcccagttctcacaggggtctcaggaaaacggggcacccactcccacctccatctgtctccaacctggggtccctggaggccagaaaagtgctcttccatttgagggaacagatgaggagtcaagaggtctgttcttttcaccctgggtctgttacctgtttgctgtgtgaccctgtctgggttggacccccagcccctctggacgatcacgggtggacagtctgagcagacacaggcctcctggtcagggccggaaccatctctgccgacccaccaaggcccccttggggacctgcccacgctgtctcctggaggcctgcctcccttacccctcccctccacttcgctgggctctgccccttggtgccctccctgagggccctgcatgcttgtgcctggggtgctcagcgcctctgctatcttggattcccgtgtactcagcccagagtgaaagggcactgtctacctgtcacagggcaccaagtgaaagccaagagccctcacttttgagggtgagggacagcacagcagaggtgtggcttctggatgcaagcagccatagctgtgtgaccttggacaggtggctcagcctctctggacctctgctaagcaacagggctggacaggacacactctcagggcctctcggcttgggaaaactgcattgactccaggactccaggcgagggaagatgcacccgactctaactaatacccccctccctcctcgggctgaggcctctgccattctcccaaaagtatgcaatcaggcccgcggtgggcctcccagccatgccggcctcctcatatgcaatatttcttctggcttctcatggggatggttcatccccgacttgaaatttcctgacacctttccccagtgagcgccctgcctgcctatgcattttgggaacagcccctgtgacatgtccccttccacctgccctctcccccaaagctgtatttttctctggctgagattagaacacattccttgtaaagtatttttctacatcgggttttcttagggctctcgggaagcacaaggggctgtattgcaaaggccgcttatggtctgtttggggccctcgtctaagtctttgtcccaccaggggttgcagtggcttgggggtaggtgccatggggatgattttttaaaataaaattatttaaatcc

SEQ ID NO: 1692 - DNA, 338 bp, Homo sapiens
cccagggaaaaagggacatgtggccaacagccctgattctccaacctcgtctccaactgggcagggcgtgcttacctgtgggccagggcctggagctgggcagggcccccagggcagttcagacggcaatgggtataggtggtcgccagcagctccagccagtggtgtgggtgcagctccaggtagcacagcaaagtctcgatggctgggggcagagcagggctcagcggacgcggggacagcccctccacacccctgtggcttaccccaggttcggaggagcgcagcgatccgctctgtgtcctcgcgccggttgcagtaaatgataatggaatcga

SEQ ID NO: 1693 - DNA, 2045 bp, Homo sapiens
aatagtttgttgcttttataagcacttttctcaacctctcttttctccgctggcatgagaatgggagggcctgacgagtcttatggtagcaagcgtccaggggaacccgcaatcctagtttttgggctcccatcaagagttgccaagaaagctgttgtgagctacttggaagtcaggacagctgggcctccagcctgcagtgacaatgaggctcagactgtgaatcagggaagaggggagtgtctcgggaaaggatggctagagcagactctcccccacccccaaagggactcagggatgaaaccaggagtctggcgctctttgtatcccgctggaagtctactcgagtgggaaacgattgtctcctgcggagagatggggaatattaaaaagaagcctttggctcttttagctatatagaaacagtcctcgtcctttctaaattttctcttcagctgaaattagcaaaacaaactccacttacaccttcaatattagattcttaattttgcaaaattcctaactataacctgggccgaatatagttagaaggagtaggtattctctaaagtgagggcttctcccagaccctccccaccccactcaccatcagcaattctgtccccacccccaccttggttgatattcactacactgtcctctctgtagaatgctttctttcactttttactgagtctcccagactagtaaattctcaacttctgtgctcaaatacattaagtgttcaaagaaatagttctttaacattgtttgggatccagtggctaatgggagagtgtggagtgtgaatgggggtggtggcagaacatgggtaatcagggagaggaaagaggaacaggtcataaaaataggcagacctacttcaatgaggacagtgcatcccgctgtcatttcttaatctgaacttctgcaaactctttgaaaaaaaatgcgcctgccttccacgtttccaacctctaaattagcgaaaccagattgtcctaataagaccttttgttggaaacacatgtagtcataaaaaggtagacggaaagtcaattagacacgcgcgcacacacgcacacattcacaagccggtgctaagtgtgcacccggcgcagctggctcccgggccgcggcgggatgcaaatacaaaacagcgacgcgggaaatcgatttgtcacaaagggagaggtgtaaacgcagcgcaaaggaattgcttgcccaatctaccagccacactctctcgggaccttgccccgccaacttctcttcgccagagaaacgcccaggagagcgggaacattttctagggcgctcccaagttggaattctcatcacagtaatatcagcttctagagtctcagcttttgcaacaaccctggcgccagaaattttcttatgcagcaccatcctgggactctggggcccactggcagtctaaatttgagcttcaattatctcgttgaagaggggagccaatgaaatataaagctttaagggtagcttggaaacttttctctttagaggaggtgaaatacaggattaagtgcctcactgagtccccagagctgaatgtcaaggccagccaagaggtggtgatttcggtttattttacatgcagaagtaggggcccgggttacctccttctcttagaattttggggaaattgatagtccagtgactcctacccacttttgggtgaaggacgatttggaatttgaagtgtggggagacaggcctgtgaagtccgaaggactcactgggtctccagatcccccaactctggaatgcagtgaatacccacccccatgtttcagagcatctctcccatgtgttagacgtcgtgcagtcctgcattttggctgagacacctaaccccggtgcactcaggtcagagcgccagggcttcaggcagacagcaatgggtcacacgggtccttatagttccttcctcttcccaggagtgtcattttagattttacaacacgagcgaataaatcatctccaaaccaacaagatgtcaccttcaggctccccactgc

SEQ ID NO: 1694 - DNA, 562 bp, Homo sapiens
agtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagagtgtcctcctggctgtggctgctttgtcattctctttgactagccagccatctaccttgctcaggcctggaataaaagaagaacaagaagaagaaagaaatgaaatgaaaaacagaaagaaaaaggagaagaaacatttgtaaaagggtcatcttcccatctgcctcccctccttttcctttcatttttggtggcggcacaggaaagccccacttccagtctgatgaggaaagcgacaatctatcaggtacagaaccaggggctgtctgcgaagatggaggggaattatgcttcggattcctctgaaatattggccaaaggct

SEQ ID NO: 1695 - DNA, 530 bp, Homo sapiens
ccatgagtcacagcagctggctcaaggctgggaggggaagtaaaacactaaatctaaggaccactctattcaccctacagtgactgctctttttccctcctgccacagtccagggtaggagatacttctccaggctctcacttatgggggctttcctgctggctacatcactgaaatggaatctcctagtggcccttctccctctacagctctggtgttacactgaaaaactagaagtttcaaaacagacaagggaaaaagagaaacatcagaaagtctgattaaagtagaagcatcatatttctatcaacgtatccactgtgcttggacacaattgcaggcccttgacatcttttgcctggattattgcaacagcctccaaaaggactcgtctgtctccatgatacccctccatcctcctctgcatcatcaccaagggaatctttgtaaagcaaaggcatgatcatgcttatcacctggtggaaacccttcagagactctccactccccagagcaggcaccacatcgtt

SEQ ID NO: 1696 - DNA, 3452 bp, Homo sapiens
cattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcttcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactccgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaac

SEQ ID NO: 1697 - DNA, 545 bp, Homo sapiens
ctctactgtgctagctaatgcaaagctacctttgcatatgtaaggtctagcaggggagaaccaggaggtaggcagcagaagatcctttataaaagaccaagcctgaaatctgaaaatccctgaaattccttagaaattgatcatcttaactctttctttgccaagcccgcatttcctgatttatatccttgttacagctgaaagaagctcatcatgtaaaggtttatagcaccaccattttcctcagaggattttacatatgcaacctatggatggatttttataagaactataccttggacttcttgcatgaagttaggaaggttatcttcagaggctccaagttttaatgcattccagtgttgtcaaatccaaaagcaattaaatactgttgtgtggttttgaattatagcctgcttgttaaaatagctactgtttcccctaaggacagcctgcatttttacctgatgtcatctgactctgggtctcaagagagtggggaacctaatagaacaactgaataaatgtagttctaagacagtgaa

SEQ ID NO: 1698 - DNA, 1205 bp, Homo sapiens
gattccctctgctccacaggagatgcagcgagcaccaaagagccttcctccaggattaagcctgatgcagaagtggttacactgactacggcaagctgagccctgccggctgttgtgcgctccgtggaaagggagaagcacggtctccagcggctgcgtcaggagtggtgccttgtgcacacctcacagggagagaagtctccaacggactgagcggaggaaaaaagaaaaaaggagaaaaggaaaaagagctgcatacctggcaggcctactgtgtgcaaagcccttgagtgacacaccctatgacccacagcactgtggcaatcccagacacatgcttggtcactgggctgtggaacatacaggagccccgtgctccggaacacggaccacccgacaggagcacggacacagcagtcggggcgacgtgggtgcctcacagaagagggaaaaagccaggagggcggcacgtgggcgcaaagttctcagcttcgttagtcatcaagaaaatgcaaactaaaaccaaggtaagtgtgagggttactactgagtttcaacttgactggactaaaggatgtgtaactgttcctgggagcatcttgaggaagctgccaaaggagattcacattgagtcagtggacggggagaggccgacgaaccctccatctgggggggcatgatctcatcagctgccagcacggcagatctgcggaagcactggactggctgagtcttccagcctccatctttcttccatgctggatacttcctgccctcgaacatcagactccaagtgcttcagcttttgggttcttggacctacaccagtggtttgccaggggttcttgggccttcggccacagactgaaagctgcgctgttggcttcccgacttttgaggtttggggactcggactggcttcctggctcctcagcttgccaacagcctattgtgggacttcacctcatgactgtgtgagtcaatactcccaataaactcccctccatatatacatttatcctattagtgctgtccctctagagaaccctgactcgtacacacaagtactggtgaaggggtggagcaaaggaaactagtccactctcatcagggccaactcacgcacctggcaatctctactcatactgaacacaagtatgccctatagcccagcaatgccattctggacatacacgtccaaaaga

SEQ ID NO: 1699 - DNA, 320 bp, Homo sapiens
aaagtcatcagcagcaagatgggcattgtcagtctgcagaacgcattgtccacaatatttgtgaagatctgagccctcaggtcctcaatggtcttgaaataatggctccagtctctgacctggggtccctgcttctccaggtgctcccggattttgctctctagcctccggttctcggtctccaggctcctcactctgtccagttttcctgactctgattctgcgtgggacaaccagtgaaaattgcaggtgaagagaagaaatgcgtatttattcctccactgggaaaaaaaataccatccaaagctacatgacttgag

SEQ ID NO: 1700 - DNA, 576 bp, Homo sapiens
ttcttgtttttgtgtctttaactaggacttctatttggaactgagtccgacagctcaggactggctgctcaaactccacaatttaatgaaaaatctcagatgatgactcagaaaacctctaatgatctgaggaatatattaagggattccagagtcaaaggctgatcatggagggcattgatgagggaagacttcaggtggctggagaccagaagaaaggaacactggaagaatgaaaacggttgtgatgcactgcagtgtgaaaatatgcccttgagccttaaagaaaggggcttaaggccgggcgcggtggctcacgcctgtactcccagcacacagatcacgaggtcaagagatttgagaccatcctggccaacacggtgaaaccccgtctctactaaaaatacaaaaaattatgtgggagtggtggcgcacgcctgtagtcccagctactcgggaggctgaggcaggagaatcgctggaacccaggaggcggaggaggttacagtgagccgagatcgcgccactgtactccagcctggcgacagagcgagactccgtctcaaaaaaaaaaaa

SEQ ID NO: 1701 - DNA, 503 bp, Homo sapiens
gacggccacccagccttcccagtttacatgatcatggggagagcctgtcaaaagcaactgcacagagcctgtgcttaagatggcaggatcgcaagacagagcaactggagcaagtcctcattaagaagagccgcccgatgcatttggactgcgatgtgttacgcccatgagatttcagggttaatttgttacctggccgtggcctatcctcttccagcagatacagaggctactgcagtttgcaactttgcagataccagcagaggaagaaaaacctgggagactgctgctaacctaatgtggagacttgacttaaacttcagccagacaaaggcggaatcttaatatggaggggcctggctctgcagggaggtcacctgggctggctggatttcaatccagttacacagcaaaaaagttacaacccaagctttggcgatgctgagccttctactctcagggattccaaagcatttgataaactctttctttgttccattgtt

SEQ ID NO: 1702 - DNA, 1387 bp, Homo sapiens
gacgtcagcatggccgcggcccctgactacccagctcccttctatccctcgagcggcaggaatccgtccccacgcccttttcctttaaagggcaacgggccgaaggtggggcgggcggcgcggctcccgcgatccattcaggtcaaaagggagagtgatcaaacaggagagccgaggggacctatattcagagacttaaccggacacctggacagaccattacaacttgggacttttcaggagaatgagggaaatgtagttattgcacctgagcctcactccagctctgaggtcctcttcacttctctttggaagaaaattggatatcttttcctagttgaaagagtagagatctgatttctccaaggatcatcgctttttgacacgggattattagaagcattcattcatctatcaaggagttttgggatacttgccataagccaagccctctgataggtgctggaaacatcaagctctgtgcccaggaagttcatccttggactgcacgcatgaacgagtttgctgtcttcccattggattcagccagtccgcggtcctggaagaagaaatactttcccagacaaataaaagctgaggaatatcatcaacatcagacctgtcttacaaaaaatgctaaagggagttcttcaatccaaaagaaaaagatgttaatgagcaaaaataaatcatctgaaggtgcaaaacttgctggtaattgtaagtacaaagaaaacacagaatattataacactgtaacttacatgctgtggtgtgtaaactactcatatgttaagtaaaaagactaaaatataaatcaattaaaataataattgcaacaacttttcaagacatagacagtacaataagatacaaataggaacaacaaaatgttaaaaagcaggttgacacagttaaggtgtaaaggttttattagttttccctttgcttctttgtttatgcaatcagtgtttagttgtcaacagtttaaaataatggttataagatattgtttgcaaatctcatggtgacctcaaatcaaaaacatacaacagatacatgaaaaataaaaaggaagaaattaaaacataccactggagaaaatcacctttactaacagaaagacaggaaggaaggaaagaaggaagagaagaccacaaaacaaccagaaaactcacaataaaatggcaggattaagtctttatttatcaacaataacattgaatgtaagtggattaaactctctgatcaaaagacatagagtggctaaatgtataacaaaacaagactcaataatctgtggcctacaagaaacacacttcacctataaaaacacatatagattaaaaataaagggatagagaaagatattccatggaaacagaaa

SEQ ID NO: 1703 - DNA, 883 bp, Homo sapiens
tttgccacactccttcagagatgcgcagtgctgcccctttctatgggcagggccgaaggtccgcgtgtaaaagtacccagtccctggtaacctgacacttcccttttaaaagccaccttttgtctatctctggcctgccacgattcttcctgtgctccataggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggtgtccatcgcgcttccttcactgccttgatcatgtcggggtcaccacctgcgggggtttgtcctgcagaccctgactcaacgacggatgaataatgtacactgacacagatcttatgcttgtcagtcctgctgagcatccaggccacttacagactccaagaagagtcctgtcagccacggctctgacttgttggccctcccggcatttatttagcacacatttaatgacagaagtctcaggctggaaacactctttttgtagaacatacaaatggacatttctaagcacattgaggcctataatgaaaaatcaaatatcccacaatgaaaactagaaggaagctatctgtgataatgctttgtggtgtatggattcatctcactgactgaaacctgagttttgattcaccaggttggaaacacttttactgtattatctatgaagaaacgtttttgaggccattaagtcctacactgaaaaactg

SEQ ID NO: 1704 - DNA, 565 bp, Homo sapiens
actttctggattttgctacagaagagaacaccatgtgtagggaacctgaattttttgtaataggccgtaagcatgcctgccctttggcctggaaagagacactatatcttccagggctgtttgctgtgtaaacatccttgaaaagacagccttgaacaaagggcagtcaatagttctactcaaaagacatggagaaatgcaaaagacccatggagatttgtcttctaatcggcagcatcttgcaaggagaacaagaagatttatactagccatgcaaggaatctttggaagtctaacagacctgacttgaagagaaggctttaaacaagaaattcttcattctggaacagtgattcttaaagtgcggttcagagaccctgggagacactgacattctttcagagtgtgagtgaggatttcctctttgcaactacaatctgtaaccctttgtatcctgagaaaccgaattaatctgcaccctctctgtcaaagcttcctgatcatcacagctggaaacaatctctaacttttgaaaatctgtaacaactactgagatgtaatatgg

SEQ ID NO: 1705 - DNA, 5113 bp, Homo sapiens
gagataaatatatttggaagtcatcagtgtgtaatcttattttaagtcaggacatggatgaaaccacttagagagtaagtgtagccagaggatagaacttaattgaagacatatgatcgatgaaattcaaggccaacttttgtgatttttcaaatagaaataaaatgttaacattttctaccacacatatacaaaccattactttctatagtgttgtagaagcactaagatttaaaaagcaagattgataatagttgccaaatatgtaaacaaatggcaaattaaattgaggagggagtgtcactttattcttggaataaagtttttgttttgaagtaatacagttttttatattaagaataacaacatctggagtgctagtttctttttctcattgttggaaattgctattccaattcaatttgacagttttagcactagagggcaggcttgcttctagattgtgaagagttctacatgaattaatatagccaaacagcgcaggttgaacatccttaacttgaaaatctgaaattcaaaatgcttcaaaatccaaaactttttgagtgttgacatgatgccacaagtggaaaattccacacctgacctcatatgatgggtcacagtcaaaatgcaggtgtacaacagtttactctgttcccaagagaaaaataaaattagctgcaggctatgtgtaaaaagtgtatatgaaacataaatgaatttcatgtttagacttgggtcccatccccaaggtatcttattatgaatatgcaaatattcaaagatcaaaaaaaagaaatctaaaacacttccggtcccaagcattttggataagagatattcaacctgcacctacattcaatctcaattaatgaatgcagttgtttcttatgtgacaggtttgccatctactatgtttttttctagtgctaggaaagcataaaataaggctaattgattttagtacatctaggactggcagttgacgctaatatacatttgaatataaatgtatatttatattccaaggagtttccaaggaaactcaagtgtagcttaattatactcagatttgatatagagggtcttccaccacatatatgaatattaaagccagtcagaagaaatcctggacatgaaaacattttttcaggaaataattaactatgtgctgggtattattatatgagcgtggctacaaagatgaataaaatatagtccctgcctaaataagctttgttgtagcatcttacagcacttaatatcttgtgctgtatctatttaaatgtctttttcccttcaataatagaaatcctgactcacttatttttggtgcctccaagtgcccatcacacaattcagtttacagtgtttgaacatgtgaataatgagagagagaaaaataagaaaacggtcagggaattggggcctttgaaaaaacttattttcacatttttacccttagagagatgcttttcctattaacacgtctaaagattatggagacaattctaaccttctatctttgctcccactacttcttcaagcagactttaaccccattcctcaagagcagttattggcagccatagagagtgggaggtcaagccttttttagtcattggagtaaacaggagacatagatgtggaaattgggaggttctctctatctggcttacgtcagtttgagaagtttgacatgaaatggaaccttctggaatgaggttctttttcctgcttttcacctggaaagttttcccatacatggtcctcttgcacccctagtccttttagggtacctatttctgtgtgctagttctttcatttccttgtctgtaacatgaggataataatagtccttatctaatagcattattttgaggatgaaatgaaatacaggcagtaaatattagttactctttgctatctggaaaaacatcaattgaacctcataggatggacttgtgttcaataagtgttatatatagtagagtcaaatggaaaaattgaaccactcagatacatttttttcattgatacataatagatgtatttatttggggggtacatgtgataatatgatatattcatataattaaaattcattgatacatgatgtatttatttgggggtacatgtgatagtatgatatattcatataattaaaattcattgatacataatgtatttatttggggggtacatgtgatagtatgatatattcatataattaaatgaagataattgggatatccatcaccttaaatatttatgttttctttacactaggaacattcgaattctctttagctattttgaaatgtacaatagtttagtgttaatagatcagtcatcctactgatatatcgaacaccaggtcttatttcttctgtctacatagacatatttagaaatgcaaatctcttaggaaattaatctgtaatgtcaatgatgcacactgatttgtattacttgctttctttgtaggcagtatagtgaaatggttcattaaatggatgctaaatatgactaaatgatcaatttacagtgtagttggcaccaagtaataaatgctcagtaacatagctactatggctgtctttaaaagtggattggtttgacttcataggaaggactctatttttaaaaaagagaaatattaaaaaataaaaagccaaaattctatgatgtcttattacattgagtctcttaaatcagtttttttttaattaagtagcaggaccctattgcaaaataagttttacctagaagcacagtatttaaaacagaaagctaaaatactctggttaagtgggaagctccctgtcttcctcgctgctagtattatttctgaaaaacctcaaaggaactccttgctctctgaatagcaggttttaaaaaccactacttgcacatttgcaccttgacatcaaacatgtgaacaaagtaatagagtgagaaaactgaatttctatttaggaatttctattttattctctctataaaaagccaagaagtggttggtgtttggaataacatgaaaaatattccaagtatctttggaaatacttacactagaactataaggtttatgataattctatcttagattcattatctagagctggtctaaaaaaggatgatatgtaagaactaccaagagagacttggagtagatacaagaatgaaggaatgaatcaatatccaataaatatccataggcccaggctttgctatgccctcttattacacaggataaaacagtgtagttgttagtttctacctttgaagattatgatccttaaaaaggaaacagctctgtgaacagagaccatgttattcataggtgttcctcacttgtttccaccacataataggtatttaatgaatgaaaaaattcacgtctctctttgatcctagactgcaagttacttaaaagaaatggaccgtattttacttatctctcatggcctgcaaattgagtttgcttactgaattaatgaatgaatgaccaattgtacacatatgtctgtaaaacgtttacatatccacattcccattagactgagattcttgagggcagaaaccatgtcttcagctctcagcatggtgcctgactcatggtaggttgtcaaaagcatttgcagaactgaataaaacttacgtttaagtagtactggagcagtctcacataaccgggcacagtgtcttctaaatagacactaaaattatttcataattaaagacagatctcactaagcattttctgagttagtgccagttgaataatatgacaataagctataggagttcagaggagagtgagttctgtggactgaaatagtcaaagtggattttcagagcagatgagacgcgatgaaggctggggctactttggtgttttaagaacattaattaggcagcaggaaaatctgaggacagggagactagtaaggaaggctggaaagagccctgggtttggagttcagagatctgtgttcagagtcctttgcttcttagtgactatgtgaccttgagaagataacttgagctccctttttcctcttctgtgaggtagaggtaagattgatgtgcatattgatattgtacttaaaagtgtttgtaaaatgctaagtaaaacctaatgctatgctttgaatgtagtgggttccaaatatttgtttaatgacaaagaataaatgatattgactaatgaaaataatggagccactggaatgtcacctcctgcatctgccagtaaacctgttaacacaggggtggcgggggggggggggaagtaaatatgtgaagccaccaaatctcatgatcaggagaaaaactttggaactcccatgagactccaaagttatgtcacaggtgaataagtcatgaacttttcatgctgatatcatttctaaggttgctgccttgtcagaagaagcaaaccacaagataaaccatgcagaaaatctttttttaaaaaagtttcctgaaggatggatggttcatttgttctgcttgtcactttacttactaatgagtcatttttttccttaaccagtaatttgttttaaatttggtcataagatggtatgttgactagtccaatgttacaaaataattggaaaaaagatgacagaccaccaactgaataagggaaatctggttcttgaacttccaatgtatgaattggtgatggtaagcttagtctttatgatgtaagattggatttattggaacttctttatgtccagaagttgcagcacctttctttgtctctggaatgcccaagatctctactgcatcctgtagacatggagggtttccccccttattctgggtctgattatttttaaagaaacaccctttccttacccatcatggagacactactaaccttgtatatacttttattagagtgctgataacaccatattacagtagcatacttacatatctgttttcttaactgtgagctccttgagagcagggactgtgtgtttttgcttttatttcaccagtactcagaactatccacagtatagaaaagcactcaataaatggaataaatgaaaatgaatagataaataaatgatttcacttgtataag

SEQ ID NO: 1706 - DNA, 8398 bp, Homo sapiens
tggccagggagccgcaggcaagggactaaggggaggggggctcagtgccagctgcttaaaaatgcccctgtggcagcgaggggcaccagaggctgggtctaattagttgagaagcagtgacacccccaaccactccccaaacaggctggctcccgtctccaggccccaaggagccacacctggaccagaccccaggaaagacatgtggtggaaaccctacggccctggagcccaaggagagcaacggctgtaacaagtgcacaggtttgagtgcgctgagacaggggaaccgtgggcaaagaggtccctccagaaagagctgggtgtgagcatgggttcgtgagcttgcctggagccctggcctcagccctctctcactgaggtgccatctggctcgcagatgtggcccattcccagcccctcgtgtttcttggaaatgagaaagtccaggaaagggcacaggggctttcgcaacgaccgtggcgatgatagctttgacgtgtggtcatccagccggccactgcccacacccaagagaaagctggattgagcatcaggagcctgggttcaagtctgcctctcaagctgttccacaggtgaccctgggcaaatcgcacaggctcctggaacttcagaaaggggaagaattattcctgcctctggcgacatcagcgaatgtgccttgagttacgggagtgttttgaaggctgaaagctttgtgtacacggaaggggtcaaagacagccacaagcctgtccctttggtcttggtcatcatgttaaccccaggtttcgatttaatcctacatgctcctttcttatgtgtgaggctgaggtgggggcattggtcagaggagcctctgggaaatttcctttcaggacagttcttttgttaaggggcctgggtgtgctgagaagggaaggtggctcctcctgctcttggagcttggagtttctcacaagctctcccttaaaagccaggcaggccaagaagggataatggctgctcagggcccaaggggcaggatctctgaggcccggaagatctcagtaggtttagcccaagagtatccagaagtggcccaggcccattctccatccctcagagcctggcagcctggtcaggaccctcaaaggccatgaccgtacccgtagggcaccctggtgtccttctgacaggtgggatctttgtttcttacaggcaagggcgctagctggtgggagccaccccgccatgctgatgtcagagaagcaagaactctggagaagcagcctcctgggaccagaggagggccagcagcaggcagcccggagacagaactgtgagcccaccccacctccacccttccggcacccacatccgctccccaccccagcccacctgcaggtggctcctggagtatcctgggtccctcaggataaactccccaccctaacctcagaatgaccaagaaactgggcctgaggatgacaagaagcagaatgggccttggtaaaggaagaccccccactgattggtggcagtgcgggcagttcagggctgtcagcgtctgggttgtaggtaaaaagaaatggaacccaagaagggaaatccaactaggagccaagaatccggtctaccccatcctccttacgaaatagcaatgcaaagcccgtgtgatttggacataaagcctctgttactcaacttgattcggtgaataacagacttgaaagaaatgtggaaaataatagtaatcttccctagaaaggagtaaacagggttgagctcccaaagcaggaagacctggggctgtgtgatcttggacgagtcactcaacctctctgagcctagtgataaagagccagctcatagggctttgagaggatttgtgaggttgggctggtgtccccaggcacagcccttggcacatagtgaaactcaagaaaacagagcagtttttaccattcatcacattattcccacacttgccaattttttaagttcatgcacatggtggaacaggtagggtgaggtgccagctccataagatgagtggagaaactgaggcctggagaggtgaaagcattcactcagagttgcatgtagagtcagttgcaaaggagaattctggcaccagttctcatgtggatggaaaaagtgcaggaagatttggaggtgagcagaggagaagggaggaggaggccgggttccaggaaaggagctgacatccagggatgtgggacaaggcccaggcctgtcttacataacatggtccacctgttcacccctgcaggccccacaaatgtgtgcaaacgtgcaccccggcacagcgcacacccagtcctccctcactggcaaataagccacagagactgggtttaaacaaattggattaggagggctacaggcgcctcctccccccgactgtccggctccgacactaaacagacctgcagaactgccagctgtggtctctcggacacactgacagtcggtccttggctccctcaccccacccgtgggcctcaggaagggggttggggtctgagaggatgccacagtgatggatggggtgagggaggttccagggctagctcaacagcgcacaggatgttagtgcttttgcgaggcacatttccgagctgttcccagacccgcccccacttcccccctcaccctcccctccggcagcctctcccatggccactgctgcgggctgtgagcagagccccgtccttgagcagattgacctcatctttcagtcctgcagctgggctgagcggggagtcagctcagaagacactggcctggggatgagactcggggcatgcttcagagggaagaaagagcttctgaacagacaatgctgtcttaaaggtggcatcttggtgctttctcatgccttgttttctttcatcctcagaatgtgtctgggggtgagaggacgggtgtgactgctgaaacttcctttcttggtgattccacatcactcctttctgatccctgagcctgtgccacgccctgtgtgatgtgccggggacaccagggtgaatacttacaggccctgttccccttccttcatgaaacagcctccttcgggctgggtcactgggcactggggcctccctggtcttccaggattgcaacttcacagaatcccttttccataaggcacatgaaagtgactgtgacccgcaacgggagccttgacaaccagccaattcagaacacagaccttgacatcggaaggccccgagttcaaatcctgccttgctccctttcagctggaaagctgtggtcaaattacttagcctctccaagccagttttcccttctgcaaaatgaggttacacaagctgccacctcacagaatgagtgtgagaattaattcttattttccacaccctcatttgacagggggagaaacagaagcccagagagggaaagggcttggttaggatcacaccatgagttgggggttaagtcaggatggggtaggtcccctctttctctgggtgttcctctcccccatcccttatctcaacataaatcctccccagttgcccaggttgtccaggcgattcctggcacacgtcctggggcctgccctccacctttagccctgctctggcttctgcagcagcagagtcctgggtgaccagcagtggcccctggccctctgagtggtggtggagggtgggggtgcactgcagcaagctcccagcccagagcagcctggccatataagggaaggagctcagggaggcctcctggctcaggcctggcgagaaaacccagacagccactgtttattttctcctccccagctcacccacgcctctccaagcctcccaacagaagacagaggtcccccacagccagagacatttcctgaagacatggggaacacagaggcagaaacagcccatccacccaggagctgtcccccacactgccgggagccggcacccagagccgccaggtaaaactgaggccacctggttcaacatcacctttcacagaaggggaagcagccacagaaagaagggcctcgttaagaagtggaacctgggacccccaagcggtgtctctcatcctgactggggatccagagtaggagggagcctttggtggggtaagtggaatggggcggggtggggggtggccatagacccctcttctcagtaaggccctcatgtgaaggaggcaggggttgggacaagtgctaagtatgcaagactcaagggaagagctgctggagccaggagaagcacctccctcccggcccctctgcccctcctcatagcccagctgcactgactcctcctccaggaagccttctcagcttccccaggggtgggaacctttttgtcctccaggtgtgcttggctgtcctttcttgggctctctctctctctctctcctcatcccacttgagtctgccccctattcaccttgtgaggggaattttccttctactcaatctgaccgaggtcctccaggtcaaggacagcgaggctctcagtcccacttccccttggcacatagaagaggcagtgcgctgaagggacaggtgaaatgattagaccctgcccccaaaccaaggcctggccaattggacagggcatgagacattcagcgtagaggttaaaacgagggccctgggttaggaaccccagctcagttctcagctctgtacccttggaaaattcccttcccatggagctttgtggatgcacaaggacttgcacaaagaaaacattcaatatccaggactataaaattccacaaatgattgtgcttattacattcattatcacgatgattattccagacacaaaggaacagaacgaggcaccaacagcaaggggcaagcagattcaagggccacagaggagatggaggcaaacaccttcccctggtcagaggctgtgcctcagcccttctccctgcatcagtttctccttcagaagcatgggactacctcccatctagttctcgtttctaaacctaggggagatgctatctttgctgcaataatcttagcctacatcttggaatggaaatggccttggtggaaatggtcttcaactcctctggtccaagctcaggccctgtgaccctggaacaatccccttcctggtcctccatgtaggagcaataacattcccttgccagcagcaccagccattctgatgattaaatggtatcggactctgttttccaaactcagtcattcagatgccccctattttatttcttccatgtctgcaaatgattataatatttttaaatgtaggatgagtcctttttattacacatagaaatagctactgtaaatagcaaactctaacactgtgcctaattaggaaataaaggtaaccataaatacagtaaaaatgaaacaatgttattatggtttaacctgatagtgtggcttgcaaggccctgggcctgaagcctgggcaataagtgagagttagaaaggtgtcaaagacatgatagcagcaaactgaggctttgtaccccacggtaaataggactgaaagcaaattcacagggagcaactgatccattccacaacagaatgctccctgtcaattcgctttccattctgttgtgtcctgtctcccagcagagactacaaactccccaaaaccacttacccaccagctgcacgtgagaagccaaaggtagtttatgtgaaagggctttggaaataatcacgcaccaagtgaaggcagaggacacaccttgtcagcttagttctcagcagcaaatcatctcttttccaggataaccctccctgattcttattgaaatctctttgctgaccacactaagctcttctctctcaggggcagtgggagccgtggagagtggaatagaccagctgtctgtgacctgcgagggagtccaatgtcggaatcactccccagccaaatgcacggttttaaaaaatctatttatttatttatgtagagaccaggctatgagactggctaatttttcgtatttttggatagagacaggatttcatcgtgttgcccaggctggtcttgaactcctgggctcaagcgatccacctgcctcggcttcccaaagtgctcaggattacaggcgtgagccactgtgcccagccaccaaatgcagttgaaaagagtttctgcaagataattccacagaagaggaaagcagttatctggctgggaataccttagacagaggctgtcctctacacaggctgtcagaactgacctactgacctgcctgctggcatgatagaccagagggaaacactctttccactcttcccagactgagtgtaagagacagacttttttttttttttttgagacggagtctcactctgtcacccaggctggagtgcaatggcaagatctcggctcactgcaacctccacctccccgggttcaaaccattctcctgcctcagcctcccaggtagctgggattacaggctcccgccaccacgcctggctaatttttgtatttttagtagagacagggtttcaccatgttggccgggctggtctcgaactcccaacctcaggtgatccgcctaccttggcctcccaaagggttgggattacaggtgtaagccactgctcccagcctttttttttttttttattagagacaagggctccccatgttgcccaggctgatcttgaactctaggctcaagcgatcctcctgcctgagcctcccaaagtgctaggattacaggcatgagcactgctcccagctctgtttttgtttttttaaggaggtatattttttctgttctctctcagccctgaagaaaggctacccatccccttcagacattcctgaaaatatatgtcatccaacatcaaggccaccacagtgaccactaagcaatgcaagaaggtcctctggggtgccctgagatcttggcagggcaggaagagtgagaaggggctttgcctgctcacctgaaagttcccacccaagccgggcccagaaaacaaaatgaattatctacatggtcatccaatcagccaccaaatggcattacctaggtccatcatcatgtaccaagccacaggtcagacccagggccccccaaattaacaagacacaggcactgtcctcaggaagtggagatctagccaggtcagacccacacacaaataacactgatactagagataatgagattgggaattatgattcagccattcaacctgggcttatgtggcatctacaccacctggccctgatttcagtagtgagcacagttgacagggtcccttcccttcacaggtgagccatgtagtccacaagtggaggtggtcgtaagtgaaaaccacattaccagcatggtaaagggttagaaagagggcaccgggtgggcgagaacatgaagcagggggtgctgatggctaaagaagtaaaggaggggctgggcactgtggttcatgcctataatcccagcactttgggagaccaaggcgggtggatcacctgaggtcaggagttctagaccagcctgggcaacgtggtgaaaccctgtctctactaaaaatacaaaaattagccaggcatggtggtgcacgcctgtagtcccagctacttgggaggctggggcatgagaattgctttaacccggaaggtggagtttgcagtgagccgagatcgtgtcactgcactccagcctgggcgacagagggagactctgtctcaaaaaaaaaaaaaagtcaaggagggtttcccagagtggccacttgattagagacctagcacaggaggaagagatgggcagggagagtgacggggagcagcacagtccctgggagcccgaagtgggtgggcacagggctccctaggagaatggaaggacatctatgagctgtagcccaagaggaagaggtcactggggctagatgcggcagaccctcgcaggctttgggaagggcttcagaattcagcctgagggcaatggggagcccttttgggatattaaacttgagtaagatatgagcatatttgcatcttgaaaaatcattatgggaagatggctgggaagagaggaggagtggcagaagaaagataggttggagacaattgattgctcgatgatataaaatgttaagtaccatgaatgatgctgttaggctggaatgcgccaagcataaaggtggggcatggcatcaaaaggtaggtcaacatattaaataattccatgtattgaaatatccagaaaatatatagacagatctatagagatagaaactggtctgcccaggactaggggttgtctaaggataaggagcttcttttttggatggtgaaataacctaaaatatattgtgccattgtttgcacaactttgtgaatatattaaaaacctgttaattgtactcactaaa

SEQ ID NO: 1707 - DNA, 580 bp, Homo sapiens
gagtcagacctaggctctcgcagagaactgcatcgcgctcccagctctgctgcctcggtgcggggacggggctctgcatgaggactgggaatgtaagtcccgggcctggacaggcgcccctgggagctagcctggaggagattcagtagaaggctgaggagtcggcttggagggtctcggcaaggcggcgcggatggagatgaagctgcgaagaatgctgagaaagagcggccgggggccttggagggaagctagggaaacgctgcgggggcagccgaggccgtcggcgccccgggagaagagaccttcactgcttctatcagtcaccatatctgaatcttggcttgccactcaatcctccaatatcgaccaacaacaggagattctctctatctgaggggggaggtgtgtttccctgactagactctaaatacaaatcctccacttctccatctgtctctccagtgatctcagaggcatggtcttaacaccgcgcacagttccttgcaagttgaagagtagacccaaatgatcagttctaaaattctattcttattgaagattactggtggaaatatca

SEQ ID NO: 1708 - DNA, 7020 bp, Homo sapiens
attttaatttgccaacaaatcctaatgtggactttgtcacgttgtgaaataaagtgattttttggtatggaaatatgtgttaagacagactgttagtctttgcactttaacaactagctgatacacttacgtcacatggatgaaaacatacacaagtgcactgttgttggataaggactcctgggtggttagaagaatgtgcagatctaactactcccattaagaccattgattaaaatgaaaaatgcttataaaggtggagatctctcagttttagtcttattgcgtgccagaagcactaaggaattgctgctaaatataagacaaatggacttgaggaaatcactgatgactaacttgaaactctgcctcctgagatcacacagatgatgaagatcatgtctccaagtcttttctgccgttgccagtattctctcccaatctcctgtgggcaacttcttcgggaaaacactcatgcaatttcataaggacaagcgaaaatatgaagaagctggatcttggaactaggctttgatcacagagcggagctgagatgaaagtccatccactcattcaacaaataattgagtacttacaaaaatttctgctgtatggagcttatatagtagtgaatatcaattcttattttatggattataaaacagaactttttgcaacaattttacactaccctaggggtacctatgagtcttcatgcctcaagtaattgtcctgtccatgtgactatggaagccctgaaatctttgaaaccccagatgacccatttcaccagacgcttggacattctccgtcgagtttggatttatagtgggtacccagatttaggtcaaggacataaaatctgaaccactttaggcactgctcataaggagtaaattcctagtgaaaaagcaatgtccctcaggaatgattgctatagcaggctaaaaggtagatttataaatgtttataaaaagcagattggatttagcagaggtagcagtgatgaccaggagcaataggaggaaatgttcttaatagtgctgtttggtggcatcttctttttatacaaagaagtcttgcaagcatttctacttgaatgactaatttggagtaatttttagtttctgtatttttattagttaataggatctaggaatataataacctggtgagaatttcttcgtgaatggcaatcaaatttgtcttattcatgaaactcataaataagctataatccagcattttataactagggaaaataaaactggggtcctgctgtttaagaggctaaggcaatttaacagaacactgggggatttatagtagatttatgatgaagatacattctaactggaagcttaattgtgatttaaattataggtcaagctgagcaatgtgttttctttttagggggaaatctttagagagttagagtgtgcttgtttaaagaggaaacagaccaaatgagaaaacagattgcattttctgtttttcttttaaaatttcaagctgctttaagtcaaattgcccctgagttcctgatgatggctgtggtgaaattgccttgttttactttcttgccttcttttccagagcagttattttacctgaaaataacaaaaagatataggcagcatatcagccagaaaactaatatggaaaccagagataaagtatactcaacctgcctagaattgtgacatcctataattttaggctgagttgtataaaattagcaagtaatatggatgaaagggcctttgaaaaatttttgccactcattttgcaaatgggaaaattgaggcttctagtggttttcctaaattttttatctcaagtactttaaggtctcatgaggaaataaaatttatgtacaaataattttaattaaaagtataaaaagttgtttccctgaaaaataaaacttaaaacagataacaaaaggttgattctgtaaggaggatttctattgggaaaaggacagttagatttgacagcccagatgcttactctctaacatttccctaccccttggcagaatccttcaataattaacaccaggacaaccacatagacttcagccatgggtgtgtcaggggcatttgaaccagagcaactccatcttgaatagggtctgggcaaagtgaggctgagacccactgggctgcattcccaggaggttaggcattcttagttacaggatgagataggaggttggcacaagatacaggtcacaaagaccttactgataaaataatatggtacagaagctggccaaaacccaccaaaaccaagatggtgacgaaagtaacctctggtagtcttcactgctcattatgtgctaattataatgcattagcatgctaaaagacactcctaccagtgccatgacagtttacaaatgccatagcaatgtcaggaagttatactatatggtctaaaaagaggaggaactctcagttctgggaattgcccacctctttcctggaaaactcaggaataatacaccccttgtttagcatataatcaaataactataagtataatcagtcaagcagcctatgccactgctctgtctatggagtagccattcttctattcctttactttcctaataaacttgctttcactttactctgtggactcaccccaaattctttcttgcatgaggtccaagaaccctcacttaaagtcttgatcaggacccttttctggtaacatcttcctggtgaccacaatgagattaaactaaggagactccctacccaaaagaaatagattagatcaccaattgtatgactttgggtaagtgataggaaccattttacctggttaaaggatggaattgggttagaggcccaacttaggagagttagagcctctcctaagacagagagcttaaaggcccctcttaataaaaggcaaggacgcttgatggaacttaggttcaaggcccaaactaggaaggttagagtccttcctaagattaagggggttagaagctcctctcagtaaagtccttcttggttaaaaatggatttcacattatgggatattaaccattattctctttgtattaatctgccttgcactgtttgctgatgtctgtgggtgacaggattaggtgtatataggatcactggatatggggagcattttctccctaaaggggaaatttgagagctgatgagacaattggccacctgaactttagattcagtgttgctgcaatggatcggtcttgtctggcctccctgagctcctcattttcctcaccctgctgcaggcaatgcttttctccctttctttctttcctttctcttttctatcttttctgttactcagggcaactgtctacggtttcagtttgcccagaaaccacatgtggaaactcctggtcagaagatcattccacaccaatttgagtggatcaaagatgaaaaggcccaactagaatcatgtttgagccttcccagtttgatactgggtgctaagcagagtggctaatgtctatgttttgtcacatttattttgctctggctggtttggaagatgttaattgggttaccccatgcaatctcttgggtgacatcttgcaaaattgagaggcttttgcctatggtttcatgaaatggaaaaaggtgattttcctttgtgttgtggtttggcccctagggctatggtgccacaagacaggtcactagggctgctcagggaaagggaacccagaagcctggcatgccagcaaaagggtaagaatttcttaccattcagacttctggcctctctgtgcaaacgagttataggaatggtaaacatccctctttattcctgtgtaaagttttaattaataggaaaaagaattttcccattaagttagtcttaagctgtagtgaatttgctgtactttgtgctataaatttgtctttccagattgttctgtcagaaggagggttaccttaggatagaatacaggcttaagcccccatttggtggttaatactgagtatcaaattgattggattgaaggatgcaaagtattgttcctgggtgtgtctgtgagggtgctgccaaaggagattaacatttgagttggtggactgggagaggctgacccaccctcaatctggatgggtaccatctattcagctgccagcttggctaggataaaagcaggcagagaaatgtggaaagactaaactggctgagtcttctggcctccatgtttctcccatgctggatgcttcctggccttgaacatcagactccaagttctttagtttaggattcttggacttaaaccaatgatttgccagtggctcttgggtcttcagctacagactgaaggctgcactattagcttccctacttttcaggttttaggactgggactggcttcctggcctctcagcttgcagatggcctattgtgggacttcaccttgtaatcatgtgagacaattctcctaataaatttcccattcatttattcatctatctgctagttctgtcccttcagagaaccctgactaatacaccctataagactgctgttcaagacagcccatcaaactggtcacttacaaactttgcttcagatccctgaaacaaaacaaaacaaaacaaaaacaaaactgaagttcccctcttgtcttgttttatgttcttgggagcttgaccttataaccatgtggcagtacttcctctttgtctctgccattcagagaacaggaactttggggttcatatcatagttagccctaaaaattatattgagcagttaaaaggctttgcaagctcaaaattggctgctctagactccttctgggaagggcaatggagactgcccagtgccgtagaacaacttctgacttcctttcttgaattttcctttttctgagtacctgggaggttacctttggtaaagttcaaaagctacaagtatttgctgttttgcctggctagagtctgataatgagattttttttttttaaaagaatgctatggttaaaagtcagcttaattaaaagtggatattcaagctctaacagcctgggactccttgggaaaaacaggaggcactacagaccctgtttgaggaaaaacctctgctttcttcatgaaaacccagaaattgaaatcagatagatccctctcaaaatctaaggctctcctctgttttgcactgtgatgtctgacagtattgacttttaggggtatcagaaattactttgcattatgagagagctttggtgtgtaataactaggtaggaaatatacttttggggatggctaatggcagttatagggagatacttggcattttgcatgtttggattagagaatcatgttcttggccacctagaaagtatgaaaatgtccccattccccactgagagatgagactcctatgggagatgggttgattccctcttttttaaaatttaactttaagttctgggatacatgtgcaggatgtgcaggtttgttacataggtaagcatatgccatggaggtttgctgcacctatcaacctatcatctaggtattaaaccccacatgcattagctatttatcctgatgccctccccgacaggccccagtgtgtgttgttcccctccctgtattcatgtgttctcattgttcagctcccacttataagtgagaacatgtggtggttggttttctgttcctgtgttagtttgctgaggataatggcttccagcttcagccatgtccctgcaaaggacattatctcattcctgattccctcttttctttggggatccaggatctaatataaaaatgagacccttaattttggggctctgctttgccttccagctgtgcctgcttattaggccctggaaactgcatgctttcccagtcctgttcctccaagggctccaccctaaagccagcaatccaattaagaaacttaatggattgtaagcaaatggaaaatcttccaagtactggattttctgtctgtctgcatatttacatgtgttgtgtgtgtggtgtttatatataaaagagctctgattaattggtttaaagataataggcaattaaatcaaatattatcagaaaaataaaaacaaatgccttttacttcacgtgactttaataatctttaggaattagagacagttttaaagattattggtaaaataaagacatttggtctaaattgcgccagtcagatttaggtttgccaaatgctttaatatcataaagtgcttttttaacttgataattgttcaacttacctgctttggagccattagattccaggtaaggcatgggaacatgtggagttagccatgcccccggctatgctgaaaaaggaccttatctggacttatgtctagtgtcttaggctccacacctgatagataattaaaatccttacttaccagatttttcaccaaaaataaaagttgctcagttagcattgtaacgtttaattgagtctactgaataagcagttttacatacaaggtgtgtaaggacagtgacgtgtttttggtaaaaaattataagaaggcatgggaatacggatttttttggcctagtttagaggcttaaaaacttttttcaagctagatagaaaaaagctgaaggtttaaacaagttgtggaaggtttgtgaacaattaatcttataaaagaaattctgtgtgtgaacatattagctaaaattaaaggaggtattattcagtttttttcataaattgaacattggaataaaagcacaacagggttttcttagagcagtgatctactctttaagaaaaaattgtaaagggttataaaaggtttatgagaatcttaccttatgatctaactgattaagattggatagattagtctataaggttttttttttaagaattaggtttggcatcaatactgcattaatgcaaaggtgaaatttggctttctctgttgaacaaggttttcatgttatattaaaaaatacgaaaatgtttttgtttgccttttaaataaactat

SEQ ID NO: 1709 - DNA, 705 bp, Homo sapiens
ctggttttctttcctaagagttattgtttctggcaacgaccacactccagcaggctcaggcctgagctgatgaatgggacaacctgatgaccaccacaaagttgcgtctgctcccatccagctaatccgagggctctcagacagactgtgactaatggggacatctgagggcagaacgttcgaaggccaaggaggaacaagtccagacaaagtgtgagcacacacatctggagggctggggagcccatgtcacattcctggctggactttggactccaggaggaaggcttcaggttgggcttgctcaggctgaggcagtttgggagagtgggagtgcagggaacttgggcatctgaatgcccgggtttgaattccacatctgttgctttttggctctgagagctctggcaagttatgtagcctccctgggccttggtttctgcttctttaaaatggggttaacaatgaagattggtgtaagaatcacatataaaggtgctgtcaagaaatctggttgaaggctggacatgatggctcatgcctgtaatctcagcaccttgggaggttgaggtgggaggatcacttgaggccggggcttcaagaagagcttgggtaagactgtagccatagccatagcaagaatctgtctctatttaaaaaagaagaagaagaaaaaaggaatggaaataaattaattaaatggaa

SEQ ID NO: 1710 - DNA, 745 bp, Homo sapiens
gatctcagctccaacaccaaggcctctgtgttccctagagaagccactctggatggtctctctgaagtctgcctccttccctggccagctctacaacttagaatgcctgaatatatacaaatatgaacaagacccacaaggactgctcatcaccccagtattccatttacaacatcctgaatgaactcccgaccaggcctataattctctcttgcagccaaatatcctgcttactcctggtatctacctggtcagcagacctcatgagttatcgcccagtgacaaaaccatcccaaagatgcaccagtccagcacaaagtatgactgtcaatctcacaaaagatgtagggttctacgaggatactcagagtataagaattacgctaagtgaaataagccaagcccagaaagacacatactttattatttcatgtatctgtggaatctaaaagagtcaaattcatggcagcagggagagggctgaagaagggggagatgttgatcaaagtttctatgtatacaaagaccaaaccatcacattatgcctcataaatatatacaattattatttgctaattacaagtaaagcaatacaagaagaaaaaaaggaatcataagtaaatccatgacaagtgaaaacgcaatggagagaagggaatcaatgattgaagaagagaaaggacagtggatttacaactgcttcgaaagagtgatttgactggcaaaggactggggagaggtcctt

SEQ ID NO: 1711 - DNA, 577 bp, Homo sapiens
atgctcagcctccttactatgtgtgccctgcaccatcttgagactctgcagagagtcccactagtaagcagactctcaccagaggcagccccttgacttggacttctgaaccaccataactgtggagagtcggatgcgatccagatcttgagcccctagtgcggggaaaaaggacacataaggttcctttccaatcgtgcatgtgccgacttcagccaacactctcaaggatggcctgccttcaaataattcaacagtacttaggccgggcacagtggctcaagtggtaattccagcactttgggaggccaagaatacctatgactggagaacagatattgtggatcccattcaacagatgatgaaaccaagagtctgatggacttggtgaatgaaggatgcagacgtttggattctaagaccagtatggcttccatctcatcctgttgccagttgtcccttatacactcaaaacctcaatttataaacaggactgtcggtttcatgaaggcgtgtctctgtgatgttcattagtgccacttgtgcctaaaatgagtgaagttagggagcactacac

SEQ ID NO: 1712 - DNA, 635 bp, Homo sapiens
tgaagggtaggcctttgactctgggtggtaggacagacataggagaacagggtggggctctagaggaccaggcggggcttctgggggccaaagggaaggaccagctgctgggcaggaggggctttccggccagtggcctggggtggcttggttttgaatttccgctctgcgggccacgtcctgtacacagcctctcagccagcacgtctgcacacgtgcatggctgctgggaatgggggtcactccgactgaccatcatctccacatgtattttccattgctcagacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagaggtcgaggaccctgcacggagctgtatggagggcaagagcttcctacagaaaagtcccagcaaggagccacacttcactgacttcgaggggaagacatcattcgggatgtcagtgttcaacctcagcaatgccatcatgggcagcggcatcctgggactcgcctatgccatggccaatacgggcattatccttttcctg

SEQ ID NO: 1713 - DNA, 475 bp, Homo sapiens
cacggagtgcaatcactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaaggttggagtgcaatggcgcgatctcggctgactgcaacctccacctcctggattcaagctattctcctgcctcagcctgccgagtagctgggattacaggcgtgagccaccgcgcccggccagaacattagttttaaacttcctaacccttgggagaaggcaaaacacttgatgaaatctacataaagactaaaacattttaccaattttgcattgtttgtttgaaattgcattgacgactggtatgttaattttgtatatatttttatgagaacaatgttggacatcatttaatttt

SEQ ID NO: 1714 - DNA, 2677 bp, Homo sapiens
gtggacagcatgcccatggcctgctgggtggccagagtccttttgtcctgcggtccatataagagggtctggatctggagacactgtagaacaccaagcagctatcatgaggctatggaagtgtcgctgagagcaggaaactaaggtctcccttgaatgagagaaagatgacctcattcttaggccctgctgtgatggaattagcatgctcctgggatgtctcctagtgactgacctttggtttggatgttctgagggatctaggcaaaagtgaacagttttagcactatttcacaaaactctctgtgactatctgtatgcaaaaaatagatttaaaagtagtatttttaaaaataaaggcaagaaccttggtactgaccagaggatgggctccagtttctatttttaaatgtggcccttgttatagcctggaaaagatttaaaaaaatagttttgttttttttgtaaacacatactctacttttattaatatataggctgtctatactcttgactacacagcaatgtcttagttattaggaaccaaatattcagcttatggactacccagggctggctttggcttgatttctcccttctgcttactttaagtcttgccatttgattgcttgtagtaggctagggcaaatcaaggagaggagaaagattaaagttgtgcccaaaatggccaaaataattttgagaaagaatgaggtggagaggtggaggaacttgctttactgaatgccaaagacccttttatttttttaaataaagtaattaagacagcatgtttgtcacccggggtagacaaaaagaccagtggaacagggcagagagcccaagccttgacagatgacagaaatggccttgcgggattggtgaggaagaggtgggctagtcaataaatgggtactgggaccgctggttttccaaatggaagaaaatggatcactaccccaaatcaaacacaaatattaagctcaagaaagatttgaaggactaagtgtgaaatgcaaaacttggagcttttagatgaaaatactggaaaatatatatatatatattttttgatggagtctcactctgtcgcccagactggagtgcaagtggggtgattttggctcactgcaacctccacctcctgggttcatgtgattttcctgcctcagcctcccgagtagctgagattacaggtgcccgccaccacactcagctaatttttgcatttttagtagagatgaggtttcaccatgttggccaggctggtctcaaactcctgactgcaggtgatccacctgccttggcctcccaaagtgcggggattataggagtgagccaccatgcctgaccggaaaatacgatcttgaggtagggaagtatttcttagacaagatctagacaaagcaaaagtgaaagactgataaaatgtaactatgtgaaaacctaaaatatttgtgcaccaaaattcaccataagcaaagtagaaagacaagccacgctgaggaaagattcttgcagtgcacagaaatgagaaaggtttaacattcagaatacatgaagaattcctataaggtaatgagaaataccaaaccaaaccaaaacctctcaatagaataacactcaaaagatataaacagattattcaaagagttgaaatctgatgaaataaacatgcttaatctcattaacaaccagaaatacaaactaaaacctcaatgagggggatctgtgaaaatgtgcagctgttactcagggccattttcatagcagcatcctgcagaagtagattggtggtgtctcccttcctcccttaacctcctgcctaaggtcccagaattgcatcataacatctattgaggaatttcagatgatgaaggtactgatggaacacatcctatttattcatggagacagtgcagcaaggactgcaactagagggtcatttaagttacaaggctacgtgactccataatagaaaattgagaaaagcatactattcatttctggtaaggttccaagccaggctcgtcaagctattacttgtattttgtacttacatgaaatgaaaaagctaaagaaaggtaaattttaaaaaattgctctaatgctgaggatctgaaatcactactcttctttatacacattatccaatgccagattacgtccacgggggagaaattactcagaaacttgaaaattgtgcttctgttttcatgtcaattctcaaggctgatactaagagaaaaggtgacttcggaagccttactacgtggaagcgtgaaatgtgataaatctttcaagaaatacaagtacgctttcatttaccaaccattacaaggcaggcagaaatgactaacttgggggaattgaaggaataaaccaaaacgtaattcatcagacaggcttcccctacagaaacacagtcaggggtagtgggtggtttttctgagccacccagataccagcctcatcctggctggacccacgtctttgtccacattcgccacttcctgaagcagctgtctgctgaacaccagcaacacgccaaccctgtggctacttcggggatggagtggagaatgggcagaagtgagccttgctctcagggggcttctaatggagtagcggagaaagatatttttaaaatacataaataaacgtgtcaacaacttgt

SEQ ID NO: 1715 - DNA, 7092 bp, Homo sapiens
atcagcctcctgagagctgggactacaggcgcctgccaccacatccggttaatttttgtatttttagtagagatggggttttgccatgttggccaggctggtcttgaactcctgagctcaggtgatctgcccacctcggcctcccaaagttctgggattacaggcgtgagccatggtgcccagcctggctcctgttttttgagacagggtttcaccctgtttcccaggttggagtatagtggtgccgtcatgacttactgcagccttgaactctttggctcaagcagtcctccccactcagcctctctagtagctggggctccaggcatgaatcaccgtgccagactaagtttttttaaaattttttgtagagagaatctctctctgttgcacaggctattcttgaactcctaggctcaagtgatcctcctgcttcagcctccgaaagtgctgggattacagttgtgagtcactgtgcctggctcttttaatcttgaaaactctgggaagagctcacttctgtttaggaggctgccttgggaactgcatctcctgggctggtgctctgtgctgcttggagtctgcagaccctatctgggtcgcttggcctcccgtgcacaagctgccagaatggaggccccattctcaatgtgggggctgcccaaagagcagggagcttcccacaggacagaggctgggcacctgcttggcctggttcttccttttcccagggctccaacacccaccccctcaggtcctcccaaaccctgcaggtccctggcctggtccgtccacacctacactcaggaatctctacacatctctgagttgctgcatctgtcttcaggcacagcccaccagcccccctgggtacccaaagacaccgcaaatatcagccattccagacaacgtcctcctcccgtgtccctatctcatggagtaatgcctctaattcagccacaccaagaccccacgctccacatcccctagaactctcatctcctgtggcccaacatggcccttcctttcagcagtgggatgtgggaaggatcaaggtcacccttgtccaaatcccatgcagacaacggtgttggagtcttgggcccaaagaccagctcctagaacctgcagggaagcaacggcacgttccatctctccccatgccactgaggaatcattggtggcaggattctcagcaggcatggccgtgggtgcacagaacagagaaaggatggcctggaccacacacatcactgtgtgcagatgctttcctagacactgcagccaaggacacagaggctcagagagaataacctccatctcctgggtcccagcgattctcctgcctcagcctcttcctatttcacaagtagggaaactgaagcccaggtaggcaagcctgacttgctggagtcacacaggaagttggcagctctgctccatccctgggatctggagcccctgctctggggaaggagaggtggggcgctgccttcccagagtcccctcaagctggcagggacggctgtacccccagggtcagaggagaactaaaaggagcggaagctggcctgggtccagggagagacctcgtgtttgcccaaaagggagctggagaggggcagctgggcccatatgcagggaggagctgcagggagctggtggcggggcagcaaagagaagtggatttggtgggtagaggggcccctccttggttctagtcctccccgcagccccttgcaaacaggcggggctctcctgtccttcttgtctcctgcagcaagccctacatgaagaggcctctttggtgagtggcagctcaacctctgctaaatgcctccagtgatggggagttcactaccttccaaagtttttaaaagatgttaaccactgctattcaagaacaattctagaatttttttttttttgaaagacaaggtctcattctgtctcgcaggccagagtgcagtggtgtgatcatagctcactgcagctttgacttcctgggctcaagcaatcctccctcctcagcctcctgagtacctgagactacagatgtgcaccaccacactggctcattgttttcattttttgtagagacaggatctcactatgttgcccaggctggtctcctggcttcaagcaatcctcctgccttggcctcccaaagtgctgggattacaggcgtgagccactgcatctggccttttttttttggagatagagtctcgctctgtcgcccagggtggagtgcagtggcgtgatctcggctcattgcaacctccgccttccgggttcacaccattctcctgcctcagcctcccgagtagctgggattacaggcatctgccaaccatgcctggctaatttttgtattttttggtggagacagggtctcaccatgttggctaggctggtttcgaactcccgacctcaggtgatctacccgcctcagcctcccaaagtcctgggattacaggctgagccaccgcgaccggccctgctgttgcttctgaggtttgaaaaccgctgcctcaatgctcctgattcagctcttcttacccaaaggttcccccacctcatctactctgttcctgcacagtcgcccttttctctgatgccccgggcaggtttctctctgccagctccacgcttctggagtcccccatccgtcttggggcccagctgcccactgtctgggttcagaccttctcaacactccctggcttctctgccctagttttgccttctccaatccactcttggtgggtggaagtacggttaccatggtaacttgaagacaacgcaaatctgattgtatcattacaatgactgggaaaacctccagtgccacaaaataaagctcaagtcactagctttgcagtccaggccctttaccattccggcagcatttctgggggctattctccttccccccactgcacaaccccgcctggccaccccaggctcaggctgcagaacagcgtagaccagggagtggctttggggtcatgctaactacctggtttttgtctctttcaggctgtttgctcagttgcaaaatgggaaggacaacagcacccgcctcacaggctaagaggctgtgtgtgaaaagcccgcagcacaggatctggcacgcgtggacgtgcgggatgggaggaggggatttcccagctcctcatctctgcagggactggccttggcctagggaacactagctgtccagggagggggagctttccctgagccccccgatgtgtggcaggcagaggagagcaagctacttctgggaggggagttgtggggaagggcaagttagtctttactgagggtggcagtgagctggcactttggtctcacctcggctgcagaaacccaccctgctcccgtcttatttcctggggatttcagctgtgtgcaggcacagatgcatctcccaagtgcctcatgcttgccttgatctcctctccttcctctggccagtcctgaacctcttggtgatccacggcggcacctctgtgtcctacatccttctctggccatctccttccctccttccagccctccctctaggaccctgaccccaaccatccttcatccccatggggacattcagtccactgactcatcaccctcccctgtccctctgtgagagaaggagcaggcagagaggatcttgcaagagccttcagcaactctcttccacccatcctgttgcttgctgctttttttttttttttttccaaaaaaatagagatggggtcttgctatgtggctggtctcaaactcctgggctcaagtgatcctcctgcctcggcctcccaaagtgctggattacaggcgtgagccaccacacccggctccgttccctttctaagcagggtgctccttttcttgccatttcccccatcctccttcctctcccacagctcacttccctctctactgaatctgctgaagatcatgcagctgctgttcctgcctctaaaaccctctcttggctgggtgtggtgggtgacatatgtaatcccagcactttgggaggctgaggcaggagaatcacttgaacccgggaggcggaggttgcagtgagccgagattgcgccactgcactccagcctaggtgatagagcaagactctgtcccctccctccaccaaaaaaataaagccctctctgcatccattccactctccactcttgctcattctctcctgccctctaaaaggtgatctgtctttggcagattcaatcacttgcctttctcattctctcctgagcccactattccactctggtccccaccacttcccccaaaactgctttgaaccatcgcactgcaacctgttgcttagcccctccatctagtctcaggcgttaggactgactgcccagcagaggctggtgcaaccaatcacctcctttagtaagtttctccctgggcttcacctcttcacctgtgggctttccacctgtctctctcttttttttttaagacagtctcctctgttgccaggctggaatgccgtggcgcaatctcagctcactgcaacctctacctcctgggttcaagcgattctcctgcctcaggctcccaagtagctgggattacaggtgcccgccaccacaccgggctaatttttgtatttttagtagagtcggggtttcaccatgttgcccaggctggtctcgaactcctgaccttacgtgatccacccgcctcagcctcccaaagtgctgggattacaggcgtgagccaccgcacctggcagtctccctaatttaattcagtgccactgcgggcaggtggggtgtggcctggttgggcagtatagagctaccagctaccaatggtgttcagccctcagggtcgagcgtgggttgtctcagccccttgcaggcagggctggagttccttctggtgcgagttgggggacccagctcccccatccctctgcaaccccaggccccccaccaggtcccctctggttcagcctggtgccttccagcacccctggcccccagaaatccctggtccacagctcccttgacctgaggcctgaaattgacccactgccccctgaggcttggtccaagtccaagtatgccttcctctccagccagatgcctgcctgccactcagcatgtcagagcaggcagggcctctagattttaatggggaaactgaggcactgagggcagatgtgatgtccccagttgggaaaacattaaagacattctgggcttctctctcttttttttagagacaagatctcactctgtcatgcacgctggaatcatggctcattgcagcctccaactcctaggctcaagggatccttccacctcagcctcccgagtagctgggagtacaggtgttcgtccccaccatgtctggctaatttaaaaaaatgtctttgcaggatgggatcttgctatgtttcccaggctggtctcaaactcctgggctcaagtgattttcccatcttggcctcccaaaatactgggattatacgtataagccaccacgtctggcctgagtcatctcttttgacccagaacaaaaccagtccaggagtggctgtactccccaggagtgtacactggggaggcccacagctccggggtgcagtggggctcttgcaatttaatgactgattcatcttcaaaaaagcacaatctcagccaggcgtggtggctcatgcctgtaatcccagcactttgggaggttgaggcgggctgatcacctgaggtcagaagtttgagatcagcctggccaacagggtgaaaccctgtctctactaaaaatacaaaaattagccaggtgtcgtggtgcacacccgtaattccagctacttgggaggctgaggcagacgaatcacttgaactcgggaggtggagatcgcagtgagccaagatcgtgccattgcactccagcctgggcaacaagaagcgaaactccatcttaaaacaaacaaaacaaaacaaaaacaaaaaagcataatctctttcagaatttttaccttcttggtgtggttctgttaggaaaggcttccatgggaaccttcaataagtgacctaaaaaaaaatctcagagcaattcctttttttttttttttttttttcagacagcatcatgctctgtcacccaggctggagtgcagttgcacaatctcagctcactgcaacctccacctcctgggctcaagccttcctcctgctttggcctcctgagtagctgagactacaggtgcatgccaccgtgcccggctaatttttaaattttttgtagaaacggggtcttgttatgttgcccaggctgacctcaaactcttggcctcaagcgatcctcctaccttgtcctcccaaagtgctgggattacaggggtgaaccactgttcctggtttagagccattctttttttttttttttttttttttgctttgtggttttgagacggagtttcactcttgttgcccaggctggagtgcaacggcatgatctcggctcactgcaacctccgacttccagtttcaagcgattctcctgcctcagcctcccgagtagctgggattacaggcatccgccatcatgcccagctaatttttttgtatttttagtagagacggggtttcaccatgttgggcaggccggtctcgaactcctgatctcgtgatctgcccgcctcggcctcccaaagtgctgggattataggcatgagctaccacgtccggccctagagccattcttaacagggtttgtctccctggaaacttcccgaagcctcaccctcccaggaattccctgctaagtgccacagtcatctcttcaccactcggtttccactctcccatccttgcaccgagatcccactgttaggcctttttcaagcacagaccttctcatgctcagtctctctgtggtgtggaagtgtctactgggtgggcctcacagaaggttccaggccctggtacaagcccaagggaaatgatgatccaaaatggactccgataaagtttctgccactctgcattgggggcttttggtaggagtccagttcaattttataaaaataaaaatacatgtctcgca

SEQ ID NO: 1716 - DNA, 597 bp, Homo sapiens
acctcgggggtttcctgctttatggcgaaggcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgcgggagccgcctaggaccggaggcgcgacccctcggcccaccttgaggcccggcctaggaccggaggcgcgacccctgggcccaccttgaggcccggcctaggactggaggcgcgacccctcggcccaccttacgggagccgcctagggccggaggcgcgacccctcggcccagcttgaggcccggcctaggaccggaggcgcgacccctcggcccaccttgaggcccggcctaggactggaggcgcgacccctcggcccaccttgaggcccggccta

SEQ ID NO: 1717 - DNA, 789 bp, Homo sapiens
ctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggccgcgcgagccgcgggatgggggcccgggccgcggaggaggcgccgctggtgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgca

SEQ ID NO: 1718 - DNA, 446 bp, Homo sapiens
attttcataaaggtcaactaagaaatgtgacaaggtttgtgaactataaagcactaaacataactgtgcatccctacattttaggagttacaaaacaaagaaaaacagttaacaccactccaccaaatgaatagaggaaatttagtaaagatgtcaacctctctgtattggaagaagctccttgttgcttgtcttgaccctgcctcccatcgctgaggagtctagttcacctctaagccaagtaggatgagagtatatttggtgtctgagctcatttttgaatctacttcatttgtgttaccacacattattcattccccctgttcaactatctactaagacatttaaactggccaagaaacatctatctagcaaaattttggctgagagtgttcctccaaatagaataatctatttctaaattaaaccagattagcaaaaatgtg

SEQ ID NO: 1719 - DNA, 443 bp, Homo sapiens
gggctacaagccgtcgctgggggcggggcttgcggcccacctgtaggtcccggtgccacctcgtcagtgtcccgagagatccccagaagaacgagagggctgaacaggggaccccactgacgtccggtctctatgaagtcagagctattactatcagcattttacccatgaagaaaccgaggtttagagagattcttttccaggaactggatagccagcaagatgtgaagcaggatgaagaaactaagactcagagaagacaaatgacatgcccaaagacacattgataagaacgcatctggtagtggtgttcgagtccagcgttgcagcagagagatgggtaactgtatggccgaacagctgtcttctcgtggaagaaggaggccaatgtccaggagtggcaggcatactggaacttggacttctgtaggccaacctgggtt

SEQ ID NO: 1720 - DNA, 564 bp, Homo sapiens
agtgtggaaattcttactcagaacacaaaggattgaagagtgcttggaggctgaactctggaaggactcttccctgaggcctcttggcatctggctcttgtttcttggagcggtggtatggcccacagtggaagaccacagcatgatgcatgaatttacatttcctcagacattctggtgctgatgaaggtaaagatggtgaggctgcgatgatggtttcagggatgggtgtgttgggcgtgatgaatagcatgatgcatattgtcactcatttagtttatctgcactgatgatgatgctgattatatgatgactgttacagggatggtcacattgtgggtgatgaatatgaccagaaagggaagactttcacagttcctacccgaactacaacatcgatattttcatttgtctttcctaggaactcttaccttaatcacctgaccaatatgctgacgactaacatgttgcgccctgcctttcttccgggcctctctgccttgctgatctgttttgctggtgtgccctccactgtgctcttgggtctttgtctctcggtaaagc

SEQ ID NO: 1721 - DNA, 521 bp, Homo sapiens
gctgccaggcggcgagaacgcgctgggggaacccttggtccgctctgcgcgtcgctctaggatccccgaaaaggagcacgggcgcgaaagcggccaggctgggccaggatctagaaagactgcctggcgcaggctccctgcccccgcgggcctgctgtcatggactcgtggagagctcgcttcccgcgcggacccttcctgcaggggtccacgtccaggcaccggcggctcggacaccccacccccggccgggcacctgccctgggtgccccttaacccgggcggtagctcgttaagatggcgaagtgtccggtccggaacacgcgaaaccccaaatcccgcctgcccgacctcctgacccccggccccacgggacgacagactgggcctcccgacgcgcagcgcgctgccgggacaccggtgcgtgcgaaacggaggacctttgtaacgccacgtgtttgctctttttgaaaaaacaagaataaatgtgttaaactgtctgaaaagcttgccgcctaaaa

SEQ ID NO: 1722 - DNA, 1428 bp, Homo sapiens
ctattttaaagttaccagttcagaaaaagctggttctagcacgtaggtctgatagaccatattctaaaggtcagctaaaaaggactttcaaaccagggcaagtaagattgtccgtagcattttggggccagaatggctttagtctctgagttgccacagggtaaggtaagaactatgagcaggtccttccaactcatgattcctaagttccagaaaagttaacaggccacagcttacattgggagctgaagattatctgggtcagttggctgtctttggtatttggctcgactttatgatatatgatgggaataatcagcttctgaatgccagtaaggttggggaagtgctgagaggagggactaggcagatttattaccaagtggttaatttttcatctctctggcctctgtataagtatgcagataagttacatgtaattcttctctacaaaactctccatcagttagtggtagagcctgttaaagtagcagcttggtattatgaatctgctaggctcttaaacacttacggacttctaggtatgaatgtagctggtataagctggcacctgtacatattccatttagtttgtaccgatacctctgtaagttcttcagcccctctgccctgtcccctacctttgattcatcaaatgcttataatttttgtttggagactactgcgtgcatgcctctattgctcttccttggctcttattatttggtcctactcctaactcacctgataactccaacttttggtagattttgttcctgtctcttatagtgtcccaacttggtttcttcctaccaaacaaaaagacacgggaagtatctgtagtagaatgtttctggtatccagttggcaaatggaaactgaggttggccccaactgttcttagaccacctttaggttttgttgatcttaatgaaatacacagcattgcatttcattccttttcatttaaactataaaattatatcaaatgatgcctacattaagattctccctataagactgccattccagatggcaaaaggtgaatagtcataatagaaaccaattcttaagcacatgtgtggtattcccttgaccacaccctgggccatggtatctgttaatatgaaagcacatggggaaccacagaggagaatggcctaggtggtggctgctgtttgctgaggtgtgctgcttactcaagcaggagggcacctctgactgcttgggatctccttttttttttttctttttttagacagagttttgctcttgtcactcaggctggagtgcaattttgtagtcttggctcacctcaacctctacctcccaggagaatcgcttgaacccaggaggcagaggttgcagtgagccgagttcacaccactgcaccactccagcctgggcgacaagagtgagactccatct

SEQ ID NO: 1723 - DNA, 2917 bp, Homo sapiens
gtagatcctaatgttgctctccctggagctgggctgcaggaagtctgggcccccggctcgcactcccggaccccgcaccaacctccagggtcgctctccaatcttaaccaggtttgctccctgagcgtacccaggtgctacagcatcagcttcccttgccgcttcctgcggctgaagggatggtccgaccaaagcctcctgccctggggcagccgatgccactgcatgctttttcctgcgcttgggcttcacggtgccacggatattggccggcttgctgcgcttggagcgtagggtaatgtacaccacattgggctgcagagtggacccattgccctgggactctggaggggccagggtaccatccaggggtatctcagggaaggatggctcggcggtgtcgcggctgcgatgtggccccttctcagccgcctgtccatgctggagagaggccctccccacctggctcaccaggaagcccaagtagatggcacacgcagtgcccagcagaaggtttctccgggtccttggacgccggctgctccagagcttacgcacccgcgggacgcacagggagcagatgaaccagtttatgagctgccccggcttgtctggacaggtcatttctctgccgcatccacatgttgaacggagtttaaagtctgcagttggctcctgctaatgtgatgcatggtttcctgacttcagctgccgcgtccgcttcgggattcagctgaaagaaaataaaagcatctctagttctgttttttcactattaaaaagaaaaagaagaaactcgtaagcaaccttacttacacagctggccccatgcttggctccaggaagaatgtaatccttgactctaatgcaaagaacttttaaaggctgaggcatgaaatgaccagtgctttggttaagaatgcacattatactgcagttctttggggaatgaagccacccttgactgaggtattatgccaactctcaccctgtgaatccactgactggggaacattgtttaagaaaatcacatggctgtgccaacaagcaaggagacacggcacagaagacagaggcagaagcagctttattgaaaaacagagcatgagtagaacgacttcaaatcccatatggcaccacagtgagaagtaacttcctctgagcttcttagagaatccaacaatgtcctgcttccttggggagctgcagccatgggcacatgggaatagggcttccaccaagagtcccgtcagtcacagcaacaggaggtcttcctcagacaactttgatgatagtggttgttagccagagcaagctagaaccagaaagaaaaactatgaagatgccacagtgggagtctgagcaccttgaggcctcctgttggaaactggcaaacctaactgtgggacacttggatgctgagttctggtaaacatgctgtcggaggcacgcctctaggatggacccccatgatccccacctcctggtatccgcgccatgatgcaatctgcttacagcctaaatcaggatgaaccatatgactcatagaacactgcagaaggcatgatgtgtgacttcagatgtgaagtcatagaggacaaggacacagccaccttcttggatttctcactctgtggaagggcagtgacattccatgagacaagcagtcctgtggtgaggcccatgtcaagaaggcctgagatctcccaccatcagctacagccaatttgtcagtcacgtgagtaaaccacctgggacgtgaatcctctcgacttaaccacctcttcaggtggccagagccctagcccaggtctgactgcaacctgatgagaaaccctgagtaggaagacctgcttgagctgctcccaaattattgatccacagacactatgagagataatacgtacttagtgttcttttaacccactacattttggttggctgtatttattaccctgtaacagatgactaatacatctcctgtgatcaaaacacttcagaggttccccatttctctcagagaaatatccaaagtccataaggcctgtgaggcccctcacattcttcccacccccattacctctctaactccattttctaccactctccttctttccacctcaaccacagctacagtgacttctttgccctttctcaaatctgcctcagggcctctgtactggacactctctccccactcccactccctcctccaggccttcactgaaatgtctccctctcagtgaggacttcctttcctaaactgcagtacccccaacctacacacacacacacacacacacacacacacacacacagagtctctagtcttcctagctccttaatttttttttccttagcacatatcactatttcatataccatatttgtcatctattttctggtttccctttctcagatgtaagctaagttggtgcaggggtttttgtctgttcccaatgtctagaagagtgtctgatttacagtagacactccatgaaatttgtcaaatgaatacaccagtgttaagagtataagagtgtaatagtacctttaaaaatgcctcaaagataaatcttttgatttatctttatttttagatctctacccccactttagccacttctgaaatttactactagaaaaaccttttctttcgtgaagaactgtctcacaaaaatagcagttaaataggaagctatcctaacccactgtttgccttttcccttgtgaaactcagaccaaaattgaaagtcatctattgtaactatgtgttcttggcatctaaactctgttttgtttcatcttgactttcttaatttcctaggttttttcctttgttcctattattttattgtttttattctatattgcttcaaagactttatgaaattaagtaaattataaatacaaatat

SEQ ID NO: 1724 - DNA, 501 bp, Homo sapiens
atctacatatatatgttgagagatgctgctttttggccaaaatgaatcttgaattgggggtgtgcagaaaaagttatatctggcctgaggctggtatcttttagagtggcctacttgcatggttggcccttatctgaacacgtggatttaggggtattctcactgttcactaataaaggtggttcactgtacctagactgttcaaacaagatgatttatgctaaacacctgctttccttctgggagtatggaattttggtacatgccaggtaaaggatgtctatatgaccaaactcccaatgaaaaccttgcatactgagtccctaggcagaaacatccctcgtataaaaatgtgctctgtgtgaatcttcatgggagggagagatcctaaagaagcctgcacatggattcctccagattctgcttatgtctttttcctgtatgatccaactgtgtacacttactgtgtcactgtaataaactttagccatgagtacgata

SEQ ID NO: 1725 - DNA, 553 bp, Homo sapiens
atcttgtggttaatggagacagatggtcttcccttgatagatgcttctggaaagttaacattccagcagtgacggttacattcctgtcaggcaggacttcaggaagagaggaactccgcaccgtttgatcaggattcccaggtgtgactttgcaggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgagctacctcttgtgtttaagaattaaaggaagatgagctaggaatcaagaaatacgcagaactgattcctgtcactggcgccaccctgccacttgc

SEQ ID NO: 1726 - DNA, 1504 bp, Homo sapiens
ctgcaagccaaggagagaaatttcagaaggaaccaaccctaccgacatcttgatcttggactttaagctgccagaccttttatacattttctacagaaaatgcaccccatcattgcttatagcccacccacgtggactgctcattctgtgaatcatgttttacagatttgtttatgtggcattcctcgtttgaataaagcagaaccaaatgtcttggtttgaagattgagatgaaatgggagggccacaaatagtaatttatctttgagcatcgtatagataaacatgtaacctgatactaaacaaaagtaaatgctcatggactgtcagtgatgtggtgggatatgccagagggaagtgatttgtggactcactggagagagacttctactagaaaaattgccttgatgttaggaattaaaaaaacaaaacaaaacaaaaaacatggagccgtattctccagaagcttacatctgatttaacgagacaggtaagtacaatttcaacataatgcattaagtgctatgagagtagtatgatggtgataggtgctatacaagacaagggttctaggttaattgctttgagaaaattgccaccctttaacaaggttaaactggattctttaacgtcaaccttactgagagtttctaatatgtcactgtgctttgtgaatcttcatgtgtgtggagtagagatccagtctgccaagttctgcaaactcatctgacaacagaactctttttcaatggaatatctcaaggcatttgtgctccacgagacataagatgagaagggctgacacaagattctcacctagtgaaaaaaaaatatgtatttatatttttaaaaactggttggatgggggctttctcccaaatacataaatgactttgaagttttttttttcagtcctatgacagagtaaagatgcagacttaaaaggatttaccatgaagattttaatgactgctgggctgattattaagcctgatcccagtgaaatggaatgcctttagtcattttcatttatggactgtttaacgatttttctccaaaagaaatatttaatgaacacaatatcgagttcctcccagtgcttctaattaacagaccactgaacgatctttgttaaaggaaaggctagcttcaggccagaaggcgttgcaggatctaatatgtatgctaccatgggtgaccaagcataaagataaactaaggatttgaatatataagggctaatgtttgtgtccattgttatggaatttctgacaatcactctctagtctttcctaatatttggcctttaggaaaagtgttttggactgaattgttctctctcctcattatcctccttaatgtgtgaaagtctcaatgtaactgttgattacctgctctctatttcataaagaggaaaaacagatccagaggaccatttcatgattcatcctttttcaaaacgtttcttaaaacattaaataaagttttattattgtaaactgtt

SEQ ID NO: 1727 - DNA, 495 bp, Homo sapiens
tcatcagcagcacagtgcttcctttcctctgaatctgccatcagctcaggcagatttctaagcagcaaatcagcctttgccagaacactgcaggacaccagtgcagcgcccagcctgcgaccatgagctcgcctgcacccaggtgattaaaaagctttattgctcacacaaagcctgtttggtggtctcttcacatggacgcgagtgacatttggtgccgtgactcggatcggggaacctcccttgggagatcaatcccctgtcctcctgctctttgttccaagagaaagatccacctacgacctctgctcctcagaccaaccagcccaaggaacatctcaccaattttaaatcgggctctaggggatggtagagtcacaggatggaagaactctgtgtccttgaatcattgcatggaagagaactggaagttgcccaggaacaccagccttggacagttatgtgaacaagaaataaacttcttttacagtgtca

SEQ ID NO: 1728 - DNA, 1742 bp, Homo sapiens
gctgcataaggggagtgaacacaaagtacatttgaccacaaaatgactctttaaaagtcagaactacggtagcatgaagccaaacgagggttccacagaagtctccaatcttcaaatcttcagtgtatgaaagcacagattcctgaaagaatggcctcaaatgaccaggagtaggagctctctatatccctgctcctgaaaaacaagctaactggagtctccatcacctgccaccagctatacacactaccaactacccaactgaactccatgactgatttgccagctaatcatgcccctgacccagcccacatggacatgggaaggacatcagtgaaccgtgaaaagaggcagaggctcactcccgtttgtattattaaaacacacgccaataggacataaaaagaagcaagagtactgggctttaccatgagttcaaatctcatttctgccaattcctatgtctaaaaaaaaaagcttcctaatctctttgagcctcacattctctatctagagaatcacttgaccagaatgttcaatgcagataaaaatactagaaggtattttaattcattccaagattccttaaaattctgtaattctatgtcctcttgattctgtctatagaaaaacttggaatacataggcagcagagtttgaaaaaaataatagaacaaaagaaacaccaagaaaaacagagaagaaagttttaaaaaatgaagacaagattatataaaagtcatggaaaaagcaacaagactaaaaaatgtattatggaagtaagcagaaatacttgcctaaatggaaaaccaaactgggaagtcaaataatttgtctctaagacttgcctaaacttgctttggtaaaacttacagtcctatggccaaagctaagtcagatctgccctagagcctttgaaggtaaaaataagatactggttaccactgaaatcgtcaaatttattaggactaaccacattctaacaataaacttaaatgagagttcaaggtatttaaactctcattaatttagaagttaatcaaattaatgaatccgattgatctgattcagacctatactttgatccaaggactgcacagatatctatcaatctatgctgaggagcaagagaaaggatttggaaggcaggtaggctgatggtcaaactgtaggccagctactttgttaactatgggatcatgaggcaattaatcagctctaatccatagttgtttatttaacagtaggttataggaacacagatgttatgatggctttatgagatgataaatgcatagaacatattaggatgtctagcccagaatacaacactcaacagatattagtttcttccatctatattttcttagttaacataattttttaaatctatgaaatcttacctgactgcagattcatcaggaattccaacatctattaaagaaaaaggtaaaatgcattttaaatcaataataaatgtacagaatattaaaatcataagaatgcacagtgatgcatgcctctaatccaaactacttgagaggatgaggcaggaggatcacttgaggagctcagaagtttgagaccagcttgggaaacataataagactctaccttcataaaaaaattgtgcacacttgtgtgtatgctttacatcctgtttgttgttgttgttgttgttgttgttgttttggtttggtttggttttttaaagcataagactgacgctttgttacaaagca

SEQ ID NO: 1729 - DNA, 630 bp, Homo sapiens
tttttgttttttttttttagtttaaacttgattttgtgaggggacgaacagcgtgacaattaaaagaagatctgggaatcaaaagcttcctgaggccttcaccagaagcagatgctggtgccgtgcttctacagcctgcagaactgaaggactttacagcttctctttcgcatatccaaattgccagcatcaccgctcttgcactccaagccattattaagtaaagtaaagaacacaaacactgtgatactgctacacttgatctgataaccaagaagtctactaagtgactaacagcagagcaactgggaacctaattctgaccaaaaaggaggaattgtttggctaattggaagtgacagaaaccttgggagaaagcaaccgcataccaaggataattataagaagaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactgtaagagaataaatttctattgttttaagccttca

SEQ ID NO: 1730 - DNA, 494 bp, Homo sapiens
gggaaggaataagcctggaagaaaaagatacaacgaactagcacaacgaggagtttgaaaagttcatgacagctcacagctgatgatggtggcaatcttaaggatacagaaagctcattcctcatgcagggaagaagaaaatattctaaagaagagataagcatattccatgaaatcaaaaaagcgtaaaacgctggaggagaagtcagtagcaagcagctaagacaacatggtacatgtggctagaagcccaccaactgctaacaaccagctggagggcctccccggaagctgagcagatgccagcaccataattccagtacagcctatcaaactgcctaggtgctctctgatggtgggaatccactaataagaggtgtccagttcttctagcaaacttgtcagtgctcatgtcttccatgggttgtgccctgaatcaatgcatttattaattctttcaaaatgcaaaataaaaattatgtgttgagcctcta

SEQ ID NO: 1731 - DNA, 516 bp, Homo sapiens
cttactgaaacctccatctcccaggttcaagcgattctcatgcctcagccacttgagtagctgggactacaggatttcgccatgttccccaggctggtctcaaactcctgaactcaggcagcccgcctaccttggcctcccaaagtgctaggattacagcccaaatgaccctccaagaccctctggaggcacccgcagtgctccttaatttgcagctctacagaatgagaccagcgtggcagccccctttcaggacagctcccgagacgagacgcgagagcagcccctaaatctcacccagcaaagccgtttcttcctaaccgggctggggagtgccgcgcgctgccagcagatggcgacagaggattagcctgcggaaaccgggtaaggggagggcggagctgaggtgagaacccacatccctcatgcccagtggcagcaggacgtggaaatggtttgcccagccctcacttctcttggacagagcttgagccttctgggaaactgcttttccct

SEQ ID NO: 1732 - DNA, 670 bp, Homo sapiens
gtttctcaaaccgtgccttcccatttatgctgcatccgcgccctgaatctgaaattggtcgtcctgccacgccgcctcaccgcggtataaggtcgtcccatcctgaatggccggtgcgcagactcaattgcgactttgaggctgtcagccgccacccggcaaccttccagtgaacaggattctgggtttctcaaagctgtaattggagggccactccagaggtgttaaagctccagcacttcgagcctgcctcgtgggaaagtcttaggctgagtctgtaggtgtctgcagttaagaagccagcggtctgcatatgattgctcaggggtggtggctgggtccaacagcattcactacaggcctgccttgaataccacctagcgcagtgctccgcatatcacaggtattggaacatctctagaaaagattgccttgtcttatgaaaatggctttttaaaaaaatcctaattccaactggtcatcctagcaactgatacaataactgacctcaaaatgtttcccaatgattcctacctcctactattcacactcttatgtagttccctcccacattgtaccagggttggactgtgagactaatagaatgcagtagcagtgatagatgtcactgctgagattaaatataataaatggcaccttgagttctgtc

SEQ ID NO: 1733 - DNA, 3779 bp, Homo sapiens
acatccaagtatgacaagttagtgggaccaatctggggagggaagcatcaggagaacaggacagacccacagaactgggcccacctaccctttctttgggtgtgccccggggcagcctccttgctcctgccttgctgacactgcctgctcccttccttccaacctcctagggggacgggctcagcatttctgttgttaggggcgggagctttgtcctcacggcctggccaaaatggagcctgcaataggtgcttatacttataaagacccgctagattcagtgcagctgttagcaagtgctggtcccaacagacccctcccagtgggcagaggcagggcctccaggagagagcagcatccatccctaaaacaaaccacctggcttcctcttacttctcctcccagcctctgtccagtcccccaaactcggacacggtctctcgcctgggcttccgctgcctccctgcctctcacccctccaccctaccctccatctccataggtctggaaggaacttggagagccacagagctgacgtccagtcacctattgaaagcagcccttatcggcacccttcccttctttccatcctaaggcccgcacctgacccctgcacctcaggaccaggctctgcagcctccctgagcccctgtccgacccctgctcccaggactgtttgtatctgttgtcatgagacaggaggaggatgtgctatttcccaccacccttgtcttgctggcccctctgcctggaatggccttcctctgcccagtggcaaacagactttcaaggttcagttccagtgtccccgctgcaatcccccaaacagagtgagcggttccttccatctacttccaagaactggaaagttcctgtcttgtcgcgcgcactgtgggaccacagcattggttcccacccagctgtgcgttcctgcagggtcaggcatgtgctgggtccacgttggcacagagcaggggccagcaggtgcttgctgtgaataggaacgtttagcagaacccgggagaggagacagtgttaccacacttgctctccactttgcctgcgggtgcctttaagaagcacagatttctaaaccttgccaagccgatccgctgaacacctctacattcccggctgccttgttggctccctgggacacggcagctgtcctgtgtccgtaaacagataatagctcctccgactctaggtgtctctccatggccctttgtggccaggcctgggctgcgtacccatgggcaccccctcccattcaatctcacagacaggacaccaggctgggcagtcctcaccaacacccctccagccggctagccagcctcctttcaactctgcattgccctgagtttgtgtggggttgttgagttcccagcaggtcctccggatgtgcatgtaggtagtcaggggaatggagtgggaggataggagcccagacacttgaaatggtgttccatgcctttctagaccccaggccctttcctgcatgattttatcagcacatgctcaatccttcacagtttacaaagcacttctagatccatccaacccaccaaggatgaggatcactggcactctgttttcccaggcagggaagtggcttccaggaggcttagtgactgaccaaggtctcgaggtctcgtgctggtgaagtgcagagccaggatccacctgagccccccggctggctccagatcccacactccttcctcggcacttcctcggttctgcacggtgcctcagcactccccaaaacatcccattttgcaggtgtggaaacccacgtcccgcagaggctgggtgtttgctccactcagttctggggacttagcttgaggctctctgatctgttctcctgctgagcaccccaggaagggctccaggtctcccagccacttagtgagagtggcaagtcctgtctcacttgatctttgggagcataagacgagatcacagaaaatgtcatcaatgtgaaagtgttttgtaaacgaaggcgctgctcaaacgtagtgttatcttcagcctggctactggcttcctacaaagtgtgaagggatgaaggtaaaagctctttcttgaataatgttatccatcaagacagatgaaaccacactggtcagctcctcctgccctccccccaacgccccacctccccttcattcccacatgtttaaagacattcgtaggctgagaaatgattcctgctgctcctctgacacccggaatgtgccttgtgattggcagagtgtccctccagaatagcttaattttttccccatttcttgactaatgtcctctactccttggccctgtaattgagaattgggcttgcaatggccagcacacgagcatcttccctgaaagctcagaaatgatggctctcccggcagggagctggcattccccatggctgagagcgctgtcctcctcgcacggagggatcattcaccaccgtgtgtattaacctgaaatccacctcaccttgatggatatttttgccaatctcccatttggtttgatgaatgtgagagaaattttcccctatggcatatgaatttctccctcacaaaataagtctaaatttttttctgttcctggagatgaaggagctctgcagaataggccacgtcttcatttacctttatctctagtagccaaaagtcttgatttttatataactggaaaaaccacgcagcataatgcttatacacacacgcgcgcatgcatgcacacacacgcacgcacacacgatgcacacgcatgcacacacgcacacatgcacacacacgcatgtgcgcgcacacaccacacatgcacacacgtacacaatgcacacatgcacacacgcacacacatgcacacacgcacacgcatgcacacacgtgcgcacgcacacacacacactgagcaccgttgagctttggtagaaaatggcaaaattacgatgtttttctcatttctggtgattggcttccgagtgttatttagagagcggagtggagagggctctttgcagccctgcggtagtgtcttgtgctcaccaagaggctcacgggaaacatgtcctccaacatgaaggtgtttgctaagattccaaccaggacccagtcttgggccacagaacactgactgctcccccaagcccctcgcagaccgcagggatattttcccttcagaacctgttgcatcagaatggggaaagcgagggctgagaatcccagaggaggccgtgaactgttctggaaaagcgagggctttgcagtcagaccttcatatgcactttgttctatctgttgcgctctgcctaaatgaccacgggccagtgactttacctctctgatccctgctccttgcctagatagtggggatcacgtcgtaatgtatgtaaagaaccgggtgcgggacttggcacctgggaagtgtcttaatacatgtctgtcgagaaaaggaagggtctcgacgtgcggaaacaagacggatgccaggaaatacgtctgcccacctccacgcccctgacagcggaggctcctggaggtctggtgagaggccccacgtgctccagccccctccgctctgtgctgagctctgcctttaagagactgcagctcctgcctctaaaaagcctttcaaaattctttattaaattttcatggcgcataaagtcaaggttctgttacttggcctcagttgtcttggcaacttcataaaacgcaataataaaacgaagctgagtgttgctaaacacaggctcattgtataaacga

SEQ ID NO: 1734 - DNA, 8507 bp, Homo sapiens
ttaaagaatcactgggtgttaaaggccttccgctgtatccagacccctccagagtacctggcacaaagactcagaacaacttagaatctgactacttggccagagatggcccttcaagcaacagctcattccacagcagcgaagaggaagggactgaccttgaaggagacatgctggactgcagtgggtctcggcctctccttatggagtctgaagaagaagatgagagctgcagaccccccccggggaagctgggaggagccgttccattcgctccaccagaagtctctcctgagcaagcaaagacagtgcaaggtggaagaaagaaccagtttcaagccttcacacagccagccactgatgggctcagtgagccagatgtttttgccatagctcccttcaggagctcaagggttccaaatgatgacatggacattttctccaaagccccatttgtctccaagagcagtatggctccttcccagccagaggagtcagacgtgtttttgagagctcctttcactaagaagaaaagcatggaggagttaacagttatccaatgcacctcccaggagctgcctgcacagaccggtctcctcagtcagacaggtgatgtccccctgcccgcgggccgtgagagagctgtgtacacctctgtccaagctcagtattccacagctggttttgtgcaacagtctaacctcctgtcccattctgtacaagcagcagaccatctggacagcatctctcccaggggatcctgcctggaatctgggggtcattctaatgacagaaacaaaggacctcagctccagaaagaagctgtctcaggccccatggctggcaaaccattccgcccccagtccttatccaagtattcccgtcactatagcccagaagacgagccaagtccagaagcccagcccattgctgcctacaaaattgtttcacaaaccaacaagcagtcgatagctgggtctgtttctatcacatccctttcctccaggactacggagctgccagctgctgatccatttgctctagcacccttcccttcaaaatcaggcaagaaaccctaggagcaaaacctgagcctcaagcctcttgtctctatcccaccctcaatacccgccatggcactcccagcttagccttctgaagaagaaatattatcagttcttatatttcaattccctgcgtcagagcagaatttcttgagtcaacaaactcagttgcagtgatatttagttgaagcccctttaagttatgttcatttttgtttgtttgtttgtttgtttatattgatttctggacttggaggcattttcatctccttcacagaggtcatccacttccaccaagaactctgctttccccccgccccacccacagaaactgtttaaatcctgaaatacttcttcaccccaatcccaaaggggccctattgttgctagttttaattcctgtagctcctgttctaagtcatgcccatcgaagaatcaagattagtccctccactaaatcaagatttagtactcttgaaaaggggagatgtctggaaagaagagcaagataaaaaccctgcacatcaacaggaagtataatcctgcagttactaataattcctgtagaagcagcagctctaggagtctccagatctgattctcagtctgtgtgcaagccaggctggctctcgtgcatgactgtctatgggtgtggaatgtacgtcagagcctgtgtagagatacaggcagatgggctaactcctcatgtctagtcatgctggcagggctttccccacatccatgcttttgaaattagtgtgagtgtacaggtttgtgtgtgcatgtatacgtgtgtgtgcacaggaagcatttccacttgagggaaatcctgccccatcatgcctacctccacaatgaaatcactcgttttttggtgtttgctcgcctaactgacttgaaccccattttatttatttagtttttttctcatggcaaagtagaatacgttggaaggtgtagggaaatcctgctggaactggtgtttcagagtaaatcttttttctctccggaatttcttgttttgctattaacaaattatatttacctgattatgaaaaattaattttccttatacattttccccttacaacactagaaaagagcaccttgttacagttccggcctctcagtatgtgggctaaatgccagcattagggaattcattaatcatgagactaggctacaaactaggcttgcttgttttggggtggttttgttgttgttgttgttgttgttgttgttgtttccaaatctctactgccttttgaggaaatgtaaatctgagacatggaaataagtgtttgggagaatggaaaagagctgaatcaggtaggcatgaaaacttttacattctctatcctctttagatgttgaaataggccagacaggttaactgatgttttttaaaattgtcttttatttctggaaagatctgacttattcctagcttttttcataccctttattattagtgccttaaaataaagctggccaggtgcagtgccacacacctgtaataccagcattttggaaggctgaggcaggaggatcagttgagcccaggaagttcaagaccaactctggcaacacagcgagaccctgtcccttcaaaaaataaataaaaaaataggctgggcatggtggctcacacctgtaatcccagcactttgggaggccaaggtgggcagatcacaaggtcaggagtttgagaccagcctggccaacatggtgaaaccccatctctactaaaaatacaaaaaattagctggacgtggtggtgcacacctgtagtcccagctactcaggaggctgaggcaggagaatcgcttgaacccgggaggcagaggttgcagtgagcagagattgcgccactgcactctggcctgggcgacagagcgagtctaaaaaataaaattaaataaaataatgaaaaaaattagctgggtatggtgacatatgcctgtagctactcaggaggctgagctggaaggatcacttgagcccaggagtttgaggctgcagtgagttgtgagtccagcctgggtgacagagtgagacactgtctccaaaaatataataataaaaataaagcctgtatctcaatgggaagatttctgctaaggcagttcaactcactggaaagaactgctgcattaggtttcaactttaatgctttctgttacttctagtaaaggttaagtgatttttccattagctgtagaagtttggagagctatttaccaagccagatcaatgatttaaaaattattggaaattcatctaagaatcaagtctgaatgcccaattctattgcggttgattaggtgtgatattctttaaagttcaggaatattggcagtaaaaaatgagcagctacttttcaatactttgtccttttttggtggtctctgcctatttcaaatgtcctgatcaaaagataaataattggcactgtgccaaggtttggttttccaactaaggtttcaactgtgccagaaacctatgtccttcactttggtggatgctaaatgttattctaagaatatgctttttcccaattctcctttctgatttttatgtattagtggatgcaaaattgtctttctagttgaatgaataatttcggctaatgcacgtggaactttgcaccccagattcttcccatggtcattatcaagtgaagccctcaaaaacatgagcgaagagcctagaaatactcagggagatttctcaccccaactcagaaattttttttttttttttcaagacggcgtcttgctctgtcgctcaggcgggagtgcagtggtgtgatctcggctcactgcaacctccattttccgagttcaagcgattctgcctcagcctcccgagtagctgggattataggcacacaccaccgcgcctggctaatttttgtattcttagtagagatggggtttcaccatgttggccaggttggtcttgaactcttgaccttgtgatccacccaccttggcttcccaaagtgctaggattacaggcgtgagccaccgcacctggcccagaaattctttttttttttttaaattattattatactttaagttttagggtacatgtgcacaatgtgcaggttagttacatatgtatacatgtgccatgctcgtgtgctgcacccactaactcgtcatttagcattaggtatatctcctaatgctatcccgcccccctccccccaccccacaacagtccccagagtgtgatgttccccttactgtgtccatgtgttctctttgttcaattcccacctatgagtgagaacatgcggtgtttggttcagaaattcttaaagtaagagatcattctaattcccctttccaaatattcaggattatctctgtaacagcccagcaaaatgtttttcctttggttatttgataattcccttctaatcaagtgactattttaattctcaaggtgcaaatcaggataaaatcatggtgattttactacatagttgaatacttcgtcaagtatgagcttgtatcctttttaaatttttcactggaggccaggcgcggtggctcacgcttgtaatcccagcactttgggaggccgaggtgggtggatcacttgagggtaggagtttgagaccagcctggccaacatggtgaaaccctgtctctaccaaaaatacaaaaagtagctgggcgtgatggcacgcacctgtagtcccagttactagggaggctgaggcagaattgcttgacccagggaggcagactttgcagtgagccaagattgtgtcattgcactccagcctgggcgagaagagcaaaactccgcctcaaaaaaaaaaaaaaaattgtcactggagacatgatgggtggagactctacataccttctttgaatacagaaacggatgcaaacacatgcaaattacttttttttttttttttggtgatgcatgaaaaaactttgacttgtggattacattaattattagtaacagttagattctgccgacttgtattacagtagggtcttatttccttaaagagaaaaaaaaatacagtcatgccccacttaatgatgagggagacattcagagaaatgcatccttaggtgattttgtcattgtgtgaacatcacagagtgtacttaacacaaacctagatggcacggcctactacctacctaggctatatggtccagcctgttgctcctgggctacaaacctgtacagcatgttactgtactgaatactgtaggcagttgtaacacaatggtaagtatttctgtatccaaacattttagacatagaaaaggtacagtaaaaatatggtataatcttatgggaccatcatggtatatgtggtccatcattgatggaatcgtttttatgcagcacatgactgtatataatcaacaaacaactctactttcttgttttcgtttgttgtgtttttgctttacacatttgatagggaacatagaagttgtgacctttcatttcagtggaaagcattgagccagaatatatttattcctaaaccatcgagccacacatgcattgatgaaccctgaaagaatccacagtaattgactaacaggcagtactgaatgaaagatgtcatatgtggtgaaaaatatttaatatatcagtttcttgggctcacatacagccctttagttccaagtgcttggttagattagaaaatgggatgaacacaatttgatgctgaagcagctgctgagcagcacccagggagtctaggtcatacgccctatattgttttcggcccacttattgttgagttgaaaagtctcatatttgtagactagagtgtatgtgtttagaggctcatgttgtatctgagttttctctggcaactaagatctctttctaaacgttctagaaagatactggtatcttactggcccattatttagtaagttttagaatacatgtacatcagtgttttcaactgcttggtggacatttcactgatgcataatcaaagtagcagattataatcatcagagtgatctgacaaggaaattctgtatttgcttccataaagaaaaataatcaaaacatatatcagatataatatatatgcagtatatcacataggaaattttattgtaggaaattagagaaggatgctactcaattcattctctagcaggaagaatacagcttaaaaatcacttgggtccctttaataaagaaaagtgtgattctgtgttgtgtgtttggaactgaaattggagaacacgtgccagtcgactgtgaaatggttgctggataaaaccacagatgtggttttatccgagaaatgtgggactgaaattattttgatgagaggtacataagagagctgcagaaaagactgtagcttctgaggaggcaggagtaccttgttaatatccaaaccacccctgagttctaatgttccaactccacctaaacgaggaattggaaactttaaatggaattatctaatttaaattcttagttttttctttgtctttctcagctgatacttgtagttttgttttgttttttaaccaccaagaacacttgcaagtttgttactgaaaacatcactaaaggaaaagaagagtttcaaaatgcttgaaaagtagtatgtggttgggaattgtttttgttcaagtccctggaagtcctcttggcttagctcccttgttcctgttcccacttcatttccttacttaacattcccctattttgagcatgtcaataagtgcatgatgaatggcacagttgaatgatcatgttaactttaattgcttcctttgttgctgtaaacagtttcttgttaagtttcagccaagtctgtgacaatctcaccaaataagaatgaaatgggcggggtgtggtggctcacacttggaatcccagcactctgggaggctgtgttgggccgatcgcttgagctcatgagttcaagaccaacctgggcaacatggcaaaaccttgtctctacaaaaaatacaaaaattagccaggcatggtggtgcacacctgtagtcccagctacttgggaggcttaggtgggaggatggcttgagcacgggaggcagaggttgcactaagccaagatcgtgtcactgcactccagcccaggcaatagagccagaccctgtctcaaaaaaacaaaacaaacaaaacatgaatgaatgaaatggctcaccttccctattatgaactagaagaaaggatgaaggaaggttggcaggaccccagccttactctgtagtgacaacccagaggtacttttcccggaatgcagggtcaagtttatgtgtgaagggactctagaatagctggtaaaaatggctacatggtaaccattcttgacttagtccagtattcccataatttgtaattccataaatttattctcagctgtcccccagccatttctaatagaaggatgtgtaccccagttttgacaatgttcttgaaatcaagttagtgttacctgcattgcattataatggaactatatgtacatgttaaagggatccgtttgattcctttcggcaaggaattgcaaaaatagtttttaccaataccagttaaaataggataggttagactttgggggcagggtgagacagtgcagccttttcactctgaaatggcaaatcagctgtactctttgagtctaccagagattcctatttgagtgtgaatggggtgtgtgtgtgtgtgtgtgtgctcattcatcttcatgctttcttccatggtgttaattcaagctctcctaataaaggtatccaaagagtactgagaagtgaccataggtatttggcatgagtaaatgtagttccttttgccaaaaaaactctcaaaagttacaactggagttcttcgcgataaaaggttggggaaatcagccatggctttagccttgttcccaagtacacatcttcttatccacaaggatgaaactctgtagggctcaccctgagggctcatgtgtggcattgagagggtagcagtgaccagaacaccacaaggcccacaagatgttttgaatgagggaacatttaatgtcatttgttaggagatagaaaccaaataataaaggacaaggaccacgctcattccgtggagaagaggtgaactccctctgctgactatttggaatggactgaatgaggaggtctctccagccagaaggagtattgaggtcatcaggcctcagaaaacaatgtacacataatctcgggctgtgaacaagagaaaggagggggggaaacatgaaagtcaatcttaacaatttttgcaatacctcttatttgcagaccattggatttatgttattgcactctcggtgtgatttatcgtatgtatctgataggttttatgaattgttttgagttgtaaactcctataccctttattaaaatggacctaattaagtga

SEQ ID NO: 1735 - DNA, 592 bp, Homo sapiens
tccccaccagggtcctcagccacacaccccgagccctgcctgcgggcccagcccccccatttccggagcctgcgccccggacccagcgggggctgatccctgggaaaggcctggcttcctcttccttcctgtccctgccccacctccgccgggctccacagccgccgggagcccagggccgagacgggaggagggcacccacctggtcggtgtcacatgctgcttcggccccagcgtcccctccaggtcccggcgccggccgcagtccccagagccgtccccagcgcaggcccggccgccccacccgcggcccgcccctggccgcccgacgggagggagggatcgggttctcctaggaagtttcaggtcattcaacatttattcaaccaaaaatactaagtcagctctatacaaactaatggaaggatacagctatgcaaatatagaacactaaagtgttacatgacagatgtatgaggggaagagtgctggattcagagcccacctcaggggaagacaggaccctctccaagatggtttccctagaagctactacctctccctggagggtggagatatttgctggtcaaag

SEQ ID NO: 1736 - DNA, 2633 bp, Homo sapiens
aactgcaatcatgagtcttcagaacaccttatgttcacattccctcatagtgccacagaccctccttttcttgtgaactggataatcacatacctgcagcccccttcccttattgatatcaccttcaaaaattgaagaaatgtcaacattggggaagaagaacacagcaggatgtgtcaagtggagctgatattgtccgggaaaaatggctgactgcacactcttcggctcacccagctcgaactcttgcattatgatgagacagcaacaaggcaccatcttggagaagcagagagcagctctcatcagacaccgaacctgctggcaccttgatcttgaacttctcagcttgcaaaactgccagaaataaatttcttttgtttataaagcacccagtctcaggattttatcttctatggaattacctcctctaagagttttctcccaaggcaaactgcatgaaagtcaggtctctacgttggctatgcctggctctactgtatacactggcttttgaacctggtcatatgttggtgtcttggttggaatctggagaatggagtgggggaatgaatagtttaaatctggattatgcatatggaagactcaagctaagagcatttaggaatcctgaattaagccaagagtaaacaggagtgaaatgggtaaggtttgattcaggtttatctaagttaattgactgaaaaaataccctgaagatcatgatgtcagagaagttgtgggtgcagaactccatttgtaagaaatttgctagtgaatgggagttgaggtagttaaagcaatgagcaaagatttcttttttcaggaggttaagggtgattggaaggagagaaatggtacgttaacttaaggagccataaggttaattatgtttaataggagaatgaaatgtgagcagagtgaatggagtgggaaggctgaggtttggaaatgtgtaggtccattctgagacaaagtgaaaagaaaatgaataaaatgatgattctaagaaaacgtattaagggaacaaaatgtgaggagtctgggggcttttttggtaagtccttcttagttgaggaggtggtgaaggcatagaagtttagaaagattctcactagctcttttcgcttggttcatgaaagaatcgtgactggaaaactatattctgttacattattaaatgttttgatagaattttctctgggggatggcctcactgtatctaaactccactcaactatagaataagatgattctaatggaaattccaggaatttctcaccacatatgatatatgagaagtaggatggagttgggttcaggctccatgctttttgcctctggataatatttataaacaaggagtcctactctgtctctgaaaagaacagtcaacatagttttatgagagctgcttttctggtataattactctaatgctgtatttatcctcaaggtcagtagtggccattaaaaaaagctgtccctttccctggagaacagcatcctcccccgacaaataatttctgttggaagaacattctgtaagtccatgttctcactacaaatattatccaatgtagtactgaaggacattttaaaaacaaagtcctttttgatctttctgagccaaaatgtcttcgacttaattccttttccacaaaataagaaacatcttttggattgaggattagtcttgcaattcctactctccttcttcacaaatgtctttatttagttttggttcccatgtctgaatgagtgatttgaatagatggcctctaagttcccttccatttctaacatgctggggctctttgagtctgggtgattacagctattgtgtcttatttccttggtatacactaagcttcttgaggataaatagggaacatgttttatttgtctttgggtcccccaaaacatgtaggctggagaacctgtataagtaaatctctgttactgaaaaaaatacataagttaattaaataaataggaatacccacaaatatcatagcattgcctggaaatattgtcttaatgagaactagaaaagaaaggctcttcaaggtggacaaaacacctaagtacatggcttgattctcaaagcaccaaggcacaggcactggctcatcagataaccaacctcttttggctgtgtgctattgtgcagaacacaacctccataactgtgctgggcatgcctgccactgacacacagcatcttagctccagtgaagcctgaggagcaggcttccttatagctccctcactgttctgcatgtaagtcaaggggacagctgtcctgggagccaatacaccactaacctaagtatctagaccacagccacaaaatgatatacactctcctccaatatactattagggatcaacaccatcctatattatgtctctgtttacctcaggcacctgcagaggtaaagcctcactattcatcaactattaatctcacactattttgttccaattcctttttctcttatatccatatcactggccctcctatatctgtgtctttatgaattagcttatgctccctatctttttcttcttctcttttcacttctaccacttcctagacttcaatgaaattgaactgtagctcacacaag

SEQ ID NO: 1737 - DNA, 2208 bp, Homo sapiens
cttgatatgtgtggcatgggctccttcaggtgctagtggattccttaggatggtggtgttggcatgaaaggcaggcttgtatcatgaggaatgattgtcatcttgtctgattcttggagatggcaggaagcccctggaaacacatggtgtggactctttcacaggctgttgaaaccctcctgaatgtgaggccagagacaggcagacagcagatgtattgcagggagctggatgacatggcccttggaacctgtgcacatgcctgcctttctgatgcacgtccatgttttctctgcacctccccggtggtgttggtataaaaagcaggcttacatcagcaagggatgattgtcgtctcatgcgatcctgggagatggcagaagtcccgggacacatggagtgtgggctctttcggaggctgttggatccctcctgaatgtgttgtggccatggaagtaaggccagtggctacgagggacagtcttcatcttgggagatccctagagagggcagggagccccttgacatgtggaatgtgatctctgttgggtgctggtggatcccacaggtggtctggcatggaagaaggccagaggctgcgatggatcatctttgtcttgggagattcctggagatggtggggagcccctgggcacgtgcagcatatgtggcgtgggcttcttcaggtgctggtggatccctcaggatgcttttcaaggtttttctatgagttctgttaaagagtctgaaaatggagcgtagaagacatgcttcgatttccaggatggttgtgttttccagagaggcggagttcattgtggaaccagcacagattttcatacgaaagttatttctttttaacctcaaaaagtgacagaatggagtgtatcatgaaaaagtctgacatcaaaacctcaaaatgtgatattgattgggtgagatagaattccatggaatttcattgccaaaccagtgaagtgctaattttgacatttgtaccagctaacgtagctgtgaagaaacacaccaatacacttctaaggacagcatagaccaagatctaggtttcatatggatgaatttattcttccctttgaggcaagacaagaaggaaagaaagtattgggaataatgctgccctcccatcctcaagggccagtgggaactctaatattgattggttttcacagaattccatggactttaactgctgaaccaatgatgcactgattttgtcacttgtaccagctaacgcatctgggaggcaacaaaacaatactctcctgaggttaatgtggaccaaaaactagatttcatataaaagagtttattccttctacttgaggtgtgacatgaaggaaagtaatggaaataattctgccctcccattctcaagggccagggggaattcaaatattgaacggaagtgattttggaattgcatggaattctcactgccatcccaaagaaatgctgatcttgtcactcttacctgtttcattccctgggggcagaacaaaaggacgcactccaaagatcggcatgaaccaagaactgggtttcatataaaatattttattctgtcctcttgagatgtgacatgagaaaagtattgagaatacttctatcacctcatcttcaagaatccgtaggaattctcccatggtggactttacggttaacctgaacaggtcttggaaaaaggactttaaacattctcctgttctgtggaataagtatacttttttctggacatacaccttgtcagtgagttccatgtgatactagagttgcatagatttttaacctttacgccaatgaagatctgaggcaaacattgccccttttttagaagtttgcatttgtcactgataactgtaataattgatcttgttgaaaagcctgggaaatgaagatctgatatgtcacttttaccggcttcctcaactgaaaaagaatacaatgaaacacgctgagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctggtcaacaaagacaaggcacctagccccacatgaaactttattcctttcccttttgagatgtgacatgaaa

SEQ ID NO: 1738 - DNA, 579 bp, Homo sapiens
ctagagagctggcgcacctcctgggcctgacgcgggcttcctggattgcataaaggctccttctccttacatagccagggcaaaggtgcatgacaactctgagcaagtcaaaacaaccgtcagcagcgggaaacctcgatgaacaaacaccgggagagtgtttctgcagatcctgctttgtgacttcgagtgaagtgtggaagcgctggaagcacttagaccctgcctgtgccgcagacccctgggaggcaccaacaccccggatcgagaagcccgatgggaaagaatgtctgggaaggacgtcatgcccgaggcttgcgtgacagtttccactcacagtgcgctcactctgaacctctgtgcacacgatgggcctgcatctcttcccactatctgctaggaaacacgaggggaaggaaatgaccgcagaagggagtgcaccgtgggggcaggaggtgctgcggccaatgggcagtgctgggagatgaaaccaacagcggcgattgccccagaaagaacttggcgctgctaaggcaatggcggcccgaaagaggcccctgacgcatgaggagcggccgc

SEQ ID NO: 1739 - DNA, 645 bp, Homo sapiens
acagggcaccggggcaaaacggagccattctgtgacaaactcacctcccaaagccactcagggtggttggctgcaacagcagcgactcagagggaaaggccactgcaccagccctcagctcagggggaaggcggtgagatgacaccacagggcattaagccagggccccagatcaggtgtgacgtggaaaccaagcatgcttcagggaaggcctggcagcagagacccgacttctgggcaggcagagcagtcaaggctgcccagcagctgctggtggaccctgggaaaccagctggggctgcacagggccatcctctcccgctgagctgatggaacacgtatgtcacctcctcctgaggatgcggcccagatggaaatcactcctggctgcccaaacggaggcccggtgcctctggtcatgtccacatctcgtccagcgcttctgctgcctcaccaagtctggaaagagctgctcttatctcaggctacccacttccactccgcgcccctgcctgtcccatctcttggaatgagcgccagcttcctgggagtggagtgtacctctttcccaaacaggccctctgtctggaacgcgcctcttctcactccctgagtcatcaataaatctgtctcactttgtcctga

SEQ ID NO: 1740 - DNA, 1587 bp, Homo sapiens
cacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcactcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgcacctgggaggccatgtctcccggggagtctcaggacctcattgggctggaattccacggggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataactgggagatgaaacaggaagctctatgacacacttgatcgaatatgacagacactgaaaatcacgactcatccccctccagcacctctacctgttgcccgccgatcacagccggaatgcagctgaaagattccctggggcctggttccaactgcccactgtggactctgaggcctctgcatttgcgggtggtctgcctgtgatattttggtcatgggctggtctggtcggtttcccatttgtctggccagtctctgtgtgtcttaatcccttgtccttcattaaaagcaaaact

SEQ ID NO: 1741 - DNA, 3401 bp, Homo sapiens
gttgcaggctatcgtgtgttaacctgtacttctgccgcagagtttggagaaagcggcagcagattgtgctgccgcaggctggagcctggaacctggagccctggagccttgaatggtgtgtggtggcaatggagagaggcagctggcagtgacagctgctccgtgcttggctacaggaaggaaagaaggagaaagcacctaccataggctggaggctagagcctgcaggactgcggctggcctcgctggctcgcctccctggctggcctcgctgtggttggtggcagcgacggatactgcagctggccagagtgtagaaaggcaatggggagcgcagtcctggtgggcccagcggttcctgtggattggagccaggcagtgtgatgttaccagtcaccactccaggtcccagttcctggcccgcttgagccaaaaggagaggctggactttggagggtggatatgagtgccttcactgagactggcccctgccacccagtggccaggatgacaaggcagaggagaatgaccctgtggccaccaccatcacaggcctatggggcacctcaaactcaactccaaaattgatctaatgaactttcccaaaccacattcccttcttgcatttctgagagaatggattcccattcatctgactacagtgctaccctgaaagcagatccagagactaagattcacctgcaggtgattcatttgcaaggtaagctgtcatcagttggaggtaagcagaagacagtagagagtacagagccctggactgtgactcagaggatgagcaccagatccagtttgctgtgccacagtggtaagtcacctaacctttatgtgcttggattcctcatatgtaatacaggatcacaactattgttctcactcatgcaatactactattgtgagaacctcatgaattagagaaactctgaatttgcaatttagctttagaacactgacaagtagctcattgattcttgcctcattcctctggaataaagtagctttttatcaaacaagtgaacacattgctttcagtggaggcagaaggaattcattttgaaaaatgcacatagcattctccaacccatttttgcatattcttttttaagggaatgccttgtgtgagaggactagcagggtatcagaactgttttttgaaagaactttgtttgcaggtgctttcaaatatgttgtcttcaactatcattttcagtgtaaaaagcgggcttggagtaagcactgcctgcagaccacttttgtgagccctcctttcagtgatgtgatggcaatccaggcccctgctgggagagatttctgcctggttaaacctctcacagcttctaatcctctctttctcatctggctttccttagccttctccaaagtcactcacagaaggcatcccactcaacctcaccttggggtaaatcaaaatagtcctccttctgaagctaccgggtaaaacggtggtagctgtgcagctgctgctgatcaacaggctccagaaacagcagcaggaggtgagcagtccctgcgttggccaccaagtggtaggtggccagccctacctccaagttgcactgtttacttattcatctttcatggtaaagcctccagttgcctattatgaaatcagcaataatcatgtgtcccctgtctgggtccctgaaaagatggaaagaggcagatcaggctggtgctctgagaatgacagacatcaaacaagaatgaaaagtgtcaccctccttggacttattcagtaactcatgcccttgagcaaaggaggattttctatcaaaggacatggatttctgtgtctttctcttgagataacattgctgggtgaccacagaaagctggctctggaagcacagaagctgcctttccttgagtaataatgtctcttcaaagggagctggagcatgagtagtgtacatgcctcagatttcagtgaaaagttcagaggaggcctgagaagaaggtcctgggaatgaatcatctagatgactcaaccttgcaaagccatccacctcattgtggatatcattcaatacatttggtgctccatcatcctatttccatggctatttcctcacatttttcaaagtctgtttcttgagccctgactgtgtcaaatagcatgccctgttattcttgggcttccctctctgttctagtattcagggagatttcagaggctggggtaaatctcagaccaagaagacgcaatggttttgaggtagagatcctaggaatatagaattctgagctatgcagtggtcctttgctttcaggaaatcaagtttgatagtatcacctgaagcatacttacattatccacaaatgacagctccttacttgagcagttaaattgtggcaagtcttaacacacagattcctcttaaatgccacctaatccctgcctggcttcaagcctctggcttcccttggagaggggcagagtctctctgtgtgagagattcttcatttctgctttctgccctgtcagtttctacttacttgctcttccaccttgtccacaaggcttatctagcggctgtttacctctgagcagagaaaatggaagtcagcagagacaaggttgaaatttctcaggaaggattttttttttccactttatcgtgcagcaagagtaaagcctttttttcggtgattctttcctccacaatggccattggctgccctctgtcacacacaggtgtgactcccttgttattaactgtcaggtgggaatttctagggaagaaggagagtgctttgttaacctcttaacatctccccaaattgcatcatattctctccctttcccctcccagttaccttttctatttttgatttcccctttttcagtctgatttggggatttcagttcccactaactttgtataatatcctcctatctctgaaagaacaagttccatctccattttccaggagagtttttttccttgcagtaagagcaccccatcatctctccatttctacctccccatcccagtgctccctttatggcagtacaattgaagagggacccacagtcttgctgaaggaacatgaccttcctactgaagttgggattacggaatagagggagaagaggaaagatggatgtttatctgaatggtcggatcttgttttccagaggacacaggccaatgggaaacttttgggaaggaagtcaaaaaatcaaagccagaactgggttttggtaatttaatctcccaaagagagaaaagtccccatactctaattcatattttgtttgacttgactgaagcccttttgaatattttttctgcttctgttctgttcttgcaataacaatgacataagtttgcctttggagacattaaaatagttttctc

SEQ ID NO: 1742 - DNA, 3043 bp, Homo sapiens
ctgtgggccagaggagagcactgggtaccagaatcacagatcaggagctgtggaaggcgctgcccgacaggatgggggaccctgggagagggatgcagccacatccaaactgtggcccagaagagggagtgggaaaagtcctcgacctctctgtcttcctgctgtcttccaatatcctacctggaaagcaacgggtctgaaaggtaattctgttcttgatgagggtgcaggcagcagagggaattgtcatcctgctgaagacacacagctcttccatgctctaccctatgtgtaatttgttcttatctgctcctggagccaccacctgctacagtgtaaagagaccccacagactctctggatcaaactactcactgtccagaaggagaaaatgaggtcctatgtctgtggctagaacccaggcctctggggagcaacccagggctccatccagggtgacctgagcctgctctgctcatcagagccagtctttaccacccttcatatcccgggagcccacaggtagaaagatgggcattgcaggtcaccgtggttcccccactgaagcaagttccctggctcgcgattagccagtgctctgctggttcatgatgcgctccaaatgctagaccaagaaagaaactgggtcggtgggcaggacacaggaccagcgctctgggaggagagctgttctcaagcagtttggtggcatcagagcctctgtgtggtcagtcaagcagggcagccaatttcctctcctttcagccctaactctggactcctgtacctggaggggctccctttgtgctcctgcagcccagaagccctccgaggcttgacatgaaagagtcgcgggatcttggactgttccggtggaagggctcctagcaaaacccagatgttttctcttcttgtatggatgggaggaccgaagtccagagaagtggaataacttgcccagggttgtgctgagatttgtgaaggtgccggatgctggtgtgctggtggctggcatgctctgagcccttccttcccgctgtttccctggagttctgcttggcaaccacccgcctgcatttttgcaaagtgatgtcatctgcagataatggtttttccgttcctggtggagcaggagttccagatacagtgcttcgggggaggggctcaagagagctgattgtgcactcctcaggcaagtgggggctgcatagaccccctcccctctgacagtcacatctcagttgtaaggcaaggcaccgtctcaggcttcctggactccggaacctggaatgaccaaaatggcagaggccccagagacaagcctcccctgcctcctccttgtagagttgggaatctgaggcccagagagggcagagccttgcccaagctcacacagcatttacaggcaaaaccttgactcacatcccgactcctaacatctgtggccacttgcccgtggttgggggtttttcaccctcaacaccgttgacattttgggccaaggagttttgttgtgggggcagtccctttcatggcaggatgtttggcagcatccctggcctcgacctcctacaggccagtagcacccctctccagttctcaaatccagacactgccaaatgtctttcacctaagttggggtgggagaaagtaaccctccagctcctaagacctttatccactgccataggcaggagaggtttcttgagtccaagcccaaagggtgctttgtctgaggctctgacttaacgtcaggcaccttcaggatgggaggcaggcctggagggggctatgaggggctggagatggtccaggccctccttctggttaggaacactgcttcctctgatcacttttcttggagcaaaactgccgatttattttcctggggaaataaaaataaatgctggctgttgtaatctcatccctgatcccatctggaaaaagcaggctcatgaatcttggccgcctgagctctgaggactgtgtctggcggaacctggagttacaatgggccttcgaacatcggaacagtcacggctgacatttcctttcccgttacatggctccttggaatgtgagccccagggggccgtccgtgggcaggcggaatttggtggaaagaagtgctgcacgggccggaggccagctcagcttctgacttgctgtgtgactttgggccacttttctgttcgtttctgggccttgatttctccatctgcagaatgaggggagccacgttcctcaacaaggggtccatggaccaccttgtatcagaaccatttagggaatgtgtttatggctattcctgatatttctgattcctcttccagacctcctaaagtttttatgcatctctaagtgatttcgatatatataagttttgggacccacaacaccaaggactttgaactttccacccagtttcaagtttgaacacatcacagttcttcagcctccttccccctcataacgaagtgtagagttatgaagctagagggtaaaattatggggtgggctggaactgggcattgctcctaacaattatctgctttcaaactcttggcagggtctctggggtccttgatccaactgaaatcactgttaaagcactttattcctccagtaatgaaactcgagctgctagttacagagtttggtttcaaaattgtgccatttattatttttgttggattggcttataaaccctcatatagtcatacatcatttataatgcattattccatgagaatgcattttccagatgagatttattttttctgttaaaaacttaaaactgttctttttttttttttaaatggcagtctttcgccatgtgttacctatttataccaccttaagtgaaggtcaggaaatgcaattttacttattctcaatgctccagggttgtcattgtgagttttaactactgtatgcattgatgtaaattttagggactccaaaactcactgtgcctgaactatgaatgtcccccaagctgcttagcccttgtgtctgcttttaaaagttctgctttgcttct

SEQ ID NO: 1743 - DNA, 1252 bp, Homo sapiens
aggggccttttagaaaatctcacaccacttcctagttggagcaattaaacaatagagaagatgggtattctggagcagaatttaatgaaacagaactccaccatctatggcaagtttgactgcttgagtctccagaggataatagttggaggccactgaggcccaaattcatcagtccggccattgaaggacacaagtgaacaaaggaggacggcaaagacagaactgtgatattcaaacactcaatagctcacagtgtcggggttcattatgacacttactaagcacatgccatatttctgacactgtgctaagagtttcatgaacattaactaaattaaccccataaaaacgccattagaaagatgcagttttgtacccccttacacagatgaagaaaataaagtatagagactttaagaaatttgccagaagtcttataactgattggtttgccatggctctttgaaacagttactcttgtcctcattgtagagatggcgatactaaggcagaatatggctagcctggacttctttttgtggagactggattccaagattgaaagtagaagctacatgttttctccaagcagggctttcagacttcacttctgcaacattttattgatgaaagcaagtcacaagaccagactgattcaaggggtggagaaatagaccctacttcttgatggagggaggagtagagttacattgcaaagggatctggacaaaaaaaggagtgatttattaggaatcatgtttaacaatttaccacaatccccagcgcaactgcctgttagctggatccagaaatgtctacgactactgcaatgccacttggccttaggggtgatgtgacccagtgtaaagagatggtggtcttaaccaatcacagttaagatagtttagttttggaaggtataaaaaatatgtaacaacatgaatgcacttttagggtcagacaagagacttggaaagagcctgcaaaatggaggagccctgaggcctaagtctcatgagtgtcaatgcttacctgtatctagacactggcatcccccttttgataaggccaagattgattgttttccttttctacctaccctatatctaatccatgtacaaacactgttgacacacaaaagaaccctaaattcaacaatctgtgaagaatttttgcactaacatgttagttcaaaaactcaacattgcttgctaagactattgcaataaactcctctatgatcccctaa

SEQ ID NO: 1744 - DNA, 776 bp, Homo sapiens
agcaaactcccagctgccccttcttactgggccatgacttaactctggaatgtgttttgactcactgactgtaatagtgactaaaaggaacatgtgggagtcatcaaaaatctgcaggtggatctgactgtaagaaagagaaacacttaattgggtacttactaaatgtttgtcaaatggatttgaatattttgtgaattttatattcacataaaggattcagaagaaagcgcaactgagaaatgtccaaatatggtgaagacacttcttctagagtgaaagacataaagaaaataggctaactcctctggggagaggaggaaaaacataatttatatctctatgtataatgaactaaaactttattgccaaaactttaaaaatgtttgtttagatggaactcagcatctaaacttttctaaaaacccatgatacgtgagagaaacaaaatcagtcctaaaattacggtctgtaagcaaggagactttttttctagaatactatgaaacaatttttttaatggatcatctgttctcatgatatttctattactccttccagaatgggtttacatattaaataacaaagcagaagctaccatttccagggaagagaatgcatcaaattatttatgattttatcaatcctgattaactgcacagccacaaaatcaacaccatccttgtcactcctacaggcgcttgatgcctgagttctacatttcctgttttattcctgtgcactcagcacatccatccactttagtgaattgattt

SEQ ID NO: 1745 - DNA, 378 bp, Homo sapiens
gaaacaatgagctggatccttgacttgaatgtgctggcggagcggggtttagcgtttattgagaacctactatgcctaggataattcctgaccaatacaagagagacagtttccatggagatgtgatcggtaaggtggtggagactcagagtgatggatgggctccctttgattggtggtccaggaagcctctaggaggaggaggtggcaacatttaaactgagaccttaatgatattgatgagttcctgttttatcagatctaagatatctttgaaatatttcaatttttaatgaaatatacagttttaaaatgttccactttaaaatgtaccacaaagaaagaaaaactactgtcaataaaattggcaccatctac

SEQ ID NO: 1746 - DNA, 3145 bp, Homo sapiens
aggcaaagccgggagaaactgctgagacgaggtggcagcggggaccacgtgagatggcgtatgtggccttgagcgataaacctcacctgtcgggggaggtgggcgaggaagcctgcagctcctggaacccaccacttttctctcccaggcccttgcccaggctgtggcctctgcctggaaccccttttcttcccatccgagcccttcccttcagtgcctcttcctctgggaagtcctctctggtgcccagcccgtcctcttctgcccactctgggtttcgcaccccatgcttaggccctgattgcctgctttgcacacagggctgtgagctccatgagggcaggaaccacatggctgttcacagctgtgttgccagggcctggcctggagaccctcaggaagtgagacatctgaatcctctgctctgtgaccctggcagccaggtagagccatcttggccatggcacccaggcttggagcaagcagcagcctcatgggtggggaaccacgtttccccagcacatcggcaggccctaaggggacattcgcttggctctgccctcagagcactgatgcccgggggacactgccctttgtgtgtcccatgtaagagaggatgcaaccttagagggggcaggggtaaacatggtcccaggccctgttgtcccctcctaagaaagttcccagttctgcctgtccatccctggccttttccctgtgctgtctgggacagtgggtggagctgccgctgagcggtgggacctagaaaacacatactgacctataggaggcactgcccagagctcctaactggggtggggtgcaaaggaaaggtgggtgagggaagcagagagaaatcatattagtagctcacacgtcaacagtctagctgtgtgcctgcctctctcatgcacttcatggggattatttcctagaattcccacaagagccccttgcaggtggtgcgattgttagctataatttgaagatgaggaaactgaggcacagagtagttaagcaatgcacccaggagcccacagctagggaggacagaggctggatccagcccagtcccctgtctcctggggccaggcccagcgctcccacctctctgataaggataaaaaggagggagcgggaagggagatattccagaggcaactaccatgagacctcccggcagagaggcttgaaaacatcttttgtgtgtggtacgcaaaccatttcccctttggtgtctctttgaaagattttgggaagatttaaactttttttcaatgatttggggatgtcagactggtgtttttttgagggtgacaccgtgatgagactggcccccaaggcagccccgttttactcaggttatggtaatagaacttctgcagcctcaaaagcagcttccgccgactgagcgctcaccccggggtccgtgctggactcagccttgactcggatgcccaccctgagccccacccgagaaagggattatttcatccctgcattatttccttagagctgatggcagaatctgctcatctccaaattcgctgtctccccgttaggagtgagcttggtgagggctccaatctggtctcccccgttcattgctgagtccctggcacccagcatcagccccgcatggagcagctagtcaataaagctttgctggacacatttcagatgaagagactgagggtcagagaggtcacatggcttgcttggaagaaacatcagatttgtctggctcaagagtccacttctggctcccccctcacacagttgcttaagagacccccagcccaagacagcctcagagcctgggtcttccccccctccgcccattctcaggcccttatactaaaaccagagaggcctctgaactgctgtctgcccccccaaccttttccttgcttatctgggaatcacgcaaaagttggccagagttagctcagtctcagagaagctgcattcttctagagtcactcggttttgcgtgacctgattcaaattttccatctttgtcactttgattcccactctgagaagttttctcagtacatataaccttactatgtgatgactggcctgggtattcatatgtgcacttgttacctgttgcttatctcctgggggacccctggttcagaggggtttaagcaggtgtcctggtgagaccggggttataatcagagactctcagggttagagcttggccctgccactgagtggccttgggagtctcatttgacctctctgaaccttggattcctcacttgtgaaatggggacaggttgagttcctgcatggaaagtgtcttgcttgatgtctcgccaaaagaccaaaactgccgtcactcactgccggagaggccctgcacgtggatattagagtttgctgggttttgtttgtcctgagcgaatgtccgtccatgtacaggctgatggattttgtaggtgcaaggtccctaacgcaatcaatctctctcctcaaaagaccatgagcatgcctggactcagagagcaccgtgtgtggggggctggcgtgggcacgtgtccgcagctgggactggcttctagggttctgggctcaggcaggagggcggggtcccaggaggtcatctctctctccttaccctggagcctttggaatttggtttccaaatgtcctgaattcctgttcattaatatgtggctcagtacagtgcttgtcccggcagcaggagcttggttggtgttagtctgctggggaatgggataaagcagagaaatgtcaagctttcccttaaaaacaaaaaacaaaagcaaaccctcacatctcccaccaataacacaccattgttatccctgtacttaagacatgttgttgccgggcatggtagctcacacttgtaatcccgacactttgggaggctgaggcgggtgggtcacctgaggttgggagtttgagaccagcctgaccaacatggagaaacctcgtctctactaaaaatacaaaattagccgggcatggtggtgcatgcctgtaatcccagctgctggggaggctgaggcaggagaatggctggaacccgggaggtggaggttgtggtgagctgagatcgcaccattgccctccagcctgggcaacaagagcaaaactctgtaag

SEQ ID NO: 1747 - DNA, 536 bp, Homo sapiens
aagaaaggcgatgctaagaaacgtgctgcaggggaggctggcacattctgctccttagctaaccgcacaggcccatgggtccacacacatcagaccatggctctctgtggtctatctttgccattactttaaccaggctgtttctcatgcgctcatggagggtgactgaagatgccaccccgaggtgcaccctcagcctcgctggacacttacggctcgcattctccagccggaccaggcagttgaggaagtcatcgaagtccagctggagctcctcatccgcatacctgagcacaatcagctgcaggaggtggctgctcagctgaaagcctgtggggacaaaggaggagacccaggactcgctgtatccgagccccgagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgt

SEQ ID NO: 1748 - DNA, 2538 bp, Homo sapiens
catattacacccttacttaaagtgtagttttcaaagtcgccacagcagcacttgggagctttttagacattcagagtcaagggttctaccccagacataccaaatcagaatctgcctttgaaccaggcccctgggtgatttctaaacacattatcatgtgaagaacactggtctataccacagggatcaacctaaataaatttgggcacaagtgcagaagttaattcctctatttatttcttttttgctcctttttagtaagtacagcccttattaatttgtgcttttcaatgaaaaattattatgttatatgctttggataaatactactgcactgtaagtgcacacatctgcatcattattgccaaaaaagaatgctctgctgaggaatgtactggggtcttgaacatgaacattttcttcatggcagcagagggagcacaagagtgcttaataaaaccagtgcacaggtctctccaaatcatgacagattttacattgtagtatatgttttcattggaagtagcctgttatgtagttcaaaatgaagcaaatcaactgagcaaacacagataggcttaccaggtcataacaactatgtaactgaacagattgaaagttgaataaaataaagataaacttctttagagttttaggcttgaattcttaaaagaaagtggacctcaaaagtgaaaaagatgccttagctttgctcaaaaacaaagataacacaacacagaatcaggcaaccctaagatgccttagctttactcaaaaacaaagataacacagaatcaggcaaccctaatagtagctcctgtttatctaaaaacagagtcagttcactggaccctacatcaggtaacttaatttcatttggtgtcatacatgttggttaaggtccatgcgccttttgctgtgtttacactcagaataattttaggggtttctccttaatgcttgcagtggtgaggatttaggtttcagttatacctacgtagtatttcatacttttcactactcttccatattgcatcctcaaaaactcccttgaagcagataacatacttggtaaaagccaagtatccaaaaagttatggaaccacatcgtgctttcataacattgagtcatttaattgtttcagtagtgctttgaggtattcataaatgagggaaattatacagactaaagatccagagcattttttacagttttaaaggtttttcaaagttattcttagataatatgtttatatatttattatttatttacaagcagtcacttactctgcatctacaataactaagacttgagaatataaaattgagtaagacatcttagtgtgcaaggagatcagagcagaacagatcttacctttggaaaactgttaatttttaccacgttgaaacacaaagattcatagttgatgcgatccagcacctgccagaatcatagcaatcagacttccaaatatgagaatcaaacattagaatcattaaaaatttgagaggcgggggggacagttgtacaactcttgagcaaaagttgacttataagctaatattaatatttcaaatttgtacgacaaacaaatgtgaagatataatgtgtattttatttgaatgtcttccctatcacaaaatcacatgagtaagttgagttggtaaacatttatttatttttatcttttctaaaatgctgaaaagaatttttctcccacactaaagagggtttgccaagtttctgcctggagcaatttgttatggctgtgtaataaatcccagaaagtttgaatttttaatggaaacactgacagaataaagagggtgtaatcctacatatgtcatttaaaaatctgagcaaaccatagtgtgcttgcaaaacaaatatactttccttagattgcactcacaaataaggctggggagaccacaaaagtaaaacaaactcaaaagtgaaaaacactcacacaatagactctgaggtcagctcaccacacccagactaaagtcactgggctctgtgcgtgtcaccaagactcttaaaagacatacttctgaatcatctttcttgaccctccaccaaactgtagcaagacaggcttcctgggaatgaaaatgacattagcattagtcaagagtgaaattaaagtcattgtactcaaacatctgccaacagtctgtgatttcatagtacccacctctgaaataagactctgtctacaattaaaaacaaagaaaaaaaggtactttaggtcttcactatccactatgtctactgagcacttgaaatgtgtgattagtccaaattaacatgtgctgtaagtgtgaaatattcctcagattttaaaaacttggtataaaaaatacatattttacatataatatatattattcattattcctatattattaattttatgtattatatatacacacatgtaatatctccatttttacattgattaaatgttgaaaatattgggttattttttaatagtgtacattgggttaaataaaatatattattaaacttca

SEQ ID NO: 1749 - DNA, 2189 bp, Homo sapiens
gcaagatggcccttaccagatgctggcaccttgatatttgacttcccagcctccagaactgtgagaaacaaatttattttctttataaattactcagattgtggtgttctgttacagcaacacaaaatggactatgtgaagaaaaccatgttggaatcttgtgctgtcattgataagaaaggatctgagcattaggtcaatcaccaaaaaactgaaaaatcagtaacaatgatgacagactcttcaaataggatgatttaaattttaggaaattggaagaagactccaagaaacttaacaaggtcctccaatattttccccaaaatgatcttctctgatttgactatgcttgttcctccatatctccctgatccctagacttcttctgtcctctatccacattctctcccaaggtgggtcatctagtttcatgactttaaatcctcccttaaactgttggttctcaaatatgcacttgtcacttctctcctaaactccagactcatgtattcagctacctacttgacacttctgtgtggatgtctagtaggtaataatcttagaattattgtgccctgtcaaattcctgctcttccctctaaaatatcttaatactattcagtcttccccatttctgtttatctcagttccttttcaggtcaaaaacctgagttatctttgattcctctctttctctcacattctagtagtccagttcctttcataatcagatcaattagtaagccctatcagctccatttttaaaatgtaactaggatcccaacacttctcaccatttccactactactctgtctcccacctgattctttcaggagccactcgattcgtttcctgcttctaccctcactactctacagtctattgtcagctcagcagccacggtaagcctactttcacttccctgctcaaaactctattggactcttcatctcagagtaaaggtctttccagtggtatacaatatccaatcatatctctccagattgcctaccttcctcccctcactccctccattccggctgcactggctccttgctcttctttgaacgcattaggcacatcctgctccaggacatttgcacttgatgttccctctaactagaatgctctttctctggatattcatatgtttctctcctcatcaccttcaaatcttttccctcatgtcatcttctcagagagacatattctgaccaccctctttaaactgtagtctttaccaatattctgtactacttattcaccatctctgcttttgtattttcttcttagtatttgctactttccagcatgatctgcttttccctaatattttatgatttatcacccattagaatataaggtccatgaaaacacgaaaaatattttctttttttttttttgactgatcccactgcctagaacagtgcttggtgcatagtaattagtcaataaatatttgttggatgaatgagtagatgtcttgaaagtcaaataggaaggaatatggtgatgtcatacaattttattaaaaaatatatgcatccctagtattctaagaattagcacatagtaaagttatagcctaattttataaactctaaaatcacttttatggtttttagctgctgtttttcaagataaaactccaaacaagtacagttttcagtatttcttatgatatattcatcattatttcaaatgcattggctttatggggcctgcacaatcatctttagataaaaatgacctcttatatttctgggtgactagacacaagccttaattaatttttaaaaagggattctatgcagaagggacagtgtttctgcctgtcttctttcacactttgcacacccaggccatctggagtgaaaatgaagtctgcccagagctgctggaagccccagctgccctgctgcccatggagtcctctgaggacgactccagagtccctcaactccttggaggagataagcagccaacacagtgttgttcagcagatgccaccgtctgccatgccctggaatttgaaccaccatcttctggagtgactcaaatgcagaggaagccaggcctgctgctaacgtttctgagaggcggcaagagtataaatggagatccacatatgtataaataaagagtgtgaatcaagctaacaaactgtttaataaaatatgatctaccc

SEQ ID NO: 1750 - DNA, 216 bp, Homo sapiens
aagactatactttcagggatcatttctatagtgtgttactagagaagtttctctgaacgtgtagagcaccgaaaaccacgaggaagagaggtagcgttttctcctgaacgtgaagccggctttctggcgttgcttggctgcaactgccgtcagccattgatgatcgttcttctctccgtattggggagtgagagggagagaacgcggtctgagtgg

SEQ ID NO: 1751 - DNA, 394 bp, Homo sapiens
catattcatatgctcttgttccttctcaaataattccatcactaatacacattccttgctgctgcttcctgctttcgcttttgaagtgcccttccatccactcctcagctctattccctgcatatctctaggaggctgtgaggggaaggaattattctctttgttttccacctaaagaaacagaagctctggcaatagtcggctgcttgctcaaggtgacacagttaatggagaggcagatctctggatgcggcgtctcaggggccacgcctgcctcccccgccgccgcgcgcatacacagaattcctcatgctgctgctatcacggaactcaggggtttggctgactttgtctactaggagcagagaacaaagtgtgacttgaaccatgcaca

SEQ ID NO: 1752 - DNA, 431 bp, Homo sapiens
tcggccacaggacacagagcactaagaagacagagaaccactaagaaagacaacaagggctgttaaggaaatcatgacattgcatagtttgtgaagcccatcctgaccacaaaggtgttgaactgtgaagaagatctgcatctcagaactgatgaatgacttgattgcatgaattcatgattgattaatgcattggtgtgttaccttcattctaatctgataatttattctttttatttttgatctttattttaaaaactctatagcgataggataagttaaaaaagttttactgtgaaacgctttttgtatcatgggaatattgagtcttcacatttgtcagtctgaatcaagaacttgatgctaatttttgtcgtaaaagttcataggcattccttagctcttgattaaaaatatctaaacaaatgaaa

SEQ ID NO: 1753 - DNA, 626 bp, Homo sapiens
gtttccaggtcctgaccaggaggcaggagtccataccgaggcccaaacaggctagccctgagcagggcccccaagcctgaggcccaggagtggacagacctttgtgacacccattctctcttccttttccatctgtccggaactctggacactgcctggaggaatcaggcctgccgtaggcccaggaaggcggaaacaaagacgacgctcagagacaggaagcaacttgcctaaagatacacagcacaaatgagaaaattggtgcccaatgtttctgaagaccagcaactgctaagacagagacttcgagggaacccgaccttgcctgaaggaccaacagcgccccctgcaggacacttccctccattgagagaagccacaggcgccggcctgaggcattctgagtgcgtggaatcctctattaccacctcctggcaaagaacggagctgcaacccagctatatgagacaccgagaatgatctcaacaaaaaggaacagtgaccagaatgcctgggggaggaacaggggatactgggtggaaggaggggagagggagaagttgtaatattttgtaaaaatgaacatttttactcctaatcaatatacaaacatcatgctcagcaaa

SEQ ID NO: 1754 - DNA, 798 bp, Homo sapiens
aacaccttaggctggtggggctgcggcaagaagcgggtctgtttctttacttcctccacggagtcggcacactatggctgccctctgggctcccagaacccacaacatgaaagcttggaaatgaatatgctgcactttacaaccactgcactacctgactcaggaatcggctctggaaggtgaagctagaggaaccagacctcatcagcccaacatcaaagacaccatcggaacagcagcgcccgcagcacccaccccgcaccggcgactccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagcaa

SEQ ID NO: 1755 - DNA, 2033 bp, Homo sapiens
acctgacactaaagcgccatgccggaagcactgagtctgatacgtcggaaccagtctccaccgtgtggtttggtcttgatttccactggtactctggggtcttggataagtctctggacctcgcctttgtcatttgcgaagtcgataggttccaatagagattttcccagaatcattcaactaaaaatagagaactttttttttttgagaggaaggacgggggcgcagttaaagatgttaatgttaagtcatcccttctgtgatttcgggacattatctttgcacgccatgtgaagatgtgcttgcttccttgtcaccttccgccatgattgtaagtttcctgaggcctcccaggaagcagaagcctgtacagcccacagaaccatgacctgatgaaatctcttttctttataaattacccagtctcagatcttgctatgcttgtcattgtgtaagcagcaaacttgcagtgaccagttggattccacccccctgatgttggtggtgtgctcttggggagatgtcttccagacaggcaaagaagagtgacatcatcagagcatggacgacctcaaagatattccagctatgctccagagagagccatcctgatggaacctactgaccagggggacacaaaagaaaagagggaggagatgaaagaaggtgagggtctctattgccagcagaactggactgtgtgtttaactggaaagctgatggagaatgtagttaggcacagctctctggacccttctagtgaaataaagaactagttaaataaggcaagacagaagaatgaggctgccatctagatgtagtaacaggtaatgttccagggcacaagggagccaaaggaagagagtttcttcactttttattctctgcagtcttcatacataataatgatctcattcctctatattagtcaagatcttcccattataagtgacgaattataaccagattaaaccaaaaagtaaaataatttattgactgattgatatggtttggatttgtgtccccgcccaaatctcatgtagaattgtaatccccagtgccagttggaggtgggtcctggtgggaggtgatgggatcatgtgggtggtttctcatggtgtaacgcaatccaccttggtgctgtcgtcacgatggtgagtcctcatgagatctggttgtttcaaggtgtgtggcacctcacctctctctctctcttctcctgctcccaccacgtgaggcacctctctccccctttgccttttgccatgattggaaacttcctgaggcctccccagaagcagaagcccctatgcttcctgcacagcctgcagaaccaggaaacaaaaggagggtgttagaggaaaaagagggaaacccactgacagagaggaaggctgaagagatcccaccgctgacttggactaaggagagagaagtcaaagagtggttacctggatgaggtggctgaatatgggcctgctcttgtcactttggatgtcacaactagccttgagaagagctgctgttccaggagtctgtcacaactagccttgagaagagctgctgttccaggagtctgtagccaaggacgtacagcagtggaggctgactcatcgcatagctgagtgaccaattgcttggcatgagtttactttaatggctgtttctgagtttgatccctctccggaaccaacccctctgatgtgtcctgttccagcaggaagagacagacctggaggttctgtacttgtgatttctggttgtggatcctgagaacaagaagtactgggatcctaaagttctgacatttgcaaagcagattaatgacctaccacattccagatcatttggtgattttgtgtgtgcgtgtgggtgtgtgtgtgtgtgtgccaaattcaaggtggtcccagcctttctagtcttctctaacctttcttctcagaagtcgcacctgttctgtctttctaggatataattttttttctattagcctgggtaacaccccaaccaataaagtttgcaatatccaagcc

SEQ ID NO: 1756 - DNA, 2379 bp, Homo sapiens
aggagggaccttgataaactagagttcatccaccagaggaggaggctgcaggccttgggcactgctcagcaggatgaggggccactgcagttgagcatgtctagcctggagtcttctgaagaacatgattattgactttatgtataggaatggctgccaatgaagaagagaatattgaaagtcagaagcatgctatcacataactctgcatttcatcgggccgagaaagcacaggttttcaggaccacagttcccatttctcctgttctgcagtcctcgtctgattggccaacactatgggcactccctgctctggtggccactggcagtgggccagggtgagggcagctcacagcccgtctcctctctgttaccttgggacgtcactcagcagttgcatcaccggctgctctctccctctgaaacatgaagcccttcctttcttattccaccttagggaagcctgggcctgcgacagaccagaagacctcacattccacagagaagacctcggtttccccccaagctctgtccagtatggagtgacaaatcgctgtacttatgagacaaaggcatgaagtccaggtcaaggcatgacttttcggcagcaacttttctagatgtgaggtatcagtaaacatttatggtgcttctgttatggatacaatacaaggatgtaaaagaaaataagtatgaggctcatcctcctgggaactcacattttcactggggctacaagacccccggagcaaatgccaggcacaagatcggggataaaagcctaactttgagaagcttgctttggctaaaaccgaaatcaattatgaagcaaaggaagtggattagagggagatcttatgaaatcccatcagatttggatcatgctactgagtttttttcttcctggctgtattttaggttttctctcccactgaaactgattaatcgttgtcaaaattcctcccttgtacccttctctctatgggagggctgtcccttggctggcctgggatgcaggaatagcttttgtgcaccctttggtgtccacttctgtgtgtctctcttggtggcactgcttccctatctctgcttgctctgaccaccttcaggctcctaggaccctaccctctcaaatttcctcctcccctgcgtccccctttcccattcaaagcccacagcacatctcagttagtgctatggaaaaaactagcctcagaaacgaatattcactgacatgtcaaggtctagtagtttgtagagccattttattggaagggacttcagaaaggaattagtttacctactcatcaggtgaggagacccacagaggggaagtcacctgcctgactcccagagacagaaacagtgctgggactaaaacccaagaagggtcctgactcccaagtcccaggaacttaattttcccccagggaatggcccaccacccacccagatgtaaaaactagagactctgggcagcattctatctctatgccagcctccagtctcctgtctattttgcctccaagatacatctctaatttgcccacttttcttgaacttcacatcaccgatctggtacaagccatcatcatctccttgcttgggcctaccaagacactaatcactgttctttttgttttgttttgtttgtttttgagacagagtctcattcttatcacccaggctggagtacagtggcatgatctcagctcactgcaacctctgcctcccatgttcaagcgattctcctgcctcagcctcccaagaagctgggattattggcatgcgccaccacaccaggctaacttcatatttttagtagagatggggtttcaccctgttggccaggctggtcttgaactcctgacctcaggtgatccacctgcctcggcctcccgaagtgctggcattacaggcatgaaccaccatggcaggctgactttcattctttctctagtattattagaatattcccaaataatattccattgtgtatatattccacattttgctcattggtttctcatggtccgatctgagctttgggtagatctggctataggcagataatccctgagacatactgctaaatgggaacagcagatgcagaacagtgtgtatgatacgctaccacttctgctggaaaacgtcaaacaggcacgtgtgcatacatatgtacgtggacttggaaaggcatagaccgtctttgagaatactcaagaagtggttatcttgggtaggagagctggtggcgggggacagaaatggaaaggagacttatttttcactggatatgcttttgtacattttatggcttattaataatgattttataattatattaccatgatcaaataaaacccttggtgaatcttc

SEQ ID NO: 1757 - DNA, 313 bp, Homo sapiens
agtgagttcgggaagccagtgcccgaatgctcaaccttgctgtatcagggagggccggagaggggagctcaagaagaggacgtcctatcgaggtggcagggattttctgaaggagggcgtattttgctgggtgtcatggcacgtgcgtgtagttccggctacttgggaggctgaggtgggagaatcacttgagcccaggaggagaagactgcagtaaactatgattgcattattgcattccagcctggacaacagcaagatcttgtctcaaaaaataaataaaaatttagaaataaagttttattggcacaca

SEQ ID NO: 1758 - DNA, 732 bp, Homo sapiens
gaattgttagcaagagaatgagtggaggcgagaagaaatcgcttgtaaaggctatgtgattccctgatgacagatctgaggaagaatgaagaggctttgaagataaaggtatcttcacctcgccaagatcaaccacatcctgcagaaccttcattcattcagcaaacagccaggctttgtgctaggccctggggaaatggcaattaaggagactcagtccctatcctcacagaacaccccatctgacacggaaatagctcctggcccgcaatgtggtaagatgcagtaatacgtgcaaggcccctgacttagtggcaatgatgtttaagccgagatctgaaggataactaacaacggcgtgccagagaaaagagtagcgggtggagagaggaggccaggggaatatttctgggcttggtaagtaagccaggtccctgccagacatggactgagaagagcaaagccaggagtgacagctgacgattattttttaactgaggaaggaagatccttgagaacggaacctcttgggaccttctacccagaacaccagagcacctcactgggatcagagccaggccatcgggtggattaagcaactaaaattgattgtcctgaaccatgagtctgtctgtttatggggagagaaactttgagatgaattaatccacaggtccaatgggactttgacattttaatttgtagaaataaaacttgcctttgattttgcca

SEQ ID NO: 1759 - DNA, 392 bp, Homo sapiens
tcacagcatgcactgttactaaaaagacgatgcgtcctcctggacctgagatctgtgtgatcgtgggaaagcgacgaaaaacgaacaaaggaacagtaaatggagtaacttggctagaatatggcagtaactacaaggcatgttctgctctggcacgaaggtaaccaccactcatacctctccagccctgtgaatacgtcaattgactaagcagattccttgaggataaagtaggctcctggggaccttgcttgttgggctacttgctttgtggatgttaaacagataattctcatgagtttgagtgacgtctgatctaccagtattccccctactctgattagaaatgacttgaccatgccaaaaagaataaaagacagctctgatacaaa

SEQ ID NO: 1760 - DNA, 691 bp, Homo sapiens
gatgccaagcagtatgtttatacttctctaaaatgtatttttctctatataaatagtgtttttgttaactctcaccggctccagtctcaacttttgcctctaatttttcccataatattcactaactctagtgatagctgtctatgcgcattgtactgagactaattcagagagtgggttggatgaactttggtttgatttgtacgtaattgttaaaaactgtgtttaagaaaacagttgtacccttggcaaaacctggaagtctctatgttaacaattttcccaatttttgttttaggaagccattctgcatattatgtttttaaataaaaggatttgactttgggctgacaatttagcatttaaccactgtctccgcaccagttccacaagagcagggatttagattaattggaaaaacctcattggtttctgatggagggggcattcatagaaacaacctactgacaactaaggagctactgcgatgggatgggcagcctgcagcttcactcggtgggcagcctccacagatgagaagatggagcctccacaaggcacatagctggcctgttgatgccactgctgttgaagtctatgtgaatggtgccccctggtggaaggaaaaagagaatgggacgccaggaatgtcagatgcttttcagcctctcccctgctctcacgcctagaa

SEQ ID NO: 1761 - DNA, 569 bp, Homo sapiens
ctgctcataaacctgggctgggcctgtcatatcatgtgcctggaggacagacctgagatcatgtgacctgcctcaccccagagattgcccaactgccctatcccatacctgttccccagaaggccatggtagtaggcaaagtagaccagggagttgtcattctgctcataggaggagagtccattgcccacagccagcccctgtgaaacacccagggtgctcagctcatgtggagggcaaaaaggaagagcctccctcaccctaccacccagaccttcagcaatccggaagctgaaacccagggtggtttatgtaggccggtgggtatgagaggccactcaatgcaaaacacagagctggcagcctgacagctaccctgcacctgaaggttcatgctgggatcctgcatgaccagcacggccagggtggggatgtagatgccagcatagctctccccggtcaggaaaagtttgttgttcttgtactccggaaagaggcggaagaaatcttgaagggcctcaaaattgctctgggcgacctggggatggcagagcaagacagagggaatc

SEQ ID NO: 1762 - DNA, 784 bp, Homo sapiens
cacgacgtggtgaacttttaaaaacggattcagtagtaccaaaatactcataatgtgcagacagacaaaagaactggaaggagtcgtgttttcagacacaggaagcttttcacgtgctccacctggacctcatctctcagcctcacactccgatcttcagcagcccccgctatgcgcccgagtcttgggacgtcatcccggagctcctagcctgcccgggaggcagagccatcagttgtctatcttttagattctcctcttggccccttatcccaactaaacacatcaccactgaggacctgtccaggggtttagctcctgatgaagagacagagaaaaggtcagagaaaggaagggtgacgctccatccaagatgactacagcgctatgatttccagatggggaaggtcacggatgctggacgcaacagaatctcaacagggacccgagagagagaggctcctctctccctacactaatatcccacgatccctgtgtcactttccagaacacactgtcagttccatggacctaggattataaaatcctgtaagatttatacagaaaatataaaaatctggggagggggaactgtgaaacaatgtgaaaaaaactatttgtcaaatggacagtggggaataacttctcctcccgcacctcctccaagcttctaacaacactcatggcacacaatacagaggagactgccataaaaatgacttaaaatgtgcccttttgaggtaaagtaactatgggacaagtgactataaaaatgacacagctg

SEQ ID NO: 1763 - DNA, 8937 bp, Homo sapiens
cccctgaagtgctgtgcctggagataccattgtggaccctggagaggcacctgctgcttatgcgagagaattggcagctgactgcactgccaggagccaaggcctaggtgtgtggagcctggaagaccagggatacctgaggcaggaggtgcagcgtgtggagtgagaaacccgagagggactggggcctgtgctcaggatcagcagagcaggcaggcagagtggagagggagagacggagccccagaaggggagcaggaggagagggaagtagtggcagcagcccaggccaggcgtgtgtcctgcaagtgctaggaccagccacccctccccatggcctccaagccggctgccgggaagagcagaggggagaagcggaagagggtggtgctgacactgaaggagaagattgacatctgcacgcgcctggagaagggcgagagccggaaggcactgatgcaggagtacaatgtgggcatgtccaccctctacgacatcagggcccacaaggcgcagctgctccggttcttcgccagctcggactccaacaaggcgctggagcagcggcgcacgctgcacacgcccaagctggagcacctggaccgcgtcctgtacgagtggttcctggggaagcgctccgagggcgtccccgtgtcaggccccatgctcatcgagaaggccaaggacttctacgagcagatgcagctcactgagccctgcgtgttctccggagggtggctttggcgctttaaggccagacacggcattaaaaagctagatgcatccagtgaaaagcagtcagccgaccaccaggccgcggagcagttctgtgcgtttttcaggagcttggctgctgagcacgggctgtccgccgagcaggtttacaacgctgatgagaccggccttttctggcggtgcctgccaaatcccactccggaaggcggggctgtgcctggccccaagcagggcaaggaccggctgaccgtgctgatgtgtgccaacgccacgggctcccacaggctcaagcccttggccatcgggaagtgcagcggtcccagggctttcaaaggcatccagcacctgcccgtcgcctataaggcccaggggaatgcctgggtggacaaggagattttttccgattggttccatcatatctttgtgccctcggtgagagagcacttcagaaccataggtttgccggaagacagcaaagccgttctcttgctggacagctcccgggctcacccgcaggaggccgagctggtgtccagtaacgttttcaccatcttcctgcctgccagcgtggcctcattggtgcagcccatggagcagggcattcggagagatttcatgaggaacttcattaaccctccggtccccctgcagggcccccatgcccgctacaacatgaacgatgccatattcagcgtggcctgtgcctggaacgcagtccctagccacgtcttcaggcgggcctggaggaagctgtggccgtcggttgcgtttgccgaaggctcctcctctgaggaggagttggaggcagagtgcttcccagtgaagccccacaacaagtcctttgcacacatcctggagcttgtgaaggaaggctcctcctgcccgggccagcttcgccagcgccaggccgccagctggggggtagcgggaagggaggcagaagggggacggccccctgctgccacgtcgccagcagaggttgtgtgtggagttcagaaaagactccaaaagctgaccaggacggcggaggagatcctggtgagggcgaggaggtggcctgggagcaggcggccgtggcctttgacgcagtcctgcgctttgcggagcggcagccatgcttcagtgcgcaggaagtggggcagctgcgggcgctgcgtgccgtgttccggagccagcagcaggtgaggaggcggcgtggtgccctcggggctgtggtcaaggttgaagccctccaggagggccctggtggctgtggggccacagctcagtctcccttgccctgctcatccacagcaggtgacaactgatggcttctctgccctgccctggccactggccctgtttctccccacaccctggagtggcatggtcctgtgccccgaccccacctgaggcaggagggcatgtgcagacactcaagagcccttccaggagtgggtcgcccacgggtgtggctcgggtgcccaggacggtctgtgcccgaggttcctgtcaatacaggttttattttatcacttgccgtgtcatccgaaagtgaggaaatgttttggaagggtccaccctagcctagaacaagccagagccgcaccctggctggaatgggggccaggctgagccgatctggtctcgtgttcgctggctgatcattgcagtatcagagggtggagatgtcagtctgtccacgtggagagaagttgccctccaggccgacaggaggccatgcccaccgcccctggacaggcttcgtctcagaaggctctatctgctgggctggcggccatccccgtgttgggtggaccccgagcacggttgcctgaggtccgatggcccgagagctgggactcagttcttggcctgctagcggctgaacaggccgcacatctcacttcagttgtggcctcattcagcagaatgactctggaaccatcctctgttacccgcagatcctgtcccatgggctctggccccaagatgttggggggccccacggagagttgacttggtagagttcctttctgggaagaaagtaggagtggctgaccaggccctgctcatcacccggatagaggacacggaccctgtgtggtattttggcattttggctcagagtccaatgtaccatgttgcccagaatttcatacttacggcctttacatgaatacgtcttgatcagacattcagagattagtcttaggtttccacgtaagtcactgaaaacagtaaaacaggctgcttagatttctagcagtatgtgtgctcttatccccagctgttagcacgttagtaatacttttggggaggagttgtctgtcctggtcagttttcacagaggcggttgtaagaggatgtggttattttctccatgtctgtagttgctttgcggcatctccatttcacgggcaacactcactgcctgcagctgagattccagaacgccctgtgtccacagtgattagcctcgtctttcagcgagcataaaataggtgcattgtccttttcttttcttgaggcagggtctcactctgttgaccaggctggagtgaagtggtgtgatcccagctcactgcagcctcgacctccctggcttgagtgatcctcccgccccagcctcctgagtagctgggactagaggcacgcaccaccgcgcctacctttttattttttttgtagagacagggtctcactgtgttgcccaggctggtcttgaactcttggcctcaagcgatcctccttcctcatccttctaaagtgctgggattacaggtgtgagccacagcactcggcctaaataggtttttcttgctatgttattttcagtgctttgcccttgaattcttttcctctcttaaattcatatcatttggccgagtcagcacgtagtttgcattccagcgtctgctgttgattccactgaaacctctgttctcatgaaggagaggatttggctcgctgtggtttctcgtactttcacatctctgtagatacaggggcaaaagtcattgctgacagagccctatctatgtcctggaagtgtgtgtttcttgctttgaatgcatgtgtgaagattataaaagccaaatagtttttaaagatctcggtgctgaacgacagtcccagttcccatttgtgtcccattgtctttgtggtgtcacccgcactgtttgcttcattgtctggggaacttctgcacatccatgtactttgtgccatttctgggctcacgtgtcactcctaatagagcctcttaaccaagactgctggattgcagctgcttgaggcaacacaggaggttagaacatgtcccgagggctctgaaacagtaggacatcctgggtgggtggagctggggagggcatgggcaggccagctggccgagctcctggctggctctcctgagtcctctggacatggcttgtccctgtgagactgtagctcttcaggacctgagctcttcccgttcttgacctgctcttgtgctgactgtgctgggctgatgggtaggcgcttgtccccagtgagtggctgtgtcctcagggtgcccctcttccagaccaactgcagcaaggcctggagcctgactctaggtgcagcccttgtggctggaatcccttgtgccacccaggggactcgggccctgctcctcctgcagcccctcctcacctgggctcgctgctggagtgaggtttttagggagcccagagcgtactcatctctgagctgctgggcccagctgcctggtgcatacctcttgcctcggtcctgtcccccagaacgctttatggagactgccgtgtcctccgagcactttgttttcacttcctgacccgtctcagaagctcaagtggttgaatgttttagcctcagaatctttttccccaagccctctcaggtggagccccgctgtaccagacaccacagcacagctctgtgaggctgtgtctcttcactctgtttctggggctgctgaggcccctgggaagccctggagcttgccagagcagagcgagaaagtctctggtcctgtttaaatgcctccgcgttttatctgtgagcaccaggctggagccactccctgtcttctcacagtgcccctgcaagttgcagcctcagttttccagtggctcgtggggtagcaggtgctgcgtcatatggtttgggacctctgtggctgcttccagcctgctaatagaacctctttccaccactgccttcatctttggggtggcacccctgagtgctcaggcctgagggcgctcctgtgtcctcactcgggacaggcagcctccactctgggagctcccatccctcgggatgcccaggagaggccatactttcagggtggcatggtgaattcaggggttaggatgggtaggtggtctttcagccccttctgcgttggggttggtttacagaacacctgtcctgcctgtgccagcctggccttctgcgagcaccccaggcacgctgtcctggaagttgtctgtctcctgcataggagggtctagagcagaccttgccctgggcctgtctgtgcgtgacttccatatgcttcattcgtgctcagccatggctgagcatgcgatggagagcacctggaccgcccctgacgtcgcaggccactgttcttatccagtgggccaagtgattgattgctagtggtggggttgattggaagaaaggaagtcgcagcccctgcccacggcttccccagctcgctggggttggaggactgtcatcagttgtccccagttaaagtccatttggaggaggttcagggtcccagtggctggatgtgcttgtggagggacacggtttgaggcaggggtttgcagaaggtgtagactgcatccattcttgggaggctgtggcacagggcagtgacaacttgggacaaatcaagacccgtccacactgcacctcagggacctcacctcacgccccacataaatgtgcttattggggggccgggtgtggtggcttctgcctgaaatcccagtactctggaaggccacggcaggaggatcactttagttcaggagtttgaaaccagcctgggcaacatagggagaccccatctctacagaaagtaaaagaaaatgagccaggtgtggtggcatgtgcctgtaaccccagctactcaggaggccgaggcgggaggatccccaagcccaggagtttgaggctgcagtgagttatggcctctgcactccagcctgggtgacagagtgagagacctaatctctaaaaacaaaaaataacaaaatgtgctttggggtcaggtgtggagatcagggtcggggaggtcatgaggtaggtaggggtcaggatgtggacagtcatgggctggtgggtgtggcagccgtgaggggtgggtggtggcctgggaggcagggcctgggcagggcttctgcacttctgctgcttacccagccccctctgggttcgaggactctccttgacaagggctgagctctcgggcactgcgttggactcagctgcctactgggaggctggggagaatggacctgtgagaccttgtttgtcctcttccctgcccagctcttgtagaccccaggcctggctgtccgcagggccaggagctgcagccatggcagccaccagcctcccacatgagccccagctcccagccccacacgcccactcctttgcccatgtggtgtcagctctggcctccgcttccacacatggaccctcagaccttgcacatctgttgtttcccttgcagggcagtgatgatgacatgaaatgaggtggggtcactcctgtttagggatgagactggggcccagggaggggcaggtgtgaagttgctgagggcagagggagacccagggctacctgctcctaatgaccagcctcacgttctccactgctcactccctgccgttcaccagctgcatgaccttgagcagtgcactcaactgtaaacagaggtgaaaacactcctttaccaactgttttaggggccactcttgtttgaggccttgaacctcctttcagttccgtggtggtcctgagcctctgaatctgggtatggcccctgctgggtcctggtctcttaggcagcacgatggcctccctgctcaaggccctgcacccaggggcagattgtgggaggcccactggccatggctgggccctatcgcagagagcctgtcagcacggccatttccacacccaggctggctgggaagcaagctacgaggtgctcaaaggccctctatgtctgcaggtagccccgtcccacacaggcgaggatcgttgggcctccttagtagccaaaggaactgaggtccagagcagggaatgtgttgcccagtgtcagcatggtctgctctggggtcaggcgtcttgccctggtcctaagccaccccaagccaaggcatgtccctgggcccatttcctctctcgaggtcttgggttccctatttctgatgtgtgtgaaaggaaggcctgtcttctggggtgaccatgaggctcagtgggaggagctgccaggcttgagctgggacttggcacctggccagccttttttctatttcattgtaccttgatgggctgtcagttctgaagagaaaaaatacactaggaatccattcttcctccaccattctccctggcagagggaagtgactacacccctatggtgtggacatactgacgctcctccatgaagcagcaaagttctgttgtttcaggagactgtgggccttgaggatgtggtagtgacctcaccagaggagttggcaattcctaagtgctgcctggaggcctctacagagacataatgttggagaacttctgccacatggcagtgctgggtaagacccctctgtccccaccagtgcccttgaggttatgggtgttggtaggtctgtggcctccatttccatgacgatggtgttaaggactgcatgtttgtgtccccccccaaagtttatatgttgaaaccctgacccccaggagggtggtattaggaggtggggcctttgggaggtgactaggcttaggtgagatcgtgagggtggggctcgccgatgagatcgagtccttataagaaaaggaaggaactagagcgaggtcactttgtgctgtgtgagcatacaagaaaactgccatcttcaagctgggtgcagtggctcacgcctgtaatcccagcactggaaggccaaggcattaggattgcatgagtccaggagttcgagaccagcctaggcatgataagaccttattgctaaaaaaaaaaaaaggaaataaaatagaaaattgccatctgcaaatgagaaagccttcagccgacaccagactgccagtgcctttgattttggactttcagtccccagatctgtgaaaaattaatttatgttgtttaagacacctagcctgtggtattttgttatcgcaatccaaactgactgagacaggcagtaaggagagaacagaggttccagcctgcttcaggtccaggcagttctgccattgcccctaactcctcagtgccagtcatgggccaggcccctgggggacttggaatgagtaaaacatgcacctattgttaaggttcacctggtccagaaggggaggcagacccacctgcccaccatgacccggacagaggcgataaatacggagcacctcatggccagggcctggaggattcccaccataccctacccagcgccaataacagagggaccctggagttgtgtacacaagatagcagttcagtgcttgcacacatactagttgagaagggaaatcagggctaatgaaacagctcaactgtctggcagagccaggctccttctgccatgatacagtttggatgtttgtccctttctaatcttatatggaaatttgatccccagtgttgaaggtggggcctggtgggagatgttcctgttatcgggatggatccttcatgaatagcctggtgccatctttgtggtaacaagtgagttctcacttgattagtttctgtgagaactgtttgttaaaaagagcctggtggcacctccctcccttcttcctccttctcttgctatgtgatgctgctgccctttgccttccgtcatgagtggaagctccctgaagcccccaccagaagcaaatgctggcaccatgctgcttgtacagcctgcagaactgtgagccaaataaacctcttttctttataaatta

SEQ ID NO: 1764 - DNA, 420 bp, Homo sapiens
gttttagggagggagagcggcctgggtcctgggtgttgtgtgcggagctgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgtgaccccagccccgccgggccgacccgaaatgaaaagctctcctcctgcgaagccccctcggggcgctgtgcagcgaggccccttaggcggcggccacgctgtggtccccgaggtcccggagctggccctgcggggcccggcgctcagaagtgatgaattgatcagatagacgaggccgggcttgtccccggccactgattatcgaggcgattctgatctgg

SEQ ID NO: 1765 - DNA, 965 bp, Homo sapiens
gaatcctttgctgaaagacttctcccaactcatctagttgttcaacgctgcagcattttatatatatacctatatcattgaagttgccgtcacgactgatttattagtttgtgcctttcaccaggctgggcagagatgtaccaaattcatttttactgataagaacataatgaatgctgaatgaatgaatacaagaataaacagaagacgttcagaagaaagttcacttggtaaacaattgacagtcttagtgactatttttatgcattgaagcagtgagagggaccaaggtatctcaaaggatccaaggtttttggattggctgcaatgagcagagatcagtgctataggaaggagaaaggctttctttcacttttagacatggcaatatgaggttttcatgggacatacagtcagtggttgtacatacgatttgagagcttaaaataatctagagaagtaagttcagagagttatcaacacctatggtggttgatgtaaaagtgtggtgagatccccttaacataatgtattgtgagaagaaaaatgaaaaaagaatcctggagatgaccagcatttagtggggtgaggaagaagagaaaagcagcaagtaaagaataaaagtttcaagattgtcaagaatgacgagttggacttggtctagttacttccacagcagcaggaggaacatgtgtgtgactcaggataactggggaagccttggctaggctttcctcatgtcaacctaccactcaaagggagaaaacctcctgatcagaggtgcccagaacccaggaaatccataatttttgaatgctggccgaggtctgtgacctctgactgaatggtttccaagctccgaattcctaggtgatgttttcatttgttcacacttgctgaagaagggaaaggctctctgatttacgtgtaagcaaaacaatctaaacagtaggataaaatcatgt

SEQ ID NO: 1766 - DNA, 477 bp, Homo sapiens
aatgaggccgcagatggagtcagaatgtgaaattacaaataatcactggatccatctactgttttccatcaccttccccactgatgctctgggcgagagagtgatgtgtcacttcaactgtgtgtaatatgtcagacacgtcctacaataacaggcgtcatatttgtattatttttagtttactgtagaaaataatgtcaccgccaaaggtgatgagagtcacgttttgtaggatctgttttcttatacttaaagacagacttctgctacggtaattgccagtattcatggcttcctttctgtgtcagaagagaagggatctgctttctcttggctgatttcacatagcattggtaatagacatgcatttctctttctaaaggggagtaactttttaaacccttcctgattttagcctggcaatgtaagtgtccttaatgtgactgttttgataattaaaaaaaggtatataattta

SEQ ID NO: 1767 - DNA, 1256 bp, Homo sapiens
ccggcgtactggaacctctctcgcgatcccgcacccagcttgaattcagcaagaatcgaaaacagtccaacaaccgtcgtatctacagcgatccttagagaacaattaaggccagttgacagtaaagaacaatcagtgtgtatttgaagtccatgctgagagagcatcaatcttctggcagctgcaagactgacctatcaaccgaggcatttcttcattccctgccattgtctcctcctcttgagatcgccatcaggcacagtcacttttctacaaacaggcaataggactcccgctgccaccctgcccagattttagtcctctactgctgataaagtgagcaaagatacgtggcacttcctgaacccaaatactcttctgagctgattctaaatccacacagaatcaacctacctcctattacctccttccaagctctgtgtcccattctctcatttcagtctcagctccagacatcagtgaattcaatgtgatacatcaggggacatcacaggacttccctacttgaaaatcaagcaatcgtgtccctgaaacactctgtctttattcatgctcagttaccgtaaagtagatgcaactctaagaacctatggatttttttattgccactaatagatcatgatttacagcaaaattttaaaaggtccaattttactcacataagaagaagaaaacattcagcaagaagcatttcttttgctttatctttcccagttaaatatgactttaaaaaagacaaaattttaaaaggtccaattttactcacaaaagaagaagaaaacattcagcaagaagcatttcttttgctttatctttcccagttaaatatgactttaaaaaagacaaaattttaaaaggtccaattttactcacataggaaacaagaagaaaacattcagcaagaagcatttcttttgctttatctttcccagttaaatatgactttgaaaaagaagagcacacctcattagccgtaattgtctgattaatacaaagaaatggactcatatcacggggttctactacccctatggtagtgtttactatccttatttcactcaataattacagttactttaaccagaatgcctgccttgtttggcattttgggagaggaagcatatgactgtaaaccctcttcaaactttcagacttacgtttgcttcttctaagtccatcgactttatacataaatgacttctttttaaaaataaataaataaataaataaataaa

SEQ ID NO: 1768 - DNA, 563 bp, Homo sapiens
aaatctgagacagccttggtctgagggagcaaagacagagaattcacgtgctgcccaggcatagccacatagcaggtggacatccctggacacttttctgacaaagcacgcaatgtggggacaacacagaaatccaagaaaggcaagaccaatttcaaggcactaaataagtggactgagacaagaagtacacagatacttcccagaacaaacttggttctaaggaagttccagactaaaatagtgcatcaagaggactggcataatcagcctcactaaaaacagcctgattaatactaaatatgtcctagctcctaatcaattatgttaacgaagtcataggcagcacatctgcaagccctgacaaagcccatgatctcagcattgcctgataatatagactccccgagctgctcagggttagcagccttcaagctttcagagaagacactgacaaaggcttgtgatcctcaaaccttgttattttattcaccacagcctattactaggttctgggatgaactgtcaaattacattgctctttaaataaaataacaggagct

SEQ ID NO: 1769 - DNA, 2453 bp, Homo sapiens
tttgggacacttaagtgactttgaaatccatccaaaggttactctgttccttcactccacacagctcaggcatttccatgttggtctcagctgccatctcaatggtttattctttttacatgttggagcagatctggacctcccaaaatgttttgaggagaagtgggcttagaggggttttccctgctctgtgagagaaggaatttagcaaggattaatttttctaagaaggtggcacaagttttgatgtgatttgctggaaaatagtaatagtcacaatttatcttattcccccaagagaatgggatgatgttcccatggaaccttgctcatcctgctagcaataacttgtattctctttctgattcacacaaacaaggatcagagggtgatggtgggggaaatgataccaggaaatacagttcgttttttgcagggattcagaatgtgttgctggacttcaagataggaagaatctttgccttgatggctgatgacagtaaccaccccatctaccatcatctattaaggatttactgtgtggtcactttacagtcatccaagtaaattttcataatcacctgattacatgggtaccgcttttcagaaaaagaaacagatttctggagggtaagtaacccaaatcgtacagctgagccatctgtctgcatctcaagcattgaggcagcattcggcctccgagggtgttgtcaaatgtgctggtctctgttaactcagggttttggattaatgggtggagctgctcattttcacaaacacccaggatgcagtctgcaccctctatttaaagtgaggtccctggacgagcaacacggcagcacctggctgcttgtcagcaatgcagaacatcaggcactccctggagctacagcacaagatccccaggcaggcgcatgtgcatccaagtttgagccgcactgctttctgccactacggaggaatgtatcctttactctcttcctccccttcgtctcatcttgtttggtaattttaaattatttaaaagttatagaaaatcatagtgcctcaaaatggcttaccaagaaatactcaaagctgtaggatcagaagcttgacatgaagatttctgtgcatctttgaattgctttacagaaattaaagaaaaatccagacatctaaaagattataatttcagaattcatagtaacatggggatcttcttggtgtcagaactgagttcttgctgaggtttgcattgggccctgtctccgggcagctgcagcataacacggagtcacccttgctgtctaagccttgtggctggaggggaagagtgaggaccaagctgtcaacaatcccagacctgccaagccccatttgtctgtgtgcctgccaggattctaagactgcatttgggaattttgacttttactgaatgtgaaattctgtgtatatatagccttggtgagctgacccagtcagggatgactctgatgtacttttgtcttacaggattcagaatccatggctggaagaggtagtaaggccattgggagggcatgcctctcctcagcccacccccaccctgtgtgggtctccattctgaaatttccattcagatgacccggtcctaggcagggaccaaaattccttgtcagctgaggaagtcctgaagaaacatcctgaagatgatgactgcactgccatcgtgggcagatgcagcttccatctacctgagggctgaaggggaaaacctttcacacacgtgaggaaggcgcagctctgtggaaaggtcactagaatggcagcggcagcaaatagggctccaatgcacgtttgcagttaactgggtccaaggagagcatggccctccacagcaagtttgctctatagaataaagtcctgagcttgtttttatcacagttagacagagaatggtctcttgtttctcagttatccagggaagaacagtgtatattctctgtagatgagtgttgtctaatgtagtgattaatctctgctagtgttaggaaagctccactactgtgtgtgtgtgtgcgtgcatgcgcgtgcgcatgtgcacatactgcagtcttgactttccaattacaaaatgcctaagtcaggtcacattgtcttcttccagccagtttctaaggcaggcaatggaaacaggagccgatgccaaatggtctagaggcagaagggctgcatgctttgcagggccagccccaaggctgccttccagagctgcactttctctggggacagtaaactctcaccgcagctgccagccccctgtgcttggccatgcccctcacatggacttggaatcagtgtctctcttgctgatgagcacctccaggagcctcagtttcgcctttatgtgcttatattcactgtattcttcagccataggagtgcggtcttccttctggacatttctaatgcaaataaaggaaaaaggggtc

SEQ ID NO: 1770 - DNA, 490 bp, Homo sapiens
gtcacacctccgtgagcggcctcgggctcgcggttgaggctgattgaggaagtgggttcaggcggcccgccgtgcctggcacacggtcagagtcccctgacaggactttcccctttctctgagatgacaatcaggccgctttgctttgcactgccctcagagaagcagtgtgcccagaagtcaagtgtgagctcttgagtcaaaatgcttggatttgaattccaactctgctgcttaccagctgtgtgacatggggtgagtgagttacctgacctctctgtacctctatgtcatcatctttaaaatggagcccacagcaaccagggaaatagtctaacagaagcctaggatgaagaatttcgggaaagaagaaacgtccagcaaggccaagtccctttgtgtgtcagtctgctttctctctcacacatacgtgcacacaggctcgtacacacaaagatgttaagcaaaatataaagcccctccactgata

SEQ ID NO: 1771 - DNA, 2398 bp, Homo sapiens
atttcaaaattaaatttaaaaactcaatatatgagtttaacaataggttggacactattgaatacaagacttgtgaactggaaacatatcaatgaaaaatatacaaagtgaagcatggaagaaaaaaagaaagagaaaaaataagaaacaaatgtaagagacatacaggacaagtatgaaaggtctaccatgtaaaactgaagtttcagagggcaaggagaaagaaatagagcagaagcaatattcaaagggataatggttgggaattttctaaagcagataaaatacatttaacccactggttaagaagctcagcaaaccctcaagcaggataagtatagagaaaaccacaattatgcaactcacaataaaactgctgaaccaaagacagagaagatggaaaaaccagccagaagaaaaaagacacattatctacaaaagagcaacaatgagactggcagctgtctctaatagcaacaatagaagccagaagataatggaatgctatctctagagtactgaaagaaactaaaggccaacgtgtgaaaaacaatcttcagaaatgaacgttaaatgatgacattttcaaacaaacaagcaacaaaaagaagcaaaaagtaaacaaaaaacaaaaattcacataatttattgctaggagttttacactgaaatgctgaagggatttctactagcaaaagtaaaaatgatctcatttgaaaagatggaaattcaaggagggaatgaagaatactggatgggtaaatgtgttggtaactgtaaatgaatactgactacacaaaattatgttgaataactgaaagatgaaaacacaatcacttgaaggagaaatgtatggtcaaactgcatgcaggaaaaacttctataaaagagttacttcatgctctgggttggcagatacaatgagcaggagtgcatcagaagtaatcaagaaggtgattagttggtgtacttcagcaggagcaaccagatgaattggcttctctatatccccgtattagccacaagctaggcagcagcctgcaggtgggagcaatgcctatgcatgtatggatcagtgtgctacatacagtcacgttgacagcatgaaccttcgatgtgatgtgaggaaaatggcattctacctctgtgttcttcctccccaaaatttgtaaccaccatctaatcatgaggaaaacatcatacaagtccaaattgaggaagattctacaaaatgcctgattaatattcatcgaaactgtcaaggtcatcaaaagcaaggaaagtctgagaaactgccacagcctaaagacaatccagggaaacgtgatgactcagtggtattcggggtgggtttctggaacagcaaaaggacaacaggtaccctgagccactatctaaattgtctgcttaccttatgaagacaccataaggaggtataacgtgtggtgagcacaggtgaagagctagaggcctgaaactagatggggagggagaagccagccatgcctgcatccagggctgcactcagcctcccagcatctgtgcagaggcatcagtcaagccacagctaactgcagtcccagctaacattatgtggaacatcccagtcatcccagatcatcccagtcaaccaagatcataaaattgttttcagctattaagtttaaatatgtgaaataaggagataaaaatactgacttggactctgtctgaatgaaaggattagtagattagattagtgattcttaaaagactttcttggatgcatataagtgtccacaaaataagagtatgatggtttccaggtacaaataagatggaaaactattttgtgaatcagaattaaattggtttatttactgtagaacttctaagaggctttaacatgtacatttaattatcataagccttatgaaaactccaggaggacagaagagttgcctgtgactttttttaaagtgtttattcacatcccaaggaaggattcccagaagagatgatgcctaagcagtgtcccaaccatgaaataaagtctcctagctactggacaagatcatctcgaagcttatttccagctccaaatgttattattttcctcaaacccattataaaatggcctctcttagcactatgagatctgtaatacaagaagtagaacaaacacatgaagttcctgttggaaattcaaacttctcatacagccttcactgagttctactcattatggataaaggcttctgctttgagtcacctaagtacttttgacccccaacttaatcaatgccttgaagtgaaaatacagtgtcaggcagtccctattcatgacacaaacaaaccaaccaactcatatcatgacttaatggtgtgagacctcagtaaaaactttatatgaactaaa

SEQ ID NO: 1772 - DNA, 906 bp, Homo sapiens
tgggagcttaagggcgccggcacgcgttcccctggcgcagagctcgctagccggggcgcgggctgcctccttgttctggtgtgatccgaatgtaacggagcggactttgggatccagaaccccggactgaggttgtgcttggcttgaggggcgggctggatttttcctcttaggatttatttccctggagacctcatgaagaatgatgtgggttctatagggtacagtgtgatctgggtcctgcctaatctcctttctaaacttcagaaaatcatgtaccttggagttgtggaggcatgtttataagcagatctgagttttgccacactggaatttatttattcattgaacaaatatttaatacctactacaattcttagccgatatatcagcacaacttctctgctccaactagtctacattgcaaagcatctcctagtgtctttggaagaaggatctatggtgttatatgtgaacaaagatgtagactagtaaggtatcaagatttgatggggatatccagacaacttggagccaagtccccacagctggatcagacaacttttggtgacatctcacagtgtggattatcaagccagtgtatcagtctggagcctaggttttttgcctttagctttgctcaggatgacttctgctcttctatggcaatacttgagaagctacagctttgattagacgagaggctatttcaataactttctcctgataagaagaccaccgaccgtggacggattctggccagtttacaaaggctgcataccatagggcagggcaccccactatggcaaacactaataatgatattgctcctgattttgtttctgaagggaatgcctctaagatttcttcattaattataagagactgggtctcactctgttgccc

SEQ ID NO: 1773 - DNA, 6890 bp, Homo sapiens
agagccccctctcggctgctggcccgggctcgcccgcgccgctgggggctctgactcctgccgagccgggcctgggcagcgccccccgcgccccgcgagcccgcgcccccgtcaccgggaaacgccgtagccggcgatccgcggtcgccctgggctcggcgccggcccagccaggaccccgggagcgcacgggacgggcctcgccagtcacactccagcgcccccacgagccagcacagtgcctgctctcagtgaaaggccactgttctccttgggtgacccccatgatgcctgaccgctcctcgtgcctcctggaacagccagggtccttatgaagtggtgaccactccagtcagcaggggtggaaaatggtaccagtcaaacccgaggcggaggaggagcagcccgcagtcgctgccgcgagatggaggagcccacgcccgagcccgtctatgtcgacgtagacaaagggctgaccttggcctgcttcgtcttcctctgcctcttccttgtcgtgatgatcatccgctgtgccaaggtcatcatggacccttacagcgccatccccacatccacctgggaggagcagcacctggacgactgaggcacagcggctgtggggactggacctggcgctctgtgggtggctgtgccccaggatgcatccgtgtgttccctgccagcctgccatcccacagaggcaaggaatgaatctggccacccagggaaacagaaggtgcagcttagccctctcagccctccctcgagcaccagcgtggaatgcccgggtgccgtgggtgtcgcaaccatggaccagccaggggaaaagagccctggaccaggacccaggaggctggggttccagtgtggggagtccctgtgagatgatagggtagtcaccttcccaggttcctgggcaccttttggaactggatccagcaacagacaccccccatccatcacataacagtggtcttgtcttgaggagactctcggtcctttaaatgcaaagtagcaatggaggctcccaaccaagaggtcccacctgaaccccagccccctccccatggactagcagtggtgtggcagtgaggggggaaagcgggttgagggagtctcacctgaaaattcacaaaacgcacaggatatgggctgcttccaagcagtatttttttaaactaaaatatagagggatatatttttcctgttataaataaaatgtacattttagaaacttgggaaaatgcagataaatagaaagaaagggggaggaaataacacttataatcccacctcccggaaaccaccattttgatatattttcttccagcctttttacttgtattttttagtcaaattcatactctgtgcatgatgttgtatcgcctcatatgatagcaggaatacttccccattacatcaaacactcttcttagctgccagttttagtgaccgaagggcatcccatcggttgggtaggtcatggttaaaaaatcatctcctttggttgcatatttaattattttccactattttttcctcacacaaaatgatttcgcccggtaccctttttgggggtgcacagtccatgagatgaatattgaatggggagacctgggttctagtctcgcatttaccagtcaggttacaatgcgaccttgagcaagtcacttcacctcccagcgcctcagtttcctcattgtaagataggaaaagccttgtcatttttaaaattttattttttgcatatacctcatgtgaacgaaaggacagaaaggggagtgaatatactatgaatgtgctatagtcggagttggggggcaaggaagaagtcatcgatgatggctcttctcaggccctccctcctcccacctctttctgccctccaccccactcccactccatcacctacatctatgaccttgcagcaaaatcattagagcagagcctacaaaaccggccccaagtcccaattcctctacttccttgttagaggaccccaaataactcactcagcctctctgagccccaatttcctcacctgtaaagtgagggaataacatctacctcgcaaggttgttgtgaggacgaaatgagagaacatgggcaaacatgaatgttcttgaattcaccaccccaggagaagccaggggtctgagctgggaggagcagaggttctgggtgccccctgcccctacagagcctggcaccttcagcttttctcaacttctgagggctgcttcctacaggccaaatctcccagccggaaccacttggtcagaggaacactcacagcagcctttcccagcacctgacctcaagggatatggcgtctaccaatttacataattgcctttgtcatcagttttcccataacatggtacgaagttaaatgagagcacctgagctccccttcctctgagtgcatttattccatccctccaagctgtggccttccatccccatccaagagacctgcagctgtgaagaagctcaagacttctttctcattgcctgcctcccagccattagtccccaccacagcccaggccacctggaaaatgggttccaaagcactatcactactaggtgacccctgaatgtggacaaggccacagctcttcaggcagcatttcaggggctatccagttgtcatccctctcatacccctctcctacccacccctatccccactattgtggaatgcacgaagggacagctggcaaaggcagtgaaccaagatgcagggaaggccctgtatgatggggaggatctaaagcaaaagccttttgtgcattgcctcaggttcagcagcagcagccctcactctgaagcctaccttgagaagccaggcatttctgtgaaaagctcatcagcatgcatttacaatgcaaactagaaccaactcccagtcagctaataacagaccccaggaaaaagaaaaggtcttccagacctccccgacacactttagaaccctcaggggtgaaaaagagggtgctccagggcagtgcaacttaaactgtggttgaaggacaaacagcctctgcaatacttgaggagcttgttagaaacccaaactcacagccccctccagacctacgtacagaatgtatattagcaagattcgctaggtggtttatgtgcacgttaaagtttaagaagcactgcctgagaatcccttggtcctaattaattcttttccacactcagatttgctaatgggtttcaccttatctcttgactcttgtttgatggcaacaggaaatagtagcatttcaggaagggtggaaaatataaaaagcactcccaacccaagcctccaaaaaacagcaattttcattttgtgtccatatattcccttctaatcattgtcctcatgcaagattttttttcataaagatgatctgctacataattttatatcatactctttctcctaacattacatcacaagtatactttcatgttgctgctacattcttcacacttgtcattttaatggccataaaacatgacatctagtgcacatatataattatgtagactcctattattaaatatttggatttcttccattttccctgttgtacatgttccaagcaaaaaaagaaagatcaagatagatatgatgaagccggggagcttgcttaagacaggggagaataaatacttacagtacactctctccatttaagagacacatggagcacatgggggagggagacctgtctaagaactggatcatattaaggagaaaaaagcaactggaatctcaggcttcagttgttgcattatgctgctgaagcatagaggagatggtcctttgtgatcagagcgtctcaactcgtttctggcaagctaagatgaactttggggttgtggatagaaagataaactgatctgcaaaagaaatgcacagaagtattgaaggctagaagttggcagacaagaaatgaaaagcatttagagaatgggaggcctgtgaaggtagccacaacccaggacttaaggagaacacaggctggagaggaactctccaaagcagagaatgggtggtgggttttccaggcaatggtgcctagtggccagttttaagttgttgcttgtactgtgctcagctacactcccttcatgttgccccaagccctctctaaagtctgataaatgatccaccactctgcagcagtggtctttgggacaatgaagacacctcggtggtgggtcacttagggaaatacaatctggaaggggccaacagtcccagagacaagtggggtagcagaaatatgcagaaccaagagttcagagtgatggtcactagaagaaatgtggcctctaaggatgctcagacaggtggatatgtatagtaggaccctagctttaccatcctggcatatcattcccatcatagctatttcatttttttccaattagttgctgaaatgtctacatgttcttatcgagttgaaagatcagtgtctccctgtctcattaaatttccagaacttcagaggctaaatcaatccaaaaggggctggccctgctttcaaacaccaagtgaagagaactacaaagtttggtgtgtccactagtgtggtttcataccccctaggtcttgctgttgaggactggttctgccaggcatgatcaatgaccacccacaatgtcctgtggcccagcctgtggagaggtgcccaaacagagttatctgggtccacatccatgtgcccagctattctgtccaatcatagcacaaagacaggttgcctgtgtccagagggacacacagcctcaggcacaccagcccttacttatgagcttgatggtcatcagcaaagactctctccctttaggagggttctccttgggacttttcagtgtcttggcaggaaagagatggcacacacgaagcactgattgaagacagtttaatgaaagaatatttacagaggttgggcaagggtatggaaaacaacagggaacagtaaaacacccagggatgacaaggcaaggtagctcatgtctgtaatctcagcactttgggaggccaacacaggcagattgcttgagcccaggagtttgaaaccagcctggcaacataagcaagaatctgtttatctacaaaaaataaaataattaaaaaaaaattacctggctgtggtgttgcacacctatagtcccagctactcaggagtctgaggtgggaggatcacttgagtccaggagtttgaggttacaatgagctaggatcacactactgcactccagcctaggcgacaaagagagatgctgtctctaaaaataaaaaacaaaaacaaactacccaggaacaggcaggccaccaactgttaccatctcttgcctagagagacaaggagaaggatctagaacccagggagagctatagccatggagaaggagtcacccaatggaagccctggccacagctagaggatcaaaactcctgcacccactgcagctcagtaggaagagagctgggggaataaataccttgacctcttgcctcctgccctccaatctcctgtctgggtcttccattggccaaaaacaacagaagctaaaggtcaggggaccctgggtgatacggtccacataggcagcacactggagcaaaagaagaaaaaccagcacaattcatcttattaccacttagcagccattcacaaactttgcttagatgggagaaaaatattttgtccccggcacaggggaaacataaaatctcaccagcagccatattgtctgggggtgatagcaatttagtcccactccctcctgcaacttaaatcataatgtagccagtcccgggtaagtggaacacttcctgtaaagcacaactgctagtgcccccttctgtggctggtcatgaggcccagagtggtaactgcagtcttgttctcccaccacccattccatagcccctctactttctggcagtcccttagctgttggagaattttatctggtggaatgacccaaatcttcatccacagaggattcaaattcttagtgccgtgtcttcaatgagttgccacagtatccacagattcctaaagaacatgaagaggccttgaagatctcacctggaagctctgtaaaattatcagaaagaatagcaggtgctctagggcaacactactcaaactatggtccacggatggacagcattggcatctctggggagcttgttagaaatctaatttcatgcccccacctcaggcttacagaatgaggacaagggatacagggagtaccaagtgccctagcgaatcccagggttccaaagctagtactccttgcccctattgtgtagcagaaaccccactttcccttggatattggggttaaccatcctgacagtgcagtgatctctttctctgccaatatttcaacataaggagccccagatggcacaagatcatcttccaatttaacagacccataactatattccctggtggaagcagttcctcttggtcactagagatttccaaacccacaaaacctaaggtttcttggttaaaggccatgtttgtgggatatgctgagatgaatatgctgtggtttgaatgtgtcccccaaagttcatatgttggaaacttgattcccattgcaacagtgttgagatctggggcccaatgagaggtgattaggccatgagggcggagtgaatggattaatgcagttatctcaagagtgggtttgttatgaagggggtgtttggtcctcttttctctcttgcccatgtgattccttccaccatgtttatgatgcaacaagaaggtcctcaccagatgctggttccttgatcttgtattttgcagcctccaaaatcgtgagccaaataaatttctattcattataaa

SEQ ID NO: 1774 - DNA, 564 bp, Homo sapiens
gcactgcgccatcaaatgagtcaagcggaaggaccggtacccctccgggaaaaccaggcactaacacacggtgcacccaactgaatttaaactcgggaacagtgtaggcagtgtcaacaaagcgcggtgctgggtcccgagcgtccaaaggtccctgccagctcccagacgcggccaaatccacaggattccaaaagtacagacggggtttcaccgtattagccaggatggtctcaatcttctaacctcgtgatctgcccacctcggcctcgcaaagcgctgggattacaggcgtgagcctccgcgaccggccagaactagctcttcttaaggatgtgacagtgatctgcactagagcttcaggcagctaaggatatctgaaaaggagagactctatggagtgtggatgtagaaaaggagttattcctaccggaaaaaaatgaactgtggacacagtcactcaagaccagagaaacaaccactatgagtaagtagcttcaatttcactgttaccaggagggcacacaccagaaagcctgggacaaagcctgggctagagccctc

SEQ ID NO: 1775 - DNA, 448 bp, Homo sapiens
aatgtgagcatcacacctaaggtactgaagtagagttctggctgttccttacggacatctctggtggatctgaaaatatcattttcatcaagcctcaaggacactttttttcctgtgatgtctctttcgaaatctaaatcctctggacatatagcgaagcaaaattctcttttaggtatgatacacaacacaagtataaggatatagtcaataataactctgggagtaagaacacattatgaacagtgaagacattgacaaacctccgggacctttgatttgtgctataaagtatactatgatcagccctgattaacccaagagaaaattcagtgtgaagatgatggagtgacacaatagaaggaacctgaatcactgaatcatcacttggaagaaagcagcccagactagttacccaactcccatcagacagtgaccagagtgagaa

SEQ ID NO: 1776 - DNA, 1676 bp, Homo sapiens
gtaccagccccaaaccctgccagcagtatgggggaggatgcatttctccacaccttgctgaaggatggggacttggcagagttcagtgatgttttagggttggaacattgattcctttctctctctcttttttcccttttctccttgtgcctctcttcctgtgggtgcctgagaaaatactcagcctgtatgactgtggcctgagtcgagaaggagtgctagctctgagaagaaaaggtttatttccactctcatgtgactatccatctatccatctctccatccatcagcccattggacaatatgtacccagttcctatatccagctagctactgtaccaggtgccaggcatttcgggaagaataagacagacaaggttgtcgtcctcatccttctgctctaccaggaacaagtgaagtgataggaagagcttttcctcaaatagctctgagttgtcccaagtccagcctccagatcagagaccgtggttagggccctggaggatgcccacagcacctcccatgtttgcatgctaactggaggctgcctcttcaggtgtgaggaggcaactgtgcaggtggggcagggctgcctttcatccccctcctttcttctccagggatctggtatgctgagtttgcttttgaaatggaggtcctggccagaggtagcctggtaaatacagttcttaatctaaaaaaacaaaactcagtggggagagagtatggggaagaaggaagcattctccttacctgtggactagacagggagtgctgagagacggagcctggggaaagtcccattggtgtgagcttagagttccaggagagattagccacagccggatgctgacaagggtgccagattgtttcattatggaatggttagttatcacctcagcctcccaaagtgctgggattacaggtatgagccaccatgcttgacatggttcattttaaaagattacatctgggtctgtagacctcctcccatataacttggattttgtggacctgtatgatggcctgcagcacagcactgccagcctcagagaaggctggggtgtcagttcatgagtcaccccagagtcaacacaagtcagccccaccagccgcacagtgtgcctgctgtctattgcaaggtgaatgcaagatgattttttaaacaaatttgtctccctgtggctggtcacttggaggcctttttttttttttaaaacatgtatttacatcctattgatgtatcaccatcctgttggtaactttaaaaattttgtgtatgtaaaattgcctatctactaatttgacaacaataccccggaggtggaactcatccccaacttttggcctggctgtgagacatccctccttgttatgtcttactttgttgctgttgcttttgtttctccccacacccatgcccccatgggggtccttggccagctctactccgactgcagttgtagaactgggcagagaaggtatgacaccccctcccccattatacctcagaaagaactagaagtatgataaatgagtacgactgggaatttgttttttccactatctctaggatgttcatgttttgtagaatccatatccttaattctttttgtgtgaaaatgtagagcatacctagttctcagacccaattccatagattagaaaaaagtttt

SEQ ID NO: 1777 - DNA, 1040 bp, Homo sapiens
ccgggcgctgtgcgaagctagaaataactgggggcatggagaatgcggtggctgtaaagggccgctgaggcggtggaggcctggcagagagcgtccccgcggtcgcggcttctggcttctctgtggagcttggttcttccgtggtggtgcagcaccccaggaacttcaggaaccagtccttccttggagagctccccgggacagccacgggggccaagtgaaactagcgcgttttcttggatcctacactttatagtgagtcataaatactttaaatacaaagccaacaacatttgctgcaaataaacgtaaaaatactgttaaagtgtaaagtgttttcctccgtaccatctgacgtttctggcggttcgttgaacgcgagagaacgctgagccgtctgcactgagcccgggagcatcttcagggcagcgccgcccacgcgcgaggtgaatgaaggacacggcctcttgacactcccaggcagcacagatagacggatccatgaggaaactgggctcagagaagctaagctaattggccaagccagaacacaaagctctgtcagtctgtctgcaatgctacctgcatccttaacccttgtggtaactgtgatggtttaaggcaaaaacaagtgcctcaaccatgaacctagcaatgaatgaggaaagaaatctttcttcccctacaattctgctgggttttgcaatcacactgtgagaaactctaccctgagacgtcaaaccgagaaagaatgctattggctccaaggtgcggtttggaagacgaccgacctctattccgacctggaggtcagctttgaggatgcctctgcctgccatctttgggcgtgttcacaaggcacatttctttgaatagatttcagcagcgacgcattttcacttctgtggggtgggtgcaaaagtcattcagagctgagtctggtggagaggacgggtgatatgctgggaatactttttgctttaaaaagcatttaaagtacttaaatacttttttttttttttgagtcagagtcttgctct

SEQ ID NO: 1778 - DNA, 1120 bp, Homo sapiens
ggatcaggcaaatctggccataaacaagagatggagtctggctatgttccccacaccggtcttgaactcctggcctcaagcaatcctccctcctcggccttccaaagtgttgggattacacgtctgcgccaccccatctggcctaaaatgttttgaattaatgaaaacagtactgtaccaatcaagagaagtaggatggaggatctggtgaaaaagagattgcttctgacaagcctgcccgctgcgtggcttttccagctacactgactagcattgtgttcacctggagagaggagattctaaaccatccactccctgctgatccttagtttctggctggtgacacaccagaaggataggatggctccaatctccctgatgaaggggtaatcacctgactttctcttggaaacagaggcactggttcaggtccacaacattgaacttggagagcaataacctctgtgtgcacagtcactgctggctgaatcaaaaggcaggcattagggataaacactgtcttttaagaataggagtgaatgtctatacatttctgacaaacgcagttttatttaaacaaaaaaaaaagtggagactgggaagaccagagagggaggggcaaatgaaggggcaaaggaaagaagcccagtttctggaattattcaactaagtatgcttttaaaagctaacaaccacaaaaccctaagccaaaccctgtttactggccccttgctagccttgtgtgtttgcactcttgctccataacggcttgtaaataccaccatgtaaaaccttgaaggcaaacagaagacaagaagggacaagctgcatgtgctaggggtgaatgaagtatgtgtcaaggtatttggatggagatgtgcccagaatcttcctagtcaagcttaataaactttggcccaaggtcctctcctgttattgaaactctttcatctggcagaagatctttttctcagatccaaattggtgcctcccacccttccccaaactgaacaataaaaccaaaataaggaggaagcctaaaattaggaactgtaagcatatcactggtaaaataacaagacactgttggccgggcacggtggctcacgcctataatccc

SEQ ID NO: 1779 - DNA, 353 bp, Homo sapiens
cccagcgctggggagagctgtgcagaataggactggaggtggaagtgttggagattaacagccaggtggaggggacgggggaggccctgggtcagtcctcagggaacccccattgtgaagggggaaagggaaactcaggcccagtcctcaggggcccccagtctgagaggaaggaggacacacgagccatatttgcagagaaacaccagcctgcgagaggagggcttgaccctggggactgagaggtggagaagacacagtcccatctgtctcacggcagagacaggtttgggggcacacgtgaaggtttgacatatagtaaacacatgtcatggtggtttgttgtacagatt

SEQ ID NO: 1780 - DNA, 1074 bp, Homo sapiens
gcgtagcgaagcccccggcgagccgaggctgggagcgcggtgatggccggtccccgtgagcagagggcagcggcggcgggaccggggactctgggccaatgggtaaagccaggaggaagcccgtgcctggcccgttgggctccctcctcctcagagccgaagcagtccacactcggaacccagcttcacccggattaccgaggggttccacgcctggaggcagagctgcagcgtgggcccgctcgcggctttgcagaaaacaaataatgacacacttctctggaagcccggggcctgggcccagagccgtggcttctgccaaactttctggtcccggacaccaactccccgcctctcagcccgaggccacagcggcccagcaccctgcaccttttaaagtggctccaaaaaggagaaagccaaatagatcagggtggtaggcgcgagtgcagggagctgcgaagttggaagattactgcttttcaaactgccaaagagcaaaatactaagcgagaaactccgtccaaagcaactggaactcgaggttctttactaatgagagttccagttaccatcttcagagaaaggagctcaaaagagggagtttattttttgcggaatgtcttccttgttaagaagaaaattaaagattaaaaaagaaaatgaagggtctggcaactatgaacctaatggtgccctaacgtttgctattctaaggccgagaatgccagatggggagaacgccatgagcttttgagcttgtgtattttgcgagaggctcgagtgtgaacagtagactacaggccttgagactgagaaggaagctataaaatgtgggccaagggaatgtctgcaggaccgggtttcagagcaccctatcgtggcggataaagagccactaacagcttttttctttatttagtagccaaattcttggttggcgctttgagaaaggagtaagcattaagcgaatttaaccaagtaaaatgtatcgtcctgccctttgtagtcccatagttcactatcctagagatacctatttttcactattttattaaagtgtattgaaaacct

SEQ ID NO: 1781 - DNA, 1239 bp, Homo sapiens
ccggggagcaggcgctccagcagcctgcagaggaccaccccatccttcagcgacgcctgcagaaagccctccgggtccgagatggtttttttgggcgactccagcacccccagagtgatgagccacgtaacggtggcggggacaggctgaaaacgagacgtttgtttcgctttgctaccttgcaagccggtcatgacggaacagaaatgatggttccatctgaagccatatgggtctgaatcgggaggaaccgactctccggagcgcggcgccgacctcaccggcagggcaggggcctgcgcgactctgctctagacggacggtgacgcttcagaccctgccgggggaaggtcaaggaaacggcgtggcctgaagtggggctgtgcagagggccgggccgggccgggccgggcgcctggctgcgtctcggggacgccgaagatctgggctgtgaaagcagcaggccgaacctggagagcccagacggcaagtgtcgcgtcatgcgcgagcttcctcgaacaactgatgacacgcacacattgacatgcgaggaagaaatggagcctcttcttaaaaggacacgagtctccactcactccatccactgtccctgggcgctcccccagtttgctcgctatgacccgcgggcagtttaacaagcaaagcacttagtctatgccaggcacatacattaatccattcaatgacaaaggctagaaagcatataaagcttccaaaaataatcagaggcttaagtcgtctccccctgccttctgccggtggatttctcttgcaatcactaattgcttttatttctagccttgagttaagtggttaaaattttctttgcaaatacaaaaaatattcaaatggcagtatgaattctggattacgaggacaatgtgctcagtgataacagcgactggttaggaaccgtcacaaagtgctgtctactgcctcgcctcccatcatggtccccttttactgatcagatgccgaacaagtggcagagataagacccaaagctcggctcctaccaggaaaggcatacctaacccgtttcctactgctgccctataagctttctaggaaacaggagggcaattaacagctacatcaaggcttgtacccagtgtcttcgtggaaggaaagatgtcaacccggggcgtggttgtacaccgagacttctgttcactttccttactgctgaattagagaaataatttaatgcagtcctta

SEQ ID NO: 1782 - DNA, 363 bp, Homo sapiens
tttctagtataaataaaaactactcatctccagaaaataaacaatgactgctaagatgattgaaaaaagaaaggagaagaaagtagcttgtaaaagcgtgtgaaatgcattcacgttggaatctcctacaggcacttcaggtcaaagactaccgatgtccagatcataatgcgaggacagtttgagcccagtgctctctgactgaggtagaacccccgggaaggtgaagagggcagccgtctgcgaaacagcccagcatttaagaatgggcagcacctggccaggtgcatttgagaactaggaatgtggcaacaataacatttatttatttggatgaagagaagaagatgtattggattccct

SEQ ID NO: 1783 - DNA, 751 bp, Homo sapiens
ctcctctggatcttttctggttccttcgctcctagaactgtgtctgatggcttatgaaggcaaatgacaaatgtttgccatatgcacatgtatgtgcatgaatgaatacatccaggttctgacttcctcggggcaacctctactttctcaatgcccctcttaagatgggggtgggggagggtcctcctagaactgaacatgatattccaggtgtgatctaatacatttaaatgtccaaaagctctttcttccctaaacgttcctttttaaaagctactgttctcaattaatgggtgtctcatcttcttaagtatattaataagaggtattttgatgtttccctccattctgtggattacctcttgattctctggattctttgtgattccgttttgttttaaggatgttctcaggtgtctggtgatccttgcttataagtccaaattaatgatgaggcactaaaatgctgattggaagctctctgtgcaggccttcctcacacccatgtcttcagatacccaaggcctttaatacccaagtccttccaggattctgcacatctcattagcttcatattccctctatttgaaaagttcatatggacccagctctgtcatcatcacatgttctatatccccaaaccttgtgacatctgcaaagaagtacagaagacctcaagagaagataagctagaatttatttatttttataccttttattcagtttttattaaagctttcctacctttcca

SEQ ID NO: 1784 - DNA, 7000 bp, Homo sapiens
aaaataagtaagtgaaagaaaggccaaatagcattattcatttgccttaggtttacagggtcacagattcattagcttaattacaacctcatttggatgccaaagaatgagcaagagcaatcagtattgctacctggctcttgcttcttcttcctgggtttgttttgtttttcagagaaacagggaagggaggacattttctaatataattgtttatagggacaaattgttaaaatatgatgtgtgtgcattttgcaagtttgacttgtgtaaaatagattacctctcctgtcttctttccttcccacactgtataccatcctgcctcatgtcaacccaatgaaattgattccattatttttcctctttcttatttccaaacctcataggctatcttgcctatgaacagttgaaagttttgacttctttggactcaattgaattcactaaaacaatgaattttaataatttttttccaaattcttattcccattgcctttaaaagtcctttagaggcaggttgtataatcataatagcctcctctgaactgccttgagttgtttttcttttctgcttttctgtcacttatgtaaagagtacatgtatttacataaaccttctctgtcccggcctatttcaaaataaagtggaaataaaaatctttagctcaatcttacagaaatttatattatctaccccagagtttgaagataaggccatctccttacactataattgtaatatagtgaacttaaagtgtatcaatcctttatcaaacttgtttattcattagctttttcagtctccagtaggcccattttacaatttattattattcctcctagaagggcttatcattcaaatagcacaccactagttacagactatccttgatccatttcatcttttttgtatattacccccattacaaatttctacttctatataacaccctacccacttcccctcagccttgcagacagcctgcaaactgtctaaatttctcccataaaaatatgtagaacatctgtttcctctagacagcatttatatagatttggaagagagttctctaaacatataccaaagagtatgcagcctaacctcgaaaagttaacaataagtgagcatcatgatggagagagggaattcacagtggatggaagacaccttggaattattaatatgattggggacctggtcttggtgctgtctctgccactgcctaggagcatgactttgaacatgccaccagatgacctccaagttctcttccaaaactaaatttcaaaggtaattttagagaagttcatttgtatgggaggttagcagaaagatacaggaggaccatggcctctgctaacataacccaactaatttggtaataattcttgatatcatgtctttgagagtaagccatctggtatcaagtgaattgaattcaatacctattcatgttcctttaaaaatatataggacatacagttacatttgcaagccaagtggaaaaatgttactatttttgtaattttctataactacaatatttccctttaagagagagtctcagataatacaaatcctttatttttagatccctggaagataaagatgttcttaaaccattctctgtaattcaattaaggaacagccatgcaacaccccatcatgggtagaaaagccaatctctaggcagcatctaagcccaaatgttgttgcagtgccctcctcagtcttggaccccacactgtcttgtttcctgaaagtagagtagcagatatttttgagctctcaggcaagaagcagctttccatctataatagttggaaagatccaaggtctttagaacatctgttatccactctccttgctcaagtccttccaccccggcttacctagttaactacttacctagttaactacttacctagttaaatccactggtgttaggcacagccatgacaaaactgacagtttattaatttgtgattagcattctagctattcatgttcttcaagcatgcatgaagaattccggtctctgaacattgtcctcaatacaacttctgtaaacagatgttcttaactttttcttctttgttgaaagataccttccaactctaaactttcatgattttcctgagtatttcctggccattcaagctttttccactctactaagctgtctagattttatccattttaccttgatgatccagattttgggcagttcaaaaatgagtagagagtaagggggaagagaactattcccactcccaacagataaatatcatgctcagtagacactctgtgtccagttttgttttctgctttttccatctgttccacccacttgcttacccatacataaaagcctttccttagtctcttgagaaaatatatagaaggaaagtttgcacagcagcaaaatagcctgaaatgtgctccagttctttttggttaacattattgtttagaccatatgacccaatttgcctcagacagtctcagtgtgtaattattaataaaactccttttcactctcaaaattgtccatgtgaataataaatgatacgaccaccataattatgggatctcagccacctgaagggtggggaaatattaataaatgtaacattaacacactacagaaaacatgtcttggctccctacaaatcatttaagtctggcccagtcttctccaccactcgttcatactcaccttatttctccatgagttccttaattagctgcaagcaagctcatcctcaggtcttccttatccttccactccaacatccacacatcatcccaaaatgtcctcactgctgtgcttgaagttttacattttatttccactgattagatatttttcttcctagccccatctcaatcgtggtttatgaatcaggccaacatcctcaaaaatgctgtccatgagcaccctgcctcattctgttcactctcctgttaacactccctcaattcttgtggtcactttattcaataataatagacagtttatttgcacatttctagttttgcaaagagatattctgcctccctttgtgaggtccttaaaagcaaacaccccattttctaattcttttgtattgtccaaagcaactattgttctgcccatggcagggtctataaatgctgattagatcacctacagtgggaaaggcagcaaaagacaaacactttttcataacaggcaatatttcaggattatagataataccttgtgggacagatgacctcctctctcaaattattttagtcccatagagcctctatctacaacctctcaaagaataaaaaatgcagtcaaaggtacagttgaatccaggtttgtgtcttgcaaagtggtcattaagatttttttctactgggattttccaagcagactgaatcctgataataccaccaatctagattctaccagttctagaagaattgaatattccttgctaattaccgctgcttttcctttatggaaaaaggaaagttttcttttatagttttttcccctgtttatcattgtttgccttattaatggccttttaaatctaggttctacagggtatttattcttgaagctggggctacactgtattattgatggaacattcccatgtgaattctaatactcccagaaggtactgcacaacaaatcctatttctgccaagatataaatagaagatttagaactatataagagggatggacagttcttgacattcaccactgcttctcaagagtgcataaaatataatagatgtacaaggaaatgcattttctgcctccacccccttttttcaattattaactttccagttgtcctgttaaataatttactaatttgcataaaagaaatatataatttgcaagccttacctcagagtggcaaccagccatcccagtttactagataacgtatttttctacctgatactcctcaaataaattgaattgcagtgtatctgctttttctttttttaagctaattaattcattgttgatctgtttgttagatctttttaaaatactcactggataaagcttgaaattttacaacaatgcccctgagacaattttagggaagtcctttgattattctaacttaacttcagtgtcatggaaaacagaattatatatccaagtgttctttcatattcagaacatccagtactcttccaagaagggaatgttcatgattatatacacatatatttattgactgtgttgctcagcttcttatctcaaggagagtcagtaactctttttcttgataaaaactaccatgtcagccaagcacggtggttcacacctgtaatcccagcactttgggaggctgaggtgggctgatttcttgagcccatgagctcaagaccagccaggacaacgtggtgaagccccgtttctacttaaaatacaaaaattagccaggcatggtggcgcgtgcctgtagtctcagctactcggagggctgaggtgggaggatcacttgagcccgggtggctgaggctgcagtgagctgagatcgtgccactgtactccagcctgggtgacagagtgagacactgcctaaataaaggaaaaaaaaaaaaaaaaaaaaaactaccacgtggcattatacaaagccaagatttcacaacatttttgaaaattccaaatgacttacatgtttacaaggaccaaaaactttttgatattttaaaataagctttatcctttttaaccaccatgcagcatgctgtgccatcatgatggaagcctgatggctaatgtgaaataatgttggcatgtcatttaaaaggttaacagacatgaaaattgggaagtttaatattgtttaatacaaataaaattgtttttgaaagaaaggcatctgtgttgagcgtggcttgcttgaaaacttctcctgtctatcatctctgaacattattttgctcctcttgactttactcaaggggcctaatcctacagtgattcaggaggtttgagaaagcaggactcatgagactaaaaattaggaaactactatcctgccagcaatgggacacctctttggctaccacctcacctaaaacttcattgaatcagaaaattagctgaactttccacaccagtctcctgcaattttaattcatagcatcctgtactaaatagctggggctttcaaaagcaggtgctacgtatatacagaaagaaatacataccttctgttgcctctcaaaatccgttatgctaaactcaccaaatacgttacatgttaaatgtttcattccttgtgtttttagatctccagttaccaatttgctatctatcctcctaccaaacattatttaaccaactcatatcctgattggtattacaattcttgtaaataaaagaatccttttctccctctttatttttaccaagtagacttctttcattgcaaataaacataaattacaatattttaaggctctttgacataagcatttgctttcttacctaagcaggtaatacttttgtatacctaccagacactaaagaagctaaatgtcaagagtgagtatttcagtaaaacctgtagaaattttaatgaaatgggacaggtttaaaaaaatgccaagaaaggaaaaggtggactccttacttttatatttcaagttttctattttgtatcaatatatgctgcattttctgattgaaattgctgttctgtctaatgaaacttgtgattttctgtagttgctttttacatttgaaagcaaactttcatactgtgtgtgcttaactgtaccccttctgttagggatttgattaaaatactctaaccgtttcattaattcctttttatgtgcttaatgtatgtgacatttatggctttgttatctcaaaagctatctgtggacaaaatccatgaagcctgttgactgtgatttatacacgtgaaagaaaaaaaccaatttcctcctaagcagtgaatcagtgaataagaaactgttcagtggcctctgattcctgacccttttacccttcatggccttttttctattcttaattattccttgagtaattgtgtgttcttgtaaaatgcaaaatcaatttacatgcaatcaggtatggacacaagaaatgcttgtgctctcgatttcaggactcacagataccataacagtcacgggactgtagttcactcagtattttttgttaataatgtggctttgctataaaataacttggtgtttcctttgctttggtactacaagattttaaatgttgcagcaaatgaaagaatgaaaacacatttgaaagctggtgtcaaaaatcatcagctgtacttataaaagttgttgtgcagcttctgaaatgtagtttattgctgtaaatatgtacaatttatgttagctcgtttattctgaaaacacaaataaaacttttttttaaattacaaatgcctacatataaaaagcttactttgtactacgttttaaaacatgcaagatttcaggcatatctttttataatccttaaaaatgtttagaattttgaatctatcatttgagaacttttattacaaaatttaatacaaagctacatccctttatttggaagaaattcatttcaggattactcaacaatcaaaaaaaaaaaaaaagataccagcacatttccaggagcttgtgtctgtaccactttgatttttttaaatattatttaagatgacaacatgccttacaaacacttaaacatatggtgtgtttatactagaaaagaagaaatgaacagtctccttgtattcaaaaataatgcctaaaactgacttattggcatccctttgtgaggtgtattatgtcaaacttctttgaaaatctccactgtaaatatgaatattagagttggcctatttgtcagactttcctaatttgaagacctccaacttccaaattaattctctcccttgagaaagaatgtgttgacaataaaacaatgaagagacc

SEQ ID NO: 1785 - DNA, 150 bp, Homo sapiens
atgccttaaacttatgagtaaggaaaataacgattcggggtgacgcccgaatcctcactgctaatgtgagacgaatttttgagcgggtaaaggtcgccctcaaggtgacccgcctactttgcgggatgcctgggagttgcgatctgcccg

SEQ ID NO: 1786 - DNA, 500 bp, Homo sapiens
ctcaaaaatgtcttagaaaatgaattattttataaaatgaaacccatttatagttcatgaaattagagatcagcaaatttgggtcatgttcaccttgggtacaggaaaagtattacacatgtcttacttgcatttctttttttttttgagatatggagtctcactctgtcacccaggctggagtacagtggtgcaatctcggctcactgcaagctctacctcctgggttcacgtcattctcctgcctcagcctctggagtagctgggactacaggcgcctgccatcacgcccgggaagcagctccacaactaccacatctccatgaattgagcggtttcgagccttcatcccgtggattaggatgtcactgactaaatctgtgtttggggcagcacagaaaaaacccataaagccaagggaatggcacaccagtgaggcattccgcgcatgatatactcgaagtctaatcagtactcctgcaagtaaagctttttctttt

SEQ ID NO: 1787 - DNA, 537 bp, Homo sapiens
gaacttttcactttcctgtcctttcaagcaacagaaatcaactagcaatcagagagtaacctacccatcctcttgggcaaaatttctttggttcatgaaatgctgcaaatattacacaattccatgtttcttctttttctaaagagggcagcaactgagtaggcattgaggttgagtgtaagaaaattctcccctactccataggtgctttcaggcatcatggctaatcagctagaggccacatttcccagtctcccttgaagcttgttgtggccatgtgatcagcttcttgtgaatgggagcttgagtagaacacatgactggttaactcttaaatcgtgctagacaaacctctccactgaagtactaatcaacttaaaatatcaacgtacccatggagccaaagcagcttggggagtcagaggaggtctcagggaaatagcgatgcttcaagagagttaaaggctataccagcctcttcccagagccacctttgcacaccttcatttgtgcacaaataaatctattatgattata

SEQ ID NO: 1788 - DNA, 1738 bp, Homo sapiens
gtgtcctgctcgctccatgttgccgcctctcccggtacctgctgctgctcccggggcttcgggaaatgcgagagtctgagccggggaggaggaacccgagcagcggcggcggcggccgcggcggcgggagccccccaagaggaggaccgggatccatgtgtctttcctggtgactaggatgtcgtcggaggagaacaagtgcgtggagcagccgcagccaccaccccccgaggagcctggagccccggccccgagccccccagccgcagacaaaagacctcggggccggcctcgcaaggcgcttcccctttccagagagccagaaagaaactatttggagttttcctggtcttactggatgtcactctcgtccttgccgacctaattttcactgacagcaaactttatattccttcggagtatcgttctatttctctagctattgccttattttttctcatggatgttcttcttcgagtatttgtagaaggctcatccacaccgctcagcacgaaggccttgttctcaggggcctgcttctcaatgaggcggatctgcttgaggttggcatggggcccaatgcccaccgggatcacgatgaccttcttcttcttcaggccctggacgtagcggacaaagttccgggacatccgttggggctcctggctggccatcaggagcagggcgatgcggaaggcttcagggcggtcgatcttgctgatgatttggaacagtgtgtatttcaaggcctcgctggtggaggccacctggctgcccgcatacttcacctggctggcaacgcgccgcagctctgacggtcgcttccggtccttgagcccgatgtaggcgtgggagccgtcgtggtactccaccacagccacgcggacccacttctaggagatgcgcagccgctccatcatgtccaccacaaaggccttcagcacttcaaactcagcctcggacagcctggaggagccatccagcaggaagatcaggtccagtagcctgctgcagtagaaatcgtgcaacagcggttctgagatgtcctccacatacagagtggtggggctcaccggggcatctgtgggaggtaccaccaggcctcccggctcctggcaggcttcacaggtgagggtgacaccatcacagtggctgcagaaaagagcgaagaaattaaaatggttcagaaagaacctatggacacttctgagccctacagtgtatgactacttccatattcccacagaatctcctctgttccacctgaacttgagatcccacggaccattccacacccaagtgagatgtcactgtttaacatctgtccccaaatagcatgcccccccacttcaaaacacacacatagccgacttcctttgattctagaaaccaaagctttagcccatcctaggatatgaaaaaatatactcgttgttctaggccatccacacagccactcaaagctgatttcttttcaacctacatctttagcaacatgaatacttaattataatctaagccttcttacaagtgtctccaagaacaaatgttactaaaatgtagacgctaacctgtgcttgtacatgttctgttgaagataaatgctttacagtacatattctaacagaatgtaaattgcatgagttttaaaacatgtttaatacgttgggccctaacgaagagagaaaaaattggagcaaaaacattgtggaaagatgaataaagattcaaaacccca

SEQ ID NO: 1789 - DNA, 633 bp, Homo sapiens
ccctccagtccggcgccggatcgcggttgcccagcgcgctgtgccctgccgggggcgggccacgtttgatctccgggcccgcagcaagggatcgcgaaggtattgatctaggcgctgctgtgaagggaatttgcagatgtaattggcctaaatcagttggctttaatatcaggaaattgtcctcagtgggcatggccatatggagcccttacaagggactgggctcttcctggtgaaaaagatttgaatcacgagagtggctgatatgagggaaattctttgctgttgccttcgaagacagaagaggtccacaaggcaaaggatgcagacagcctgtaggagctgagactggctcctggctgacagccagcaaggaaatgaggacctcagtcctccaatcatgaagcagactccgacttctgctaacaacctgaatacacttcaaagaggattctgagctccagccgcctacacattgatttcagctgttgggaccctcagccgagaacccagctatgccgtgcccagatgtaagacctacacatctgtgagcttgtaagtgtgtgttgctttaagccactaagtttgtggtaatatgtttcactgcaatatgaaactaatacttctgtgtgc

SEQ ID NO: 1790 - DNA, 11799 bp, Homo sapiens
ggacacctcgggggtttcctgctttatggcgaaggacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattatggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtgcatgcggctgtggtttgtgttcacacttctcctttagagtgtagtagacagaacatgcctgaactgcctggggctgaggggtctcaggcgcagagtggcccaggaattctgagcaaggacagaatgttagagagaatatcctgagctgagcagagaggcctgcccatgctagctggcagccacctgccttcagtgcttcattcttgggggaccttgaggccagttcttgagtggatgagtcctgccgctactgctgctgcccacttggtagctctgtcctcatctgggaagagccactgtgaaccccagagacctagtggtgctaggggctgatgcaggcaaatgactggctgcccctggatcttatgtgaaaacaagaatgctggaccaaaaggtctctacagggctccatgactacccatgacccgtaacttcagtgaggagctagtggccaggaggggctcatggttggacactggtattcctctactcagaccttaaaccacaggttgcaagaacagggaggtcacatgtcagtgacctcatgcctaaatagatgcatagcacagagcagattcctggatagcttacaccctactttccccagtgcatcgattatgacttcctttctagcaactgtgagtacagccgggactcatcaatcacacctgtaacttcccagctgcatttctcagggtctctgaaagcagggccttctctggtctttttaaattacccacagacctaggacagtcttctgcacatacttctacattttaaaggcttacttttagtatgtttatgtgtgtgagatggggaatattgtattcatgtgtgcatgtatatgtctgtgagtactgtggtctgtgtgtgtaactgggtatgactgtgtgtgtcatatggatacaggggactagaatgaggacagccaggtgtccaggctataagatctaaggaggcacttgctctcagggccaaccctgcccttgcgtgagcctgagagagagagcctcctggaattttgcaccttgagtgccttcctgcttcaccctaatccccccggttgtctgtatgtttggatgtgagtgttgtacatatgctgtgtatgtgtgtgcatgcatgtgagtgtgcatgggtgtgtgtctgtatgtctcagcagctgtcactgggcttcccagtccctgtcagcaggcgaaggaggccccttcatttccttgggtcctgcttatgcagcacaggccacagcaaaggctccctgggttgggtcagccctcactctaactcaacatgccctggaagtcaccacagggtcatggaaagagtcctggtgatgagatggagtgtctgctctgccacaagggctgtgggaccagggtcggggcatacctctctgggtctcagtttcctcactggtaagatgtggcaacagaatctcatctgtgagccccctctagccttgaacaactctggatccaggtagaccagcataatgaaagcctatgaagcttctgagatgtgcgaggcatacattgtcccaggtactcaagtaactcaagtctggaagctgcgagccacagagatcaagccttctccaaaaattggactgcaaggcatgccgtacaaacagagtgctaggagaccttggggaggtggggaagaggaagaggaatcatggacagcttcatggggaggtggctttggagctgggatgggtgaggacagctggaatgtgggcagcacgtgaccaagtgctttgcagacatggcatggcccccagccaggccctgaggaaaggagagtctcaggacagcagctatgtcactgtaagcaggacccttgaaagcaggtgccacctgcaaaagggggagccctgaggcccaggcaggcctgtcacagtgtggggcacctgtctagacagccccatggccagcagtgggggtgggccatgggccatggggaccttcctggtatggggtactgccatgtccccagggaatatggggggcccaggaaggtccccaaggctcgaaggacccaggtcttttcatactgccaaagagatgtaaggcctacagaggggaaagtttgcatatctgtgaaggcatggagcctaggcattggaagtgtccagtaagcattttcatttggcagaagtatctccatggcacttctacctacagccctgccacattttgccacaaactgtccagcagccctgagatggagccccagtgtagaccgtcatggagcacactggctctggaacaatgaggagcagactggagaaagccagatggggtttacctgtcaacagccacaacatagttgtgctggggtgactgttcaagaaaaatgaactttggtgctcctgccgaatgggttgttagtgttcagtccttttcctaccactgagttgttttgtctgatcattcttcctcctggttctgcgggtctgccttcttgaaagggaagagcaagactccagctccctgccctgtagaggtgccttctaccttgctcagtgttgaagcaaaggagcaaagcaaagcttaagtcagagatttggtgctcagctaatcacagagacttttaaatgtcaaccagggtttgctatcaggccaaagctggattattattacccaaagtagaaaattgtgagacagaggcaggtggggagggagggagagagaagaaagcagaaggtggaggatacgtggatttaattttttaaaaataaatatatgattccgtgtcaattaaaaacaagtaccccaggcaagtcttcctgcagtcctgtcttagccgcacacacagcataactgcaaacccacttgagctcatttttgctcaaagaccaactctattaaacccttagaatgttctggatttcaacacacagtccacagacagccattctatcaaaagcttagtgttttccctatgactgggttttctggtaaggtgaactaaggcatccttttccatttcaggctgtggtaacagcagataacagccgcagaggtcatagccagcactttctatgcgtcccttcatttaatcccagtactcctaggtggtagatctattattttgtccacatgaattattgaaaagtctgtcctaaattttaaatggaacgaagtactgggttgcaagttactggtggctgtttcacaggaaatactacgacaatgggactttgggaatgtgttctggagactccactccttggtgactactacatggagcacagaaaattgtcttgagtggcagctatgtgccaggtgaggagacaggttttactcacatgactccccagaagccctgcagcatccccatattttataaaggggaagtacaagcccagagagacatctgacttgactaagttcacacaaaaacagcaaggtctgggccaagatggaagcccgggctttgccttcttcttctgcctgcagggcaggggctttcatcctggcttcacgctgatttcaaaagcctctcattctcttgacacctcatggcccctgagtttatcccaagaataataagttctactgtcctcctggagatgccgaagaatcaaaactgcaacacacagagggcctgggtgtgcgcgaacactgtagtacacaccgatgacagcagattaagccatttctctcttaggtgcgtcacccaaccagctcctggacccttctgctgtgctgccctgacagtcacaatatgtcctagtggactaattagcactaactacccatgtcaccccaaggccatttaagaagacaaataaaaaagacaaaaccaatgagtattgtggctgaagatgacgaaaaaaagttaaaagcagggaggaatgaattattttttctttctcaatctctccctctgcttaaaccaaagagaggttttcatctgagagcccgggagctaagcagctactttctacatgaaaaagtgaaaacattaaaataaaatccctttctttcaagctaacgttctaaaactgaacctctgcagaggctccaaaagagaaatgccttgcttttaagcccctgagtgagagggatcctgaggaagtggcagaggggatgaacctaagctttgggacataacaaccggcacctccagtggccaccactcctagctatgctgcctgtggatggggcccccagtgctggcccctaacagcatggggaagcctccccagccactctgaagctgttcgcatcacatccaagatgaacctaggcagggaggctgagtgtgcttgggagatgccaagttagggaagtaagttccccagggtccttcaacttgtggtgcctgaggatagctgctttttttccagtgcagatggagacacggcagccttggggggatgtgtgaaagtaaggcctccctccctctgcctttccaagtggctgatcatctccttccttctcatagctacttctaggagaggcatccaggcaggaaccacttctccatttcacagatgggaagactgagaaccatactggaaaggggtgtattttaattaaactggagagtggggaacactgatgaggaaagcaagctgatagacggaaggctctgcctgtcactgccagcacgggcacttgggccttcttatcaagggttctgatgggagtttccactaggattccaggtgtcgatcatctagtagccgagttctgatgagctggactttgggtggttgaggtagggagcagtggaaaggggaattggagtcttatcaacctctttgaacaccagttccttcccctctcttctataaaaatgtcgtagcaatacctgcctggcagagttgtgagaattaaatgagatgatgaatacatctgctctcagcaccacaccacacctgtggcagtcctcagagagaagaatcacagctttcattcattgagagctcactaagtgccaggtatgctcagctcttgtgcagacgttctttttctttggatgtaaatgtgacatgggcagagcaggaggagctgtgaggctggcttggctgagccacagggattgctggcatcttatatggcattcaggactatggagggtccacgggaagaaacacagaaacagaacccaagtatccttcggggactcttggactttcttccccttgatcttagacatgcctcagtaaacagatgctggtttctatcgagactcattcctggggaaggacccccaccagccaagcaaggtaaagcccagactcagttacatgaattacaggtttaagacagaagccttcctatgaatatttttctggccagtggcttatataagagaaatttgctcattgtatttctatctggccaacgaaggggtctagaggggctttcagcaacccaaacagtcttgtcagccctaactctggacctaaggaaataattatgaatcctcaagatccatttaaaagtgtcattactgtagataaacaaagacgagtggatgcttcttcctactccacctcactgcagagattccatccatcccagggtcactgaccactgactggatgaactaggattggtgtggcagagtggagttttcaggagccaagagactcctggattgtcatgctctgtactccttccccacgaaaggaatgtctagaactcctgctgaaagtagtcattgcctgcatttcctaggcagaatgtgttagctccctccccagaagaacctgggcgaagaaggtgttccaatctgcatttggaaagaatccctcccgcaaagaactctacaccctctaagagaagataacgtgagggcatattctcctctcttagagggtgttttcaatactaaattctatctctgaagagaatgaggacccgaaggggggcagtgcaccaagttttcaactaaaacaaaagcaaaactaatctgcagtcttgaaggtgggctcattcattcccctgcccccactttttaaaacattttttttcttaaatgaaacagtttcttttatcttttggcttctcgtgtactcagaaccatagagctcaaagcttctcagctcaacggagaactcagcacttcttggactgataaatagagcagctttaaaatgcttagaactgaagacagaccaactgtggcgagagaaagtaaacacatccatgcaccagtcaaccctagcaagctcctcgctgagattacaaactgcagttcctgcctgagccggagaggatgctggagcaggctgggggaccagaaccacaaaccagccctggcttagctctggcttagctagctgtgccccagaagagctgggtcctcagggagtcttcttgcggcccggtttggatgttcctaagcatagaagactctgccagtgtgtccctcattcgtttcacatttggaaatgtaccaagagaagtgggaaccagctttactctttgatctagatgggaatcctttcctttgcattcaagctctctgtgtacaggtgtaacttgccagtgagagacttgggatttctcacaaaatagaatgtgataacgacataatttgatatgaatatttgaggaactttatctctggacaatatatactttaaacatccccctccccaagtcacacacacaaattgtttttatgagaaccaattaataaatgctaattcattgaggcatatcttcactaaattactgtttcatttaattgcagggaattttccattactaaactctcccttgctgatttttttttgcattatttatatactctttcaatttcactaatagtgaggttggtatgtgatattatctgatgtttgtacgtcttaaatttatttttcatttaaaatatttcctcattcttgcagctccacataatcagggagaaacatcaataaaagcaggcaagattttacaataaatggttgaaaaaggcactggctgaaattaacctgacaggaacgcgtcctgtgtgattgtgtttctctcattccagacgtgcgtgtgtgtgcgtgtgtgtgtgtctctactttgggttaatgtgggaatgctttcctatatcaataagtcacaagtcgatctgtgaaaagattgtgcatacaaaatggagatgaagatcacaggggctttaataataaaataaacataaacaacactcgaatctctttataaatcccagagcacaatgtgcgttttcttacttccttttcatggaccccagataaagactttgacagccagatatccaagatccggatcagccagcttcctaaaattctcctctttttttttaaggggtagaaaactgggggtatcccttggtggttaggggttgcttagagactgtggtagagatttggtgttaacaaaaatgtattttgaaagcaggatttcaattttcttatattgaatggcaaaggttccatgcacctggctatcttcatttctgaaatgaatgctttcattttattctctccagctaccttctccctttctttcctttccacccccattgcctcctttcagtgtctttctttttctccttattctttcactcctttctctctcacagcaaaatgttctggaggatgtgaatgattaaactgtttactccaaggtttaggtatgaaaaggcaagtcactgtaagtaaagtttcacctttatacccaactccatcaataattacagaacaaggatgactattagtaaatctttcttacaattggctcttacaaaaatgatttcattttttctgggcataccaagtttgacagattttacttttcacaaaaattatttacacagcagaggaacctgctccaaaatgaaggaagcatataaagggccgttgagtgtatccataggaaaatgaatacctataaaatgcatctcaataaattagagatttgaggccataaatagaacgttttgacatattatattagtagatgccctctaatttaaaccaaagtgtcccttagtaattaaaattccatgagattgattttttatttggtttccttcacttcctttgtcttcttcaacaaaattaggcagagtccttttgggggtagactgataaaattaattaactttccttccacccccaaaaagttccaaataaatgcttccaatagacatcaaaaaagtgtcaattagaaataattacttcttatcaatcagtggggcaattaaagtgacaaagcttaaaaagatacttatcttaaaactaattcacaaggtagctaaattatctcctaattaacttgcattgtggagggtgggggggaaccatcttgaaacaaagatgaattgatgaaccccaatacctctttatgttcctcaaagttgcttccatcccctgaaaccttattttcaacccaggcaggaaacctgggaagaaaacagatcctttccaaatgcatttattccactttcctcaattctaaaaccaagagttaggaatggggctttagatctcacatcagggaagttagagacatcgtcctctgccttgtcttattttaccacttgaatgaactattttcgggactggtgggagtgggctgcgacaagttatttaagataacttttaatgacagccagcctgcttgcttttacaaaactctcttcctcattggtacagtattgttttcacttttatatatatggggcatttatcgtttcttctgcatctttgaatttttttaaaaatgtttttgctttagagaatttcgtccctgatgcaacaaaaatagcgattttaaggaacgttcagcccatcgctgacctgcgcacgttaaaatgattcgcgttcaacattcctgcagaataaagctgtaggaaagacaacgttaagactctctgcaaggcaagaccagccaacgacgaggcgaccccgtggcaggctgggcggcggaggccgcgcggggaggttttctcgagcgtccccggttattgggaagggtgcgctcggcctcgctcccgcggaaagccgtgtggccgcctgcgtcccgggctctgctcacagaaaactcaaggggagctccctaagcacggccggtctcaggaacagaggtgcctggggaaaagggggaacctgctaaaacccgagagataatgggcttgtaaaaaccagaggggtccgcttatgagtttagctccggttatagacaacagtgtcaggtaagctgatcagaaagacagacggcctctccctcaggtttgccgagggagggttcagaaaagaaacagggagcgccttcagcagtctatgcggttataggccattttcttgttttattagcgtttaaattaaactatgagaagaaagtctcatcttccctccctcgccactttgtctatttgttttggaaagagggtagaagaagcccctctgtcttcccgaaaagaagaaaggggaaaaaaattacctggtaggtccaggggcagagggctccctcccaaaacccaagcgcgatttgcatccaagctagtgggaaagcgcgcatctcatcatctgggactgttcctgattaaaactacagtaaaaataaa

SEQ ID NO: 1791 - DNA, 572 bp, Homo sapiens
cgtttcccctccttgtgcttttctctcgtgtgccatgtgaagaaccttgcttcctctttgccttccaccatgattactcttaccagttgttttaattgctaagacaacccagttctgcatgagctacagccaacttcacaaagcttcaggtgcctggatgttgaggggcaaataggactgttcactgaaggagctagagaatggaagagaaggttgtgtcagatagaaataacagaagctttctgaaatgaaaacagaaatgttacaacttgcaccacagtactggactgaaacgaagatgtaacacagccataataatttaaattaatagcaaataaataaagaaaaaaagaacttcattgtgaggaccatagtcatgggatagctctgtcttttcggggaaagtggagtagagggacagagtcaccccaggagaaaaaatgcttaaattaagactccctgagagactgaataagagtatgattagttcagccttgctttcatcctccacttccccctcccactgtagacttcagttttaataatgattaaagaataatgcctgaatccca

SEQ ID NO: 1792 - DNA, 545 bp, Homo sapiens
ctctcgccccgtcgcgtttatcgaggagacaggtgaaaactgaggtttagagagggtaaataacttgcccaaaatctggaaaagtttgccaacccctggtcttactcctcattaaggtttcccttcctctccaccattcccaaatctgagtattccagaagagctactgtttttttaatgatatggtaaattaatttctaaagggattaaaatgaatacctacctgttgtaatgaaaataaatgtataacataaagcaatctgcaaaatagtaagtatacactcaaaatctgttagccattattaccattgttattatttttattttcagtccaaccaacactgatactgctgaactcctttttttttatggagtttatggcacatgtttaagttaattaattatgtaagatacatatatatatgtacacatggtaaggtggagcggttgtgataataccacaagctgcctgaaggggcagcccaccctagatcctttcctaactgaacaagattccaaaacaccagtacctctggtaagtggaa

SEQ ID NO: 1793 - DNA, 2319 bp, Homo sapiens
aagcaagaagggacttgccccattgcacaggaggggaaaccgggactgatgatgaagcagttaggctgcagctgctggatgtgtctcctgatccctgagacccactcctcccatgcatcctcagagtccctcaaaccccacatccagagccagacaggatgaagcgactaagacacagagcactgaagcaatctgcccctcagaagtcccccagaggcgcgtgaaccctgagctgccccccagactctgggtttccccttcttttccccaaacagccctagctccccccaggcactcgcgttgctcagacctttgtgatggactctgagtgttgtgtgtgcatttctctgtgtttgttcatgtacaagcgtgctcgtgtgtgtgtgtgtatagatgtacacatgtacatgggtgtgtctgggtgtgtgatttgtttgcatatttgtgtgtggggcacgcgcatgtatccttggctgcatttgtgggtgcgtgcataggtgtgcttgtgtgtgcatttgtatgtgtgcacacatgtgcgtgcatgtgcatggggggattgcatgcaggcatgtgtgtatccttgtgtgtttgtgtatgtgcatgtgtgtgtgtgcatgtgggaatttgcatgcatgcttgtgtgtgtttgtgtatgtgcatgtgtgtgtgtgcatgtgggaatttgcatgcattcttgtgtgtgtttgtgagtgtgtacacgtgcatgggcgtgtttgagtgtgtacatttgtgtgtgcacttatttgtgtgcatctgtgtgggggcatctgcatggatccttgtgtgcatttgtgtgtgtgcacacgtgtgcacgtgtgtgcattcatttgtgtatgtgtgtgggtgtgtgcatgtgggcatgcgtgtgtatctttgtgagcatgtacgtgtgtgtccttgtgtgcatgtctgtgcgtgtgcatacatgtgcgtgtgtgcatttatgcgtgtatacttgtgtgtgcacttgtatgtatgcacatatgtctggaggacatggccttgccccagggtctggggacccttccctgcctgccctgccctgccctgccctgccctgaagtctggggaacttggccctgctccggggtctggggaaccctgccctgggcccctgcctgccctgggcccctgcctgccctggcggctcaccttgctctcgggcctgctgaatggaatctgcagccgctccatggcctcgatcatggcccgcatggacacgaagatgttctggtagaccaggggccggaagcccttgcgctcctcctccgagtagccggcgccgtggatgatccgcatctgcttgatgaagatgagacacagaggaccagagaggtttagtgacttaatttgggtcacacagcaagtggaaccccaggggagtaaacttggggtcgtgtgagtccttcaccaacaaaatgggacacggccagtcgagctggggaaataaatgataatcctgttgccacccgcgacacagatttgatgactcagggatgggtcatcacccgaagcctgaagagctgcgtgagaaccccctctttgcaatccattgctgtcctgaagccacaaaggattctgggacctctccattgccccccgacccccagacatcccccagctcctggatagaaatggtgggagtgatctgttttaggatacccccaaaggccatgcggcccagacgggaagttcctgcttcctcctgggcacggaggaggacaggaggaagtggaaccggcagatgccaggaaggaactgggttaaccgtgccaagccccagtcatcacaaggcaactggagccagctatgtgcacagagtccagcaccaggccctcacaggaaacgcagctgctggggaagtggggagccaggccaggcagccgcaggggcaggaggctcggcctctcagtcccgctctggctcaaactagctgctgacccccaatcaatcctgctgcctccttgggcctcattttccccatctggcactggggttctgtggtgtttctgtcccccaaggcaggcgaacagggcagtcaggagcatggactttggaaccagaattctaggtgcgagtctcagctgtgtgaccttgggcaagtcgctctgcctctctgagcctcagtttatcctttgggggaaactaggagtgcctgcctcaaagtgctaagaacaggccgggcacaatggctcacatctctaatctcgtcactttggggaggccaaggcagatggatcacctgaggtcaggagttcgagaccagcctggctaacatggtgaaaccccgtctctact

SEQ ID NO: 1794 - DNA, 4951 bp, Homo sapiens
gcagcaagctttcgtcaccttcagagctctagcataatgataaaggagcactagtgacagccttgctgtatgcaccaagctccaccctgggcagtgcctttccctaatgtctgtcctggtgtgaaatggagacttgaagaccggtacccacatgtaagagaggttaacgaagggagggtggcagagagaggagtcatgtgaaggaaagctacctttagtcctccatcgcaatactgtccagtgtctccagcgtgctagaaactgtgctgaatgctgggcacatggcaggggtcaaagcagacagaaatccctgcctcatgaacccactttctattaggggagacagactagaaacacaaaaaggacattgaatagtacgattgagagatgagtgctatggagaaaaatccagccagaaagggagatgcagaagatagcaccagatcttctcaatgttgttttcatcatggacaggtgcgttccttagaagatgaagtgttagtgattcctgagtttttctcaccttcacgtcgattgatctgaatttggagagtctgttttctgtgtctggctctgcactcaactttgtaggggaccctgtcgaggtccccacactgtggcttcaggtagacagagcagatgggagcccatttcagttcattgtcttgctgaccaatggggaactgtggtcaggtgagaggaggcagcttttacaatcagacttcattgaatagtgtgggctgctgtttccttgtaacaaaaccccataatgatggcagtttccggatgtgtctttttaggacttcagaacttattatttgaatagaagtttaaagcatctggatgatgatgctgtagctaaaacagctgcttgtcagaagagaccctatttaacacttctaaacttgtttcagaggtggaggaaaggataatctgggaaggcctccctctcaagtccacaggttggtatcagctgtgttcatcccccaaaaggaaaataaaatgacaacaatattttggtcacagaattcctgagaaacctctgtttctatcttcatgtctttaagatagggacatgaattccccatgatctgggtgatagggttagggtggccaggacactgttactttgtgtgtgacacaggtggctcctcatgacagttcctccatgccttagaacatgttgtctgtctggtcatccctgggggtagagctgagtgacccagcagtgggagatttaacaactggagaagaagatgggatgtgtttaattatccccagaggtagggccaatttgtcaccctttaaatagacttatttgcatataaactaaagcaccttagggcatcattaccgaaagtgtctaagcaaatgtctgatatagttacgtgcctgcattaaaagaaagcagcccccttatcttgccttaatatccttacagtgttttaataagttcataatgcatcctgtatgtgcattttttggtataaaacaccgaaaggtggagaattgacttcagttctctccatcctttccccttaagtgttggtggcgctgcaggggcaacgtgcctcccattggaagtggtgacttcctctttgatagaggtttgcctgtctcttgaaaatgaaaagaagcggagattgatctctggagtcccatggtccagtttggactattgggaatattttttatgggatgttaaaaacaatattagagacgtgagatagtaaatttgtggtaataccggatccaggaagcttacagtgaagagtatgaacttaacctgaaaagtatttctctgttctataaatctctcagtgacatttggattaatcaagcataattaaatgtagttagatttttgtcagattgtagttcaaaataatattcatctatggagagggtaatatattatgtagaaattttattaagcactttagttaagcaaacactaaggagaacaaaatcaacctcaggaaggttaattactaaaaaaatcacaaagtatagtagattatgtaaatcattttaattttgaataccatggcttgagctttaatttacatagagacgtattttggatttgtttttcacattatattttctagtacaggattgcaattgcattcttgaaaagttctactcattttaggattccattaagtttgcttaacttttttcatgttataatttccaaaagcaaagaattacaattgtattctagctaattattttaatgtttcactaactttgtgtgtattgtaagaccatatttttatttctatacaaatgatgattttaagagaagtatcaggagagagaatgtatatgaaagcatcgcgtccacgcctggctttgcaataagtgttcatttaaaagaaagacatttacaaaggtaaaacataagagtttagactatagcgataaatctttttattttagtaatttctttaaagggaaaagtaaagagatcaaaatgattttatatgtattttttttgtactcagagaattacattttcactacccccgcctgtctcagggaatagcctttgataagaatcccatggagatctctggaactctattacagtgtgttcagatttgttagttcatatgtaaatttcagagctagagcttcaaaactagagtattgtaatctcaggaacataagattatccaagaagcctgaaccttgctcttttcatgataaatgacatccaaatttcctttgtctaggagataagcatagatcccttttatcatgcttctctgagattttcacagaacaaccctgcaatttgattttgtttgataattttgctttttggcttttcagtgaggactctattttccattggaactgactcctttggggataataagctttcacttaaaagaacattccattagatagttctaacttcaatgaacctaaaagtggcttcttaatttgaataatctggataacttttgcaaatgggtcaaaacagcacaagtatcaacaatcacgtatgtactgagtaatatttgccctccagttagcaaagtcaagaaatgtctaactctggcacacagcactggttttaactactctttagttcatctttgccttccaaattggttgaaaatggcaagcttagaatggaatgcatattaataacagaaccacttaatgttttaaaatattcataccttgagattctttttgagagaaaaaagaaatcttaacatccaattctagttgttttggcttttcacatatgctagacatgaaaaaggcagttacaaaagtgaaatccgattggaagtcagtggtgtccgccattgagccgtgctaaatgtcgtgtcacaaaaggagtttgtgaaaacaggatgagtagaaaatgttatactgttgtttctatcgtggcaccgctttcttataaattccatttgctttttgtcatctgaactgttacaaccatgggaaacctcagtccatatttttaaaagcactatatacttacaggaaaaaccgacttatgccttcattgaaaaaatgttgaagttaatatcccaaatgtttaatgagcatgttttagaatatttacagctaaagtctgtcactttagggatttgacaaaacttgagactgcctgccaccgaagagggaccaggcagaatcttctcagccttgtaaccagcgttaaaaaaatataaggggcttgatgagatcctagatctgctccttttctcctaggtgcctgggtaactcctggggaaagcatcatattaagtccttttcaagcaaggtgtgtgattttgaccaatgaattgagctgatatgtgattttgaccaatgaattgtgcatctatttaaaaattaccaagtgtatcttgactcttgagtggacagtcaaggcaaagtttacttaggaaatgtaaagtatggagtgttttaaaaaattcaaattgagtttattcactgttggaggaattgaattctattgcctccctcatttccattatgttcattgttacaattgtgctgctctgttctcattgtgatgcttagttctcgtgtagaactgagtgctacattgtgattagaaactggagttgtgcttgagtcagtcctggaaaacaggacccatttttaagaagaacggaacataccactttggcattctggctgaccctaatttctgcagagttccttggtgttaaaatcatttgaggtcatagttgctgcttatggtttatatacacaccatctgctgctctaagttcacatcctctcaaaagcatgcaagtgcttgaaatttaaatatttcccagatctaaaacaacttgtgactacctaagaaatgcttgaaccaaataagaaacagcactgtggaataaaatataccattgtgaacatatctgatgctgcaatgaaatgtaaagttccttactttgctgatttttcatcataactccttgactcataaaagcggtgtctaaactgggaacagctgctaatagggtaaaagtattatacatcaaataaaagttcattacaatatttgtactcataagtcaaaatctgacctggttcgctttgtgcctctgtcagcctacttacagtgataaatgtacacacaagtccagtgttgccaaggagctttgtttatagaaagaagcttggtcccctcagttctatgctgttgtgtggcctggttggtacatgccgtcatgatgaaggatgactttggtttgagataatttgtcactccacattccatggagaaaagtgtttcattttgatgttggaaaaacatgaccagagaagcatgtgactcagataatgttccccggaagttgcagagcaatctgtggtgtctgtcatagcccaactagtcctggagcacatggacaattctgtaccccaataatcagaacaataaaatggtagttgtgattca

SEQ ID NO: 1795 - DNA, 2930 bp, Homo sapiens
gtatttttaatagagatggggtttcaccatgttggttaggctggtctcgaactcctgacctcgtgatccgcccacctcagcctctcaaagcgctgggattacaggcatgagccaccatgcccagccctcaaatttactcttaatgctcagttaatataaaggattcctaacagtttacaatgtggttttcttgtttttgttgttgttttggttttttaagatgtgaggtctcaccttattggccaggctggtctcaagctcctttcctcaagcaatcctcccaccttggcctcccaaagagccacctgtccaatgatttatcctgtttcttaagaactgtctttaccttcttagacattttgtcataccattctagaagtcaaattccaagtgcagtgattttttttttccctagtccattatagttaatcttcttgttagtgatcaaataccaaaagagaaaagcacaaccagaaattttggctatttgctgcaagttgtaggtcttgggctctatactaagaacttgaaatttttaaattagtatccctgcctaggtgaaaagtttttaataaatgtgttgaaaatcaactttaaatccatttaatttagactggagtgggcgtgagaaactgcaagtctatttctacatataaggatatattattatattgtcccatcccaccactacctttttctcaatttctatttctttgtagttattttagtaaaagccatttggattctgagaagcactaattcttagctgtgataggtctatgcaagtaagacagaatcattaaatgaagctcactaaatgaagttctcatttctctccaacagactgtgctagcaaacttcgttttcttgattgtatttaaataatttagtatctcactacgataatagtttttaactggaagggtgtgatgtgttttttgttttttgttctcagagttgtcttctgagataattattaccaagtcatttgtggggttgtgtttttttcacatcatgtgacagaaattataactcataagatttaggcataatctggttttaaaaccttgattgaaactgttgttttttaacttagcaggcagcctaggccatggctgaaaagaaggggtaagtccttcattgcatgatgatgtgtgcaggttttcctgattttctaatttttatttttgaattcacatgtgtaatttcacatcaataacttgtgtttctgaaatatcctaactaacttgttaataaggaaagaaaccagatttgcttaaatctgttcaaggctgacattctgaaattctaaactggaaataacttcccagagtatttggaaaggttctaagtacaaggatcaggcctaaaatagctccttgggaaagaaatttcctttttgatgagaaaacttaaaatattgtttttggtaatgtaagcagttaaaaacatgactttagaaagacagcttaatgcgtattcaagcaaacctttgttttgttgcttttgcttttgtttgtagaagagagaggaagttattataccaaaaagtaatagtatatgtaactttgagtgaggctacttatatcttagaatgggtatccttgaactatatctaccccaccatggcttaaaaaaatcagtggtatatattgagaatgtcagtcatgagcttagtgtttaagtaacacatcccacttacagttgtttgcatgattagtcttgtgtatcatgatgttcaactttgcttttgctgtgccagttcaaaaatatcttttttgctaaaaactcttaaaattcatgacataagttttgttttgatcacccggttttatatagtatttctgggaccaaaaaatttaaatatacctttttaatataaaacagaagtttgaagctggaaagatagtgtttatggaagatttgtgtgcttttgtgttttttaaacccgtcaggctgctggtaaggcagtttctagggctcacttttcctccttacctcttgactagtgtagcatgtggtatgtttaaaatatttcattttctgctttgtaattctaaagtcaacactatactgtatgtagacaggagagctgatttgtatattttagttatttggtctaatcaagcataactaaagggacttcttttttgatacttttctcaaattaagtttaaatatagtatacgggccacatttcatgtctttgaaagtgttgtacattactgtaaaccaagtactctgtctacaccagagggtgctttaactgcaaaatatttgagaaacaattcagtctctcaaacattttggcacagttcatcactccagtttgttactttcttgagaatagtccattttttgtttttgttattgtaccgtatgttctggtcattggaaacagaacagctcatagttgggtgatgtaatataataacagtaatataacctagtagtcattttgcttcaagtaatttaattagatagcaaaatcactgcggtttgtttattacacttgtagggctttttatcttactcagtgaccatcactacgaatgtcttacattgaagcacagactgcagagcacttgttaacttagtcctcctgcataatgcactcgtgaaaagtagtgcttgctaggtgtttgaagattttatgatccgtgtgcttgggctcgttgagttatttgtaaaataaacatttagtttgagttgatgcagtaagttttttggactagtagtatccaggtccctactctactgaaaatataatcttcactatctccccttaactcagaggagatgtagcatttagaacaccttgagacatgacattgtaaaatagcttgttttatgttcctgaagctatcttgttctctgttaaagctactaattgtctcagtgtaagttttaaataaacatatttctttaaa

SEQ ID NO: 1796 - DNA, 498 bp, Homo sapiens
aataatgattcacttcagctctagagaaatgtatgaaggaagggaggaaaagagttgaaattcagaataagagtgtgattccattacctgaagaggcaaaagagcaggaggaaattggacaatctaggctacataatgttgaagtgtacagaaaaggaagctgagattgaaatactggagtgtgatgaatgaaacccagagaccaatgtcccaaacatagcccagtctgcatctcccacatgaaggaacccaaggaatggtcacgtttccatatatccccacttaagtgacatgagatggatgggtttccacaaggatcagctggaggagtttcacatccatctggcaaagctgcatgaagataagcctcgtgttttccagggaactgcattgctctacagaggcaatgccgaattattcaattgctttatgaatatttcctcccattaacctctctctgaaaatttgctgatacgcattaagtgtctcttaaccaaa

SEQ ID NO: 1797 - DNA, 2639 bp, Homo sapiens
gcaatctctctcccccactgcaaagccctgtagcaatgatcctttgttccatgctttaacaagtatcattgaataatgttttctttaacttaagttcagagttatcaaatgagttatgttccgagttgtcagatggtcttgaaccagagaaaaagagaagagctttttctccctgagaaacatcgatttggaatcacaactagaattccacctctggtacataacaacgtgagtcacaatgaaaagtcatagttggagattcctcatccggactgtagaaaaggtcatgtccctaactccagaatgccaatgataaaggcacacgtacaggcatgttagaaagatggagaagtcagaggaagatgtgcacaaagttaaatcgctctgccctttctactatcagatcatcaccaaacactcgtgggatcacactgagaaggatcatccaagtcaagagctgcagaagaaatggtgcacatattcaagagtctcacctttagcctttcctctacagcagaatcactatgctacattaatttccttctcatctgatgacttcttgagagctttttagtttctgcatctcctatttctagccaatgcaataaaccagctggcagattatccccttcacatccaatgaccaaatcatcacatctctccaagaggttcagaggtgggtgtttttatacagaacctgtcaccatggcagcttgactctcttcagtttctgaattaggaacagtgacctacttatatttctactacacccataatggaaacaggttagtaatatcttccaggacttgacattacggagcttccaggtggcaatgcagataaaggcaaagaatacacagagtccagggggctcactgggaagcgaagtccatggtctgaacacacacccccgatcacctttgctctatgccacgacgaagtcatcaggcttccccacctccagtccccaaaatacactcaaactactcagatgatggaggagcacaacccattgcctccttcacttactagaaggcagaaaatgcagaagaaaaaccatgttgccttttacagatatgacttaatctgcagttgggaaagagattaggtataactttggctttgtctactcatcccacttatacaacaaaccatgccagttttagacatttgttcagtgcaactggctttcggaaatgccagaaaattgattcttccctacccccgccaaagcatattgacttatcctttggcaatttaactcctaaatcattatcctcgactatgactaaaatatcacataaggtgattcaggaaccaaagctataacctcctatatttgccttccatccccagggccccctggaaggttctaagtctgagtttgtgtgcctcactcacttgcttgccttttgttacggcgacccattcaactgcatttatatacacataggatgaatattctgaacgtgcagtaattcatgcttggggaaaattattcaattatgggtcagtcatttcacaaatatagaggctaagccctgttacaccgtaatcaggtgtacatattatccaaggatctcataaacttccaagaggctggagatctgtttatttaatagttcacaaagcagttataatctcttccctcagttttgctaagggatccagactttctaactttccatataaagggacttgccatatgccgggcatttggcgctacccacttgtttctttctcaaagggttagattctttgggacagtatagtagacactatattgctccacccagacgtcctttttagggccaatacacccatccccagctgctgatggttcacaaggaaggtcctcagccagctgcaggacacagcctcacccaaagtgatacccccagaaggggtggccagttgccaggaattagctgatgtaggcaaacaaaagtccagccccttgctcaaatggggacagctctgaagaaccatccagcgctccccatagaagtggctggggtctcagacgcaaccacatttgccagtcagcttctcctctgcccaatcttgccttgttccttccttacaggtgtctcctgagagctcacccccaaaatccttcagcaccccactcctggtctcagagtctgcttctagggaacctaatttaagaccagcagcagttttctaagataactaatgcagagcattatttttctaattgtacgaggaagtcacaggctccttcagaggccctacaaaggctgataaccgtctttgaaaaatactcgtcatacagccactcagtttaaaaactacacatttttgatattcagctcagatcactttctgaacaccaacccagtcaacagggacaggagttaatgcacaggaatacagcaagttcacaagtaaaggcggcgagacctagcaaaggtagtgatttgcttgtcccaacatcatgtggcattgaaaactgccaccagagcaaaggaggccacatctggggttcccaaccttaaccatcagagtatggctgcccacaaaagacatatttactttataacctcaaatcctagcaaatcttcattctaaagctacccggcaagaacagttccacctaagtatgaaactgagtcctg

SEQ ID NO: 1798 - DNA, 1497 bp, Homo sapiens
ggatgtgctgggcctgaccagccgcccgctttcctcttctcttgcctctgcctgccccctggtggacagctggggtaaagcatgggagtgcgcctttggggtctcagtggggctgaaatacgactcctcccctaggacagcctgccttccccagccttgttctccggcaaagtcaatttcctggagaatcgaggctctgcctcagatgttcggagcctccgcaggatgaacacctccatttcaattccaggggctttgatcaacctgtgcctcccttgatccccaacttgtgggcaccttcccttgagcagtgcccccacgaggtacacctttcccgggaaacaaaaatcattccttctttgggtcctgcaagctgtaaagaaccaatacagcactgtgctactgaacatgttgccactatagaagccccttgtgttttgaagagtacatctctatagccattcgtttattcatcagaaaccagctagaagccaggccctgtgctgggcgctggagacatggaagaaactgggctgaggctcccgccttgaagagcttgtggcccagggaagggacagttcatctgtcattgattgccacgtgacagtgtctatgatgctaaaaagatgccagtgctgtgctgcaggagcaaaggccgtggaggaagaggctttggctttgttgcgagtccttgccagagccaggcaaagccagtcaccgctttgttcagatgactcaggtaaataaatgaggccgcacaggctgtcctgacaccacacacctctagaataccctggctgtgctgggagctattggtgtcagctgagtattttcatccctgtccaagtcacaatgatctgactgtaccagcctgtgtggatgttgctaagaggaggcagacagcaccatgagctcccttagatgacgatcggcatgatgttcctgctgtggcagcgctcagctcttgccaatgctcttctctgctttgctcactttaagcctcccttaatttttttgaagcccagtttccacattgctgattcacagatatgcaagactcaggcaggaaaaaaaaaagtgtctccttttccagacttcttagaggacttggaaagaaaatgaaatgacgttgaacgaaatcaaagtaaattgagtgatctgaaacgatttgatgtcagcaagaattccccatacagctcacagccctaccccgagcacgcctccctcttgggtatgctctctgcaggcccaaaccttgcagaagccattccatgtttcctgagcaggaaaagacaaactcagaccgacaaccttggacttcaaaagactgcacacaaggggaggaaggactgagagtaccaaggcgtgagaattcagaatgctgctatctcatttatttttaccatttaggaaacgttttgatctgcattccttttcccttccctgatttcaaaaaataaaaataaaaatgcttcggttctgaggagtaactctcca

SEQ ID NO: 1799 - DNA, 566 bp, Homo sapiens
ttgtggggcccgcttggatctccttgtccaaagggtctgggcgccggggctgcagtctctgggtgaggaggcggacgcgggaaacctgcttcggtctccatggttacgagccgctcagcgcgcaggagggggattcaaaggaaatacggaagctaaaaggaaactgctgaacagaaaacaatgtcaactaaaaatactacaagcaaaaaacatcactgagaatgaaggtgagaaaaagatgtcctcagaggaagcaaaaaataagagaatctgtacctatcagaaccactctaaaagaactaaaaaacgtctatcagaggaagtggaaatttgcagaacgaaatttggaaaataatgaaggaagagcaacagaaatgtggtctgttttgagacatgagttcggaaacttacactgtgtggagcctgacaatgaagccaacaatatggaaggcgggacgaagacatggagaaacattcctcccttgtgatgttgtttgagcccatgaatcagcctccctggagtcagtcccacatctcttccttgaactcgcctgagccatgacact

SEQ ID NO: 1800 - DNA, 894 bp, Homo sapiens
ggagactctaagacttctgaagagtttcttgcttctttcctgtggggcagtgactccacttcccagcagtaatggaatatcctgaattagctacattaatgttagaaccatttggacctcacccaggacttcaactacattatgagtaactcctggacgattggcacagaagaaggcacaaggcaaatacccatctctgtacaccctgtgctactgtgtcatgtgctgctccaggcaactccaatggattggccaccctggccaatgtgtgagttataaagcaatgatgtgtagctattgaacctacaatttggttaaagttaaactctcaagttttatatgtttacaagcatattgtccttttgttaatttcctcccagtactcatttcttgacttcttttagttttactatgtagtaatttttaaaatgttagtcaaagttagttaatttaattcacttagcagattttcctgtaattttggttaaacagtatcctttctgtacaggccctccaaacaccagcactgagtagaaagaggctctgattcatgaaatgtgaatttatgacagttgccactcttaaaaaaaaaaacaaacagacagaacttgagcaatacatgactgatgcattctcagcctgcttcctgtgttccatctgtctttctgccagtgcattcaccctccaggtttgaaagtagtcgggcaagaaagtactaaacatagagaaagggcaattccaaaagaacaaatgattgcttaatttaggctgacattacccagttgctgggggtatgggccatggggatgggccatgttcaccacttaggttgggcaaattcccaagatgccttttgacatagtaatgagggggaatacatcactcatgcccact

SEQ ID NO: 1801 - DNA, 488 bp, Homo sapiens
agaggtccctcagtgccagggcctcccctgtgtcgagggcggctcttagaatccatcctgggaaactcaccgtcagggcaacggaatgagaacaacttcatgagacttattttgactggatcatctgaggtcaggagttctagaccagcctggccaacatagtgaaaccccatctctactgaaaatacagaattagccgggcgtgcctgtaatctcagctacttgggaagctgaggcaggagaattgcttaaacctgggaggtggtggaggttgcagtgagccgagactgcgtctttgcactgcagcctgggcgacaagagcaaaacttcatcaaaaaaaaaaaaaaaaaaagaaaaaagaaaagaaagaagtgggtgcagaggctgggctacagaagaacacactgattcccatggctgaatactccttcgcacaagagcagagcctctgtgagggataaggactccttgaagatcacaggggtggt

SEQ ID NO: 1802 - DNA, 409 bp, Homo sapiens
gataacgctagggcatatccgcccgcctccagctgttcccgtggcaacgttcaggagcgttgcctcgacttccgaagaggctggaagtggcggcccagtggtttcctaggtcgagtagttcgctgggactcgcttccaagtggacccgggagaggcggtggtgtagaagaccaccctgagcctgggctttctcccgccaggagggtgcgagggccatctttgacctctgttaagcgccctaaggaggtaccgacggttgtgaccgcagtctctgacgtcttcagatgtcagtcctacaaagtcgggggtggaggtttccctccaggctgatcggacatgctcaaccgtttatttacctttgaatttggggagcagaactagccagggtgacactagtttctcccaataa

SEQ ID NO: 1803 - DNA, 605 bp, Homo sapiens
tgcccctgaaccccagaacaaccagctggatcaattctcataggagccacagcgcggagactgtgaaacatggttccaaaactgttcacttcccaaatttgtctgcttcttctgttggggcttctggctgtggagggctcactccatgtcaaacctccacagtttacctgggctcaggggtttgacgtccatcagtaggaaccagctccaatgcaccaatgcaatgcgggtaattaacaattatcaacggcgatggaaaaaccaaaatacttttcttcttgcaacttttgctaatgtagttaatgtttgtggtaacccaactataacctgccctcataacagaactctcaacaattgtcatcatagtggagtccaggtgcctttaatgtactgtaacctcacaactccaagtccacagaatatttcaaactgcaggtatgcgcagacaccagcaaacatgttctatatagttgcatgtgacaacagggatcaacgacgggaccctccacagtatccagtggttccagttcacctggataccatcatctaagctcctgtatcagcactcctcgtcatcactcatctgccaagctcctcaatcatag

SEQ ID NO: 1804 - DNA, 405 bp, Homo sapiens
ccgtttgtgagagaaaacctggtatctggcttctgacgtttcagtacaatcttctattgtgcatctggatgacatcactgttgtgtcctttgcagagatgtgcatacagggccctaactgtccaggagctgctacggacagagcccggtaatcccgacgacttagtggatcctgtgcctcccaagggtggcgcccacggtgactgcacacttgtcacagactggcaggccatttgtctgctgcagcccaccaaatcccacagatccttttggatcctttgcagcaggcttttcataccttgagtcttacttaatgttcacatgaaaaagcaactgctgtttgctgtgctcataaaagtcttgttagaaattaacaccttgtgtgaataaaaacatcaagtaagta

SEQ ID NO: 1805 - DNA, 580 bp, Homo sapiens
gcgctccggtactcgctgctcgcggctggccggctcgggattccgggctttcttcccgagaccgcgtcccccagctgggccgaaggtggacgctcaggggctggaggctcagcggaatcccctgcgttcagtagccccgctctcccctgtcccgaaggattactctgcccctcagcggttccagtgccctcaaagcaatctgtctctgaagtactggctatcttctgagcgtgtgccagaagatccagctttgttgaaaagcgaagccgttagtcccttaatacaaaggagacaaattgatttatgcctggggcaccatcaccaaaagaagaggaaatggatgcaagccttcccagaacaacaggcgtgccctgaattctttcttgggcgagatccacgaaccgtctcttggggtctggattgggacccctttccggtaacaagaagaagtgaaatgtgcacttatgagcctggatcttcagacacagagctgtgcctccttcacactctcttttcccttccctccatctagaatccatatacttttatcatattatgcagataatgacaatgcagagct

SEQ ID NO: 1806 - DNA, 2442 bp, Homo sapiens
aggatgctgcgaggcgttgccagcggagggaacctgccgccgcctcgtccccctccaccctcggagcccggccggggagtcgggcccgggccggggaggaggaagttgcggcccagctgggacagcagcaggtgggaagctccgcgcccggctgttgcggctgcctgattgcagcctggccttgggcaaagcttcctactccgtctggagccccacacacttcccggttcccccgctcttgggccgcttgccctgcgtgctcctcgaggggcctgcgaggtgccagcgccgggtagagacctttgccgcaggggcaggattgttcgtcggtcccggcgcgtctccctctccactccctctctgccggagcccctcggcccttcgaagccccccgcggaggctgcagcgcccggagaagccactgagtcaatggggcgagggactggggcgggcgcgcagagcccccaggattgagacgcgcgcaagtgcggccactgcagcgccgcttggctgtttgttctcccgactgttcgcgaattacttacaaggcgcctaggcttctccgaagggtggacggctcgttccctctcgccttgtccgccctcagtctctccaccaccgcccggcacgctttgctgatctaaaatcagaacaattagagagtaatgattttttttggaatagcaactcctacagacactcagatctgccctcgcttcagcgcctcccagccctccttcccagcagccaggcgagagcgcgcagacccctaaaaagcaacttcagtgttaaccgggtctggatcctggaactttataaactaatccgtgtgtgtgtgtgtgtgtgtgtgtgtaaaccgaagagtaagtgcctattatttctgagtacttcggtgtcctaacgaagctttgctcctaaaggacaggatatattttaggagtctttctttccactgagttttttaaatgtttattttctcgagcgatcaaatgtgtcttttgtgcagtttatttaaacctcgtaaggcctccttgagtcgctgaactaattcagcaaactagctggtattgtggacggcgcagtcggggtggatttttgtgtgtaggagaggtgaaactgacaattcaaggaaaggttctgtgcgagtccccacctcccatcctcatatccacacgtggcccctaggaggtgctggtgaaatatgcttgcttaggtttcgcagatccgcacttactcctgccttaacaagtgtgccttttttcttagcactgagcaaggtacttaaattaaaagggtgtgcaagagatgatgcactcggtgtggctgctctgatagccaaatggcgatgtggtcccagttaatgtgttgagattatactgttcaccaagccctgttacgaactctgttgccatgcacgtgggaataatgcctgccccaagggaggtcttctttaacatctatttagtcatgtgttatttataaacagcttgaattaatactgtaaaatagacggatgtctaagaatctaggctgtagcctaaagctaaatgaacctgagggtagacaagttcactctgtattaaccaaaggataatgaatgagttcaccgctcagttcaataagcttcttctgaaatatgcttcctcctggacttctaagaaacaggccaaaagtttaattatcccttaaaacatgttaagcctaaatagaaaaaggaaattaatcatttatagattttctcttctttattatgattcagttggtgcatctgtagatggctaagaattttccaaaccacgtgaattcagagaggcaacacttttgttgttgttgtttttccaggtaatgagctcgctttgaaaaccagtcactcggaaagggatggcatttttatgcaacttggattgaaatggttttgctttagtattctactctaattagaaagaatacaccacaggccgaaatagtttcatatgataggaaaatctttaaagaaaggaacacagagttattagattatggttggctgtataaatttagctgggcagcgggaggaaggtcataataaatgtatcctgctctctctcatcaattatcagcagcacatcccccaacattctctcctcccaaagactgaaggatgtgcagcaaagcttagatcttgaaggagaaggttcgggaaaaattaatgattttaattagaactttccaatctaagtagaatcattaccttaattagctaaataaggaagtatgaaggatgaaattttgcaaatgaaattttgtaaatgtatggtagcgtagaatacccccattgcttcattttaaaaaaagaaaatataaatgcattttaattaataaatgacttttcatcatgtccctattaggaaaattctgtgtgccaatgctttcagtgtttgatttaatacatcttttgaagtg

SEQ ID NO: 1807 - DNA, 456 bp, Homo sapiens
cacgcaaggggaacagccagcgcagaggccacggggttcaggaacagcaagaagatcggggacactgggtcctggaaggccctgagaagggaagtcgggaaggagggagcatccgggggcagatgagtaaagagtaaagaagccggaggacagtcgcagaaaaggtaatggaatggatacaaggccacgcttgcgcgtgaggggacaggaccaggttccagtctctaaatttaactcagcacagggccggggcgaacctgcgctggcggaacctgacaccgtggcccgagcgccaggcccttgccccggcgatgctgggtcggcctcggtcggaaaccgggagtggcgctggcagcatttgtgcgcccacctgtcgcggcccgtttcccgcggctgactgggtcaggctggggcggcctggagagtctgagggacgggggcgagggggagaggccg

SEQ ID NO: 1808 - DNA, 373 bp, Homo sapiens
agtggactcaaggacaatctcactttcacatccatctctttgtgataaaatgacaggcatttcaagagacaagaggcaggctgctgcccactcaaaagtacaattccacccatcaggcagagctcccaaattaaggatcatagcaattacacacaacaacagcatggaaaagaagccagtgctgcagaggtgatctggatccaggaagaaagggaagatgccttcaatcaaaaatacattatatataatataaattatacatattttatatctgtatatattatatatacatataaaaatatggggactgggcacagtggctcatgtctataatcccagcaccttgggaggctggggcaggaggatcacttga

SEQ ID NO: 1809 - DNA, 1477 bp, Homo sapiens
gagctattactaacttctccatttgattttttatggatgtgaaaaatgctgctacttgtctatgttattatgtggtatttgttctcttggattgaaatttatgcccacagatttttcttttcatttgaaaatgaatgtgaagatactgtttacagcttttgttaattgcacttttcatcactctgatcaatttcttgtaaagtgctatgggaattatttttcctgtgaatattaatgattttactactgcctccgaagttttaaaaaaggttctgtagacagaaaacagttgttgcaaccaaaaacaaccaaaaaaagaaaaaaagggaaaactggcttacctttctcagatgaattaaatgattttaataacttcccaattaccagggttataacattgctttcttcagttattaatacagtcaaattaattttaacaatataggcacaattcatttacaaattcagtacagtagtccagggctacatgtaagtggtctctttattttattctttacatcagaaaaatcatgaatgtcagttttgccagtattttacaatgaggcttatcgtttaaaattttatagtgtatgacatgtaaataaaccagtatttattgtaggttgtttgattcaggcatttcaaatggatataggttaatggcaatggaatcctatttatttggtagttggttttgtttgtttttgtttatttacttttgctatttgttttgtattgtctaaactttgcttcaactgaagacagtgtaaggagttgaaaatacaatcaacatagcaatggaaagcaatgcaaagagggtaaatcttgttttaatttttttaactttttttttttgtaaataaatagtactgtgatactttaggtgtgacctctattccacatgatagttagaaccagaaaaacacttttgctttctagttatactattggttcattgtaaatgcattaccaaaagacaatatgaaaaagagcaagattaagtttttctaacattgtccacttcaggggcaagcatgcttggtatagagctctagcttgtgtataccttaaactgtaacttgcaggtgtttttcagttgctgcactttttatttaatcttgctcagtcccagtaactatctcaaaggtaattgctggaatatgcattttgaaatacggtttaaaaaaaatctgtgtattgtttcatctaaaaagaaaagcactattggaaacactaaaaacgtgttaaactttgtagttattttgcattcctgtactttacaaactgtcatcacagcaaaaagtttaaaattaggtaatgaaatatttttgtaaataaataccgttaagctggtattttaaaaaatgtattataaattaattaatgtttctggaaaatgttcatatatatgtatatgaatgtctctttatgctgaagggctctgattgggcaaaataaaatactctaatctctcctg

SEQ ID NO: 1810 - DNA, 629 bp, Homo sapiens
gccctctgcatcccgtttctttctccaagagctgtttttctacgcgctcgagcctttgagctgtgtgtgcgggagaaaaagatgttaagaaagaggaagtagaggtcgggcacggtggctcacgcctgtaatctcagcactttgggaggccgagatgagcggatcacctgacgtcaggagttcgagaccagcctggccaacatagcaaaaccctgtctctactaaaaatacaaaaaaattagctgggcgtggtggcaggcgtctgtaatcccagctactcgggaggctgaggcaggagaatcacttgaacccgggaggcagatgttgcagggaaccaagattgcaccactgcactccggcctgggagataagagcgaaactgagtctcaaaaaaaaaaaaaaaaaaaaagaaagggaaaaaggaggaagtagaaactgcagaagacaaatctctgttttattctcagtgtaccatggaaaggacaatggaagttgctggccatgcctctgaaaacacaggcagctctgtgtcacattattgaggaagatgatattggatgtggctgatttcacatacaggagccttgtcctgggacatggaggagtgttgagggtggtcaccagattgc

SEQ ID NO: 1811 - DNA, 356 bp, Homo sapiens
aattatccaaataaattgcaagcattctatccaaatggagctctttctgagatgaagagaattctcaatgtcaagatttgaacaagaagagaatggaatacacaatatggacatccataaaaattcatcagagagcattttactactgagctgcaaagggaaaaacttaaaatggatatgaaaagtgaagaaagtgatcataggagaaaaccatttcagatgacaagagcacctcaaaggcagcagcctcaaggagcagccatggccccagacttgtcgcacggatgcagaaaacttaatggaggaggctgaggtcagaatgggaagagtttttaaaaaataaaaaggggagctaa

SEQ ID NO: 1812 - DNA, 384 bp, Homo sapiens
ggacagaggccagactgcaacttaagctatctggaatcttacctctgctgtcttactggctgtctacatggggctacattttaactatggcttacagaaatcattgcctgtcaacagcctccacccccacctccccacccccactcttgggaatggactctgacaaactcaccatcaggaaagttgatgtttcccatctaggatggaagaatgggattctgaactttgtcactgtttctgaaacgtcatcagctcctgtaattgcatggttgggacagatctatttaaattgctttgaagttttcccaggaaattcccacaaaattgtgcaacccaaggaattgaggtggaaaaaatggcactggcatcaatttgcttctcacc

SEQ ID NO: 1813 - DNA, 206 bp, Homo sapiens
ccagccaggatcccccaaagtgtgcagagggctcagcagagaacagtatgggaccccctcaccaggcctggaacacctccagccacaaagaagccaaagattaaactccttacagaagttaactctgcagactgagaagacgtgaacagagagagtcaaggggagtgatgactatttcagagacaggaaaggacagaagagatgac

SEQ ID NO: 1814 - DNA, 1059 bp, Homo sapiens
gtatggggaaagtttaaggcggaagagccctcgtttgtcggctgcttgggaagtctgaggattactgggactaacaggacttcagctggggcttcaacgtgtggtgtgggcttcctgacaccacggccactggtttccaagagtttcaacaatattttcatcatatttattgaaggcctcactgacagacttctcaaggcccctctaccttctattcgctgcctggccccaaagccagtgccacacattttaggtttttaactgcagcagcacctatgatgtttccaaaatctgtatcattaaagtttgatcagagaagcaaaaccaccttgagcaaaacaaggaatttattaaagagattaggatacacattgttatgaaagctgcaacctgctgcccctgtgtccagaagtgggcctgaagtcagcagggctggcaaatggatgtgcagtgggagagagtaggcgtgagctgcacctgcagggaggagatggaactcctgtggatggactgaaactgatgtcttccacgtcagcctctcaggcctccaacactccagcgctgatgatgaagatgacctgcagaggagctggtgcccttcaccatggaattgctcataaacccaagattcagtgaagctgaagaagcagttctggtgggagctggaggaactgcaggcacagctgctgccctgtaccaatacattgagccagtggctgcctggcattgtgtgtgagccaccacagcgcctggccctacacagactttgactgtaaatatgactgctgtttcacttctgccttccaaattttgctcagattttctgagaaacatagttcagcttaggtacattgacacagtacaaagccaccgcagtggctggttagggagggattatgaatgcaggctgagaatgcacgggaagcgtttgtctatttatagagtaggtaccattcaaggatttatgtgaatcaggtgcaaagaactcacacaaagatggggaaagttagtacttagaaatcagtgatactagataaccaataaataaaaataaactta

SEQ ID NO: 1815 - DNA, 774 bp, Homo sapiens
cctttgctgttctcaaggctggcactgaggttggtaaaagttccaagcagggctccaacaccggaacaaacctttctccaatccctgaagctgtacagctatactttaccggttacgtctagactataaaggaccacagtgttccacctcaggcaggttcagcgacctgcaagtagtgatacagctgggaaagttacagagcctgcgggaagctccggctgcaacttcagttctgaccagaggttctgtgaaccttcaggatttagcaggtttccaggaccggtgggtgaatctacccggggaagttttggtggacaagagctgctcgccagctgtcggagtgggagaggccagcgtgctggctccatccacttcacctaacacctctgaagtgtctgccctgcagtgtggcaagcgtggtgctgagcgcttctaaatccgtcgctttaaagatcattagtacaatgttgtgagagggttagctccatttgaaaattattttcccgtgattacaaaagaagcgatgctgactgcagaagttagaactgggagaagactcatcacccccatgatcatgtcaacaactgccctccttcagttttggtttgttttgtgtgtacactctgtcatctttccattgaggaaactcaggctagaagaaggataaaaacaaaacagaaaacaaaacaaaacaaaagtgccctgtagggtcctgtaggtcagtgtttctcacattttaatgtggttgcggttctgatacagtgggtctggggc

SEQ ID NO: 1816 - DNA, 2848 bp, Homo sapiens
atcaaaaagcacaccttgcatgtcattataggcttcatactggagagaaaccttacaagtgtaatgagtgtggcaagaccttcagtcagaagtcatcccttgtgggccatcgtagacttcataccggagaaaaaccttacaactgtcatgagtgtggcaagacctttgctcgaaattcatcccttctaattcataaggcaattcatactggagagaaaccttacaagtgtaatgaatgtggcaaggtttttaatcaacagtcaaaccttgcacaacatcagagagttcatactggagagaaaccttacaggtgtaatgagtgtggcaagaccttcagtcatatgtcatcctttgtataccattatagacttcatagtggagagaaaccttacaagtgcaatgagtgtggcaagaccttcagtcatatgtcatcctttgtatgccatcatagacttcatactggagaaaatccttataagtgcaatgagtgtggcaaagcctttagtgggcagtcatcacttattcatcatcaagcaatccatggtatagggaaactttacaaatgtaatgattctcacaaagtcctcagtaatgctacaagcattgcaaatcattagagaatccataatgaagagagatcttacaagtgtagtaaatgtggcagatatttcagacattgttcatagcttgcagttcatcagtgaactcatactggaaagaaacgttacaaatgtcatgattgcagcaaggtcttcagtcaagcttcatcttatgcaaaacacaggagaattcatatgggagagaacctcacaactgtgataattgtggcagtcatttttttttcttttttcagatgaagtcttactcttttgtccaggctggggtgcagtggcgtgatctcggctcacggcaacctccacctcccaggttcatacgattctccttcctagcctcctgagtagctgggactacaagcatgctccaccaagcctggctaatttttatgtttttagtagagacagggtttcaccatgttggcctggttgctctcaactcttgatcttgtgatccgcctgcctcggcctcccaaagtgctggtattacaggcatgagccaccacgcccagtgtggcaatgtctttactttacattcacaccgcattagacatcagggaatctatactggacagaaatcttacaaatggaataggtgtggcaatgtctttagtctgaggtcactccttgcagaacagtagaaaattcatttttgagataattgtcccaaatacaatgactatagaaaatgacaaactttaattgacattagagtcaattctgcattgactagagtttgagttgacttaacattgagttcaagcattaattgacataaaaagtgtttacgtcaagaagaatgggcagggtgcagttgctcacacctataatcccagcactttgggaggccaaggcaggcagatcacttgaggtcagcagtttgagaccagctgggccaacagacctgaaccagtttgcccagcctgttttttctttccttctttctttcttttcttttctttctttcttttttttttttttttttttgagacagagtctttctcttgtcgcccaagctggcgtgcaatggcacaatcttggttcactgcaacctccacctcctgcattcaagcaattctcttttctaagcctcccaagtagctgggatttcagatgtgtgccaccacaccacatagtccctctccacagagatggttgagaaggctgatggaaaagccagatacttgttctacagctttccctgacactagtatatcatccacatactggagcatagatatacactttgggatgctcatcttttctaacacctcctcaagaatttggccaaacaagttaggagaatctgtaaatccttggggtaagactgtccagcagtattgttgttttcacccagagtgagaatcttcccattcaaaagtgaatatatcctgactatcttcagctaaaggacatgcccagaaggcatctttcaggtctatttctgtaaaccactgatggtcatatggaattttgctgagaatagtatatggattgggaacaacaggatgagtggtttgaacagtttgattaatggcttgaagatcttctacaagtcagtatcaccaatctgactactttacaagtaatattggagtagtatagggagacatgcacagttcaagtagcccatctcagataaggctctcaattagaggttttaaacctaatctaccttctaagggaattggatattggtttcttttcactgtttccctgggagtttttaactttatgtgaattggaggaacttgtagcttccttcaatttccctcccttgaccactcattagcattgatgtagctttcttctgctgtagtaaacaggtttaatgaagtgaagaatccttctgggcttacacgcaagcctatacctaactttgccattaggccacttcctaacaagtttgtcccagccttaggaagtagcaaaaatttaacattggttgatcgggtttcaaatctgacttctgttttttctgagactttggctttaaatccttcccctttgactcctaaaacttgaagttcttctaataaacaatttatattagagggcacaaaacaaacagaggagtgggaagctcctgagtctattagaaaagtaataagttcggctgggtgccatggctcacacctgtagtcccagcactttgggaggccaaggtgggcggatcacctgaggtcgagagttcgagaccagcctgacccacatggagaaaccccatctttact

SEQ ID NO: 1817 - DNA, 246 bp, Homo sapiens
gggactacaggcgcccgccatcacgcccggctgctttttttgttttagtagagaggaggtttcaccgtgttagccaggatggtctcaatctcctgacctcgtgatccgcccgcctcggcctctcaaagtgctgggattacacgcgtgagccaccgcgcctggcctgaagaaagaagtcattaaagaagcaacccatggcaaaactagttattttcttaaaacagtaggaagaagaaaagctttttg

SEQ ID NO: 1818 - DNA, 2284 bp, Homo sapiens
tttgtctcaatgatctattaatgcactcaaaccacactaaattagctttgtcatctggtccaggttaggctgggcaattctgctggtttcatttaggctcacccaggcagctgaagacaccttggtgcagcatggtctaagttggccttgcctggcctggggtagctgccgttggctgagccgtacatctccagcaggctagcctgggctcctccattggatgcagccttcccagagcaagccacatgtgcaaccgcttcccaagccgctgcttacattgcatttgctgctgtcccattggctaaagcgggtcatgtgaccaagccggcggccaatgtaggagaggattacacaagaggggtgtggctcctgggcactcatggctgtaccaacctacgaccaattcccctgagcgccaggctgtttcctgcctctgcaccatcgcccaagctttccccttcgcttgttatgccctgctgggcgatctcctactcgggcaagtcacaagcttctctgtgtctcagcctcctcctctgtaaaatggggatcacatgagtttaagttattctgaggattaaacaagttaacacacaaacatttaaaacagtgtctagcacgcagtaggtcctccagagatgccagccatcaccatcacagtggtgattcttggtatgacgacccctgccctcttcaaagccccgtttaaggaatctcctctctgaagctgtctctggttctctccaggcaagcatcctcccccaggcctggccctataattatcttttcctcatccacctactccatctacagtaggatccagagggaagggaatcccagggcccagcccagggagtgcgaactatctgatttcctctgcaattagggaggcaagacagtcctcggtggccccatttgacagaggtgaaaactgccgctgtaggagatgtgctgatttgcccggggttgcgcagctggtaggtgggtgagctgggagtggagccaggttgggctgtagcagctgtgtttgccctgcctcactgtccagctcccacctgggccgggtgtcggggtctcaaagagaaggcagataccggctctgccgcacagagctcacagtttggtggaggaggaaggctcaagcagagagcaggaggtgtgagtagctctgtgggctgtgggggccagatgggtcctcgaccctgcggggtcagagctggctgcccagaagacatgaaatggaataagcagagtgacatgctctgggccacaaacagggtgtgtggccgccctgaacacatcactgcagccacctccacagccacagccctagccctgtgggtcatggggatgtgaccctccccactacctcccatcactgaggacacacctcctgggcctccagtaactacccaggcctccacacctgctacaccatgatggtgcagcccgcctccccaacgccttcagccctgtggaaattttctctggagattctaataccccggcctccttgaggtcagtgtctgcccagagcctcccggcaggagagaagaaaccccacagctctttagggaatgcctgcctgtccaaatggacaaagacaagctgtgcagaaacctcccctgggaggactgagccatcacctgaggaatgggagtctgtggaaacgtgagtcacctctgtgggaataaagcctttcatctggacatcgaaatggccaccagctccctgagtgactttgggcaagtcatgccccactccaagcctcagaaagccgacctgtgagatgaggatgaaagtaaccccctcatgggcctgccatcccaccaccatggcgcactccacctgaatgaccttgaggactgtgaccgttgctgtgtgcatctgtgctgcttcccgtttcattgctgagtggtgttcctgtaaatggatatgccactgtctgcttcttcactcaccagccccaggcaccccgccattctaccgactgtctctatgaatgtgactaccaggatcaaggaacttcataccagttgaaccatacagtatttgtccttttgtgactggcttatttcactgaacataatagcctgaaggtttatccatgttgtatgatgtgtcagaatttccttcctttttaaggctaaataatattctattgtgtgcagagatcaattgtctttatccattcatctgttaatgaacacttgggttggttccaccttttggttattatgaatagtactgtgatgaacatgagtgcaaatatatctgtttgaattcc

SEQ ID NO: 1819 - DNA, 2187 bp, Homo sapiens
catcagcccagcctgcaaggaggcgccaccggacctgcacactcaggagcagactcagctagattggaagagaggatgggaagacaatggatgacctacctgtggagagaaactacccattccagaacctcctctctgctgaaagctgaacactcaatgggaagacctgtttgcagagaggagccagccactccagggtctccgttctgctagaagctgaacactcgttgggacacccttgctgtggaaaggacatccttactgtggaaatgagctactaactgcaggagctgaggagctgcacagcaaggttaaaagagctgtaacacaaacagggctgcaacatgccccttgctccccacagggagagaagagctctggccctcggagaagcccagacctgggagctccttgagcccgggctgtgactccctctttggggccctggttggcgtcactgcattcgccagtgccactgttggaagctgcttgtgatgcgcctggtccagggggaagctgtttgttgtgtgcctggtccagccacctcatggagagcctgtgctggcacctggagctgcccaacctgggcagcagcttgtgtgtgtgactgcacagtggccacgcttgctcacacacccctagcacacccctctgctccacccgtctcaatctcccttggatccgggatccaggttggtagcaagtgcgagtgggcagaagcagcccagtgggcccagagcaaaactcaggcaaaggtgccactagactggccaggaaagcgacaccctaaagatcccataatgctgatatgttaattctattctataagcaccacacagaagtgatagcttttatttcttattttgtctagcctggagacagagctaaggattccttgaactgcaaagtcttttccagttcttagtttatacaatccatactcaccttctgcctaactaagcattgtcatttttgtgccaaatgaagagtaggactcctacgattgtcctcagactctcttggctcaatcctcctgctttaacctttcctacttcaaaaactcctgaagttttgcttccccttctatagaatggaaatatatgtcgcaatacttactgcaaagaaaattatatattttaaaaatagactaaagagatgttgtgagacatcagacatcaatcagatgttgtgagaactgatttctgcatcagaatatctccttgactttacagctatcctttaatcctggctcaaagttccagaagaaagatgatccaatataatactcctatttggactttgagtcatacacattccttcttctgagaaaacgtgcttctgcatgaatcctcccttcattattttcagctcatctattattgaatctgaaaccccaggttaactgactgatcactctcatcagtggcagattttggtgtaacataggacacatcactcccaattcaggtcaagtcccaattatcttgcctctcaatatgacatgttcaatgttgtatttcattctacttcattttaatgtaaaaagtcttttctggtgaagtcagtcttttattttctcataaaaattcaccctttgggtttttcatagggtattcccataaccaaacacactttacactttcctagtacataacccaatactttcttctttccccacagtccttacatgaagcctactcagaccgacatcactgtatcatttttttgtattctgaagtccttcagcacttgattcctttaagtttaatcttggtattctattgggaatcatatggaaatgtacaatgatatttattgaatgaacaggaaacagggaaagacattgaccagaaaaagtgtttattcatcaagtctttaaagatacaaaaacacgtgtcttctgtggagctctgagaacaggactccagcaaagcacttttcagccttgtggtcttcaagcatttccaagatctgtgacattggaaagaaaaaaaattaagacagatttgggtctccatgagcagagagtattctttcccttagttctgggtagcatagtgcccaaggaaacctaatcagtacagtgggaaaccaaatctattccaaatcattacccataagcaatcctatggactctctgaggtttgacagagtcagcggccctctccaataaatgtgtttttctat

SEQ ID NO: 1820 - DNA, 792 bp, Homo sapiens
tctggaaaataaatttactatattgactgaaataccactctttgtgtaggtatttgtcatatatttaagaaaaagctaaaaagaatggaaattgtatgacaataactcaagtctttctccaaagtgcatgcagtcttttgcgatacctcattcagccgagtatttgtgctcttcctcattcagtataaggcagctttcagtttgcttagaaggcaacattggaatgttagagttcatcagaaacatagaattttaaactgtgagttccactgaatacattttaatttctgtaggaagaatcaaaacacctatttaaagatggcaatatataataatcattttaaaagtatttgattaaacctgataattttccagaaatgaaaaaaaaaatcagctctaaaaccaaagctgattttagaaaatttgaaaatgtaaatcagccctatccataatatagtttctctaaaactttattttaaagagtcattttaaaataatataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaacagaatgtgtcatggaaatactgaaagatttttccctagagtggccttattgactgctggtgtgatgccactgtaatgtaataaattattaaattgtttc

SEQ ID NO: 1821 - DNA, 557 bp, Homo sapiens
aacagtgaccttgccatcagagagaacctcatcaggaaggactttgagctcttaaggaagccacccctttggagaggctctacttggacccaccaaattccaatctgtaggaaaaaagctacagccaattttcaggccgcttccaaatactacatgagctagtttggtgtctaatgtaacagttgtacatgttttagtggctccacagttagacttgttggacactaaggaagccatctatcagagagttggggtaaaagctgacttggcagaagctgtctgatactgtgggtcatcctgaccttgagactgcgcaacgtgccctggcagattcagagtgtgtcctgctagaacccatgtgctggactcatttccagagagaatgagtgaaaattagcaagtaagatgactacattcattgcctgaatgctagaaagtgccgcatgcccccagattacatttgtggagtgaaggctttgatctctgcttcctacatgtgtctgcgaggattggtactatgagtgtgcctgcagcatgcattcattactgcatctgat

SEQ ID NO: 1822 - DNA, 541 bp, Homo sapiens
acagtgcattgtccctaaacgacccatacttgcctcactgacaccatgtggcccacttcccatctataatctatgtctgggtgtgaagcccttcccatatgatcccccgaatggaacttcacaagttcgaattcactgggtcacagtgtgatagcgtgaagatgggaggacgttaagggaaggctatgggtgagttgggaaatgtgttaggcagggtcagagattaccacatcctaaaaacaacacttaaggcgggagatgacaaaacaatcaatgaataacatgactttttccagtgaaagtgccatatctaatccttttccatttttgttctctgagcttctttcttagggaagatccttcttgagaagcccctgctgagtattaggaaaatgcatttcaggacctctcatcaacacaccctctttctttaccacaaccacatatatgggggcataactcaacatgtgtaaaagacaatcttctgcttttcactgaacctccaggaattcaggacaataaacctctacatgcagaccaa

SEQ ID NO: 1823 - DNA, 1798 bp, Homo sapiens
aaaacccctctgcttccagccgtcagtgagcgccaccctctccaggaacagatgtcctgcgttctaaatgaagagtgcagagcccacagcaaacaactgtccccagcagcccggatccctctgacatcagcccccaggaatgtgctgcagaccctctagcacgttcaggcctcccaggggataccctcccctcccctcctccatcccagtgtttcactggggacaggcctctgagctgcagacggaggcccacggagggtggaagacagcccaccccgctccagacctggagactggaggagtgactggagtgagtgaggcagccttgagtggagtggagcgggaagcctgcctgtgaaagaggcagctaggccaatagctggactgtaggaagaacacggagctggactgattcaaccaagagtcctaccgaccggtgctccccttgccaagagtgaaggcagatgccgtgggattctgccagctgctgagtacatctatttccatgatgctttccggaagtggggaaatagcacagaatgggtttcagatggacgtaagctaaaaacccataagcccccactttgatgttctgggtctcctagaattactgtcagctcagaaccagtggccagtagtccaaaagatctgattatttccttttctccaatgcacgctcatcctggtgaaaggtgtctttggagaactgggagaaagaatacagtatagatttctggcaggctacgagggtgcttccttgagggtacccagcctttccctcattcaagagcttccagtctgataaaactggctcaagtacgggaatggattgaggggtcatgactctactctgcttttatgatttgggatagacttttgtttgcttgacctagaagttttctgcttatacagattaagtacgaacttagtaggcttcctgtctatttcacttcgaggaacatcatgatcaaccagccaacaccacaggtctgcagcagtcagactgatttctgctttgactccactgtccaatagggtcagcacgtccaccttgcctttggtagtactacagccacggggcccccgccaccctggagccaattactccggtcgcattcaggttactggttcagtggctgctgttcctgctgtgaggtctggccttcagagaagagtgatcacagctcctcaaggaggctggagctcctttcatatatttacttctcaccatcaaggtgaaaggcatgtcttcaggagcttcccagcgtgggtgaggaggtcttaaagggaagccaaacatgccgcagaccacgcgggaattcttggccgtccagtgcttgtcacagatctgcttccaggtcttgccctccttcacctccacgtagccctccatcactggggtgcgcttgcggtaggttgagaggatggctcgaatccgaatgtcctccacctggatattcaggttctgggaagaaagaggcgtggaaggagagggttaccctactggcctggctgcagagacaccaggcaaccagtacttctttagcgactatgggccaggcctgccgcgggcctgcctgtgccctcaggccctgcagtgagctctgggcaaccccgaggggcacacggcccaagctgcagttagaaagcgctatgcatgggagatagtgaggctgaaaggacccaacagggagtggggtgacctggaacagtcagaaaagactcagagaccccatgggcttctcctacatccgaacctaagatcttggagagcaaagggcagcagcctcctcctgca

SEQ ID NO: 1824 - DNA, 1613 bp, Homo sapiens
tatacaacttgtgaggttatacttgttttcagctacttttctatagggattgtgggagatgggtgctgagaggggtgtttgcctgtgctgtggggatccccgttcttccagggtcttggcagcctcctgcaacaaacttgctggggcctgctgtgtgtacacactgtatcaggctgggtgtacctcgttaagcacataggtggtaaaataagtaccacggtaaaattatggcttagggctcagggtaaaattataaaaaaggaacagattacatcccactgtgggcaataagaaacactttctgcaggattctgagatgggcctggaagaatggatgatatttcaacagggggtaatgaggaaatgcagtttcggtgtgggcacctgaacggacaaaaggacaggtgtcatggaaaacaggttctgggaaacctgcatcacctaattcactggagagggataatagtgatgctataaatagcaaatgaagtcagttgggctcttatatgtgttgagcaccaccatccatctgaatagttgcttaagccagaaactggggagtggccccagctgcttcttccttcccttcatccagaaagttagcagttcctggattttcctcctctagaatgtccctcaaacctgtcctcttttgtcttttctcatgtctgccacacttgtcttagtcattagcgaaatatccacattttatacttctgttttgaaactgacggaattgtcccagaaaactgatgtttatggtttcttttaaataagtacagaaatttaccctcccagtcttaaatcttgagaaagttacatttatcttatctgagttcctttttcaggaaaccaatcatcagtcctcccagtcttaaatcttgagaaagttacatttatcttatctgagttcctttttcaggaaaccaaccatcagtcctcccagatagtatcaaggaactgaaactttccagatcacagcatcaggacagtgagacaccacacccctcacccaacatgattgcctagcccaccacctactgcctgttggctaactcctcttccttaccctttcctggtcttgttttcccacatgtcattacgtttctttcctgctgtgtaaatccttaattttagttggcttaggagatggatttgagactgatctcccattctcctctgccgcagtacccgaataaagcctggcaatactctttgtcctagtaattggcctcctgtgcggcagcagtgacacctatctgtaccatacctttgacgctttgggggcagttctgtgaaggtgggaaaattgattgtggaataaagtgatacatttggtttggggcatgtttctatcttattaatagtatatttttcctcatagagatgtctactacacagttagaaataaaggcctaagctgggcatcattgcccttgcctgcaatcccagctactaggtaggttgaggtggaaagatcgctcgaggccaggattttgagactgtagtgtgcaatgagcatgcctgtgaatagccactgcgctctagccgggcaataataatattaatatatagatgccctgtctttaaaaaaatatagaaaagaaaagaaa

SEQ ID NO: 1825 - DNA, 418 bp, Homo sapiens
acagttactgaagatagacagtagggggcggaagggcccacgcttctttgatattggtggctttggtttttcagtgacgggggacactttgacttcagttcctttttacgacttttggtagtgaagagataaagttcattacaaaacatgccaggcttaagcaattttccaaagggattaacgaattgcagtggccgcaggctatgtaaaaatttttaaaaggtggtgtctctcatattcttcagcataacttgggtcacagaaacccaggcataaaaattcattgtgaactcatattctaccatggcctgacactgactcaatcaccacaattgcaatcaaaagacggctttagttggaacctggaacgtgctaatcctgtcaggcagcctgtgattctggaagtgaaggaacaaaa

SEQ ID NO: 1826 - DNA, 4618 bp, Homo sapiens
ttatttttaatattatgttgtatttgatgtgctatcctattcatttagtataagcacatttttctttatgtcttcagcataattatatgctttttcagaattttaacatcaggactgcttccagggtagctttattgccctttgtcttaagtatggattatagttttcattctttgtatgtcaagtaattttggattgtaacttgaactttgaatatactgtagaaactctgaattctattttattcttctaaaacaatatttctcagcttcagcactactgacattttgaactgggtcattttgtttgtgttgttgtgtgtattttgggagggtactgttctatatgcattgtggggtactgagtattatcctttgtctccactcactacttaccagtagcataactctctctcctccccacatcccctgccaaaaaatgccttcagtcctttctaagcgctcttttttatggtgttggggccaaaatcatgcatctttactcactctttctcattgagagctatggctataaagggtagtgatacttttacttatttatttttaaggcaagcagttaacttagctggattcaaactccaggctgcctcgtgtgctgtgggaagcagcctacgctctattcagttcttttcttttcatattggttgggttactttgagtctggcctacatgatgggcagtttagaggtcaaccaaaggatttcagcagaacttatacacagaatttcattcaggcttcccgtgtctgattggctacagtgtgggaatttcctcccacttttcagccactactgaggatgcctttcggcaaaattccttgaaattggaaacttacagggaaattcctttcctccaagagtgcgctctcctccagtgttggcttgcttttggttgttctccgtggttttagatagctgtctttatattaattctggagtttacagttgatatctgttgggggcttagtttgataacatgtattcttctattactagtagccagacctgtatgtcttacttgacctgatggagaaaagtttcaacttatgagacaatactgtgctagctagttttactgatttgtactctaaagtacccaagcctaaaatagtagagctgtctatcccacatgaaacttctctgattttcactgttttttataaaaagtatacatgttcacatttctgtaggtttttttaagcatcacaatttttataaactttctatatttccaaggtctacctgctttgtattttgcctagtgagagttttgtattcatgtaggaataatctcttggtgtgagtatctattttccactcatccaaaacagatagagcattgatttcactaagcgttatgttctagtttgctttggtattattattagaaatacctggtgattaatttgagctaagtattcttctctaccctcattcccagcattatcacccgcttttaccacttccaaggggtggaagcattctccacaatgcattttttcatgccagagaaaaatctagaaaaaaatgaataaaacgaagaaattctttccccttggtatctgtagctaacttgcctaagtgttctttcccacagtttaagtcttcagtccatagttcataagcaaaggggtgtagcgagctctgatcttgccagaagagagaataagtgagctaccccacggtggacattctggccatctgaaatgagtcgatgcatgtggcttttgtctaaaggctacaaataaaatgtaaccactttcttctttgagtagttgatatagcaaatagttgaaacagaagttttgattggcaaatcaggatgtggtagatactttaacaaagagtagaactattaccagttttatgtgttgctgtttgtatctctttcacagttttgataatatcacatcctggaaagtgaaacagaaaattattattccattttaaatgactaaatttgctttcatggtatttacagtgaaagagtaaattagaaagtgaatggatgactgttcatgagaaaaagcagggtaaaaagattttatttaattaattgaaaatattagggtcaaaacataggcttatgttatgttttgtgaattgtgctgtgttgtagacatttgatgagtcctaacatagaattgatctagctcttgaaataccatttttgattgagtataaatgggatataggcaccttacaacttcagaattcgaggaagatgatgtgaatcttccaattttatctatttgattcaaatggtatgttttttcacatttctcataatttccacgtcaactcccatgatgatcatgcaggaaagcagcatgattgcacttcttgtagtgcataccatcactaaaacatagttactgtctttctgtggtcttaagaaaaattcagaaacagcataccaatgtacatataagataaataagcttatgtggtacagtaagtgttctgttctgagaaataccttgattcgtatcctaatgtctgatgttattggtagttctcaaacttccccaattctgctttcatctaaattcatcttatctatctattgttaaataatctatcagtccatttttatctatcatctatatatctgtctttatcaatcattcgtctgtaatctatctgtgccgtttggcataagagacagaagggcatagcagtggaaactcaaaggagttacctccatgtgaatggacagtggtgatggtgatctgtgaggtggtgatgtatagaaagaaaaactagaagagagcatgccctaactcagggaccttgtccagcaggcactctggccttgttatactgtgcttgaatatgaaaaaaaaaaaaatcaaaatagtgctgacattctttgtcttctgggtctgagaaaacttagagtagatatgatgactctgccatttcagtcttttgtatttccacatttagagctcagttttaattatgtagaattatttctccagcctgtgttaaactagaccatggattggcaaactttttttgtaaattgccaaatacacattttcagttctgaaagccttgtggtctttgttgcagctaatctactctgctgttgtgttatgaaagcagccataggtaatttataattgaatgagtgcgctgtgcctttcttccaataaaactttacaaaagcatcctgtgggctggagtttaccctttgggaaaccagagcattggctaaactggaacctgaaaaaataatcacatcaactcagccacatggtaataatatttagagtattatttcaacattttcattttcataaaaatttttttagctcttttgccaaattccatctgtgagtgatacaaatgactaccacgtgccattaacatcacctaaacagtgcaaaacaagcatagtagaagtaattggaatgatataaaccccttgctgtaatagttatagttgataaattatgtttcaaaattgaacctatttcttccaaatttcatctataaagttccaaggagttccaaaatcttgcctgccttcttttcccagttagcagtattgtctctgagcagccatggtggtatccatcctccttggacaatgaatttagcctattttgacttcatttgagcagttgtaattgtttcaccacatcagagtaagattactacatgccagagctattctttaactcagcttgtaaaaacatgatagcatcaacaatatacatagcaaatgaatgccatctttaatccaattaaatggtttttacaaatttgctcttgtttgttgatgctatctgcattgcagtaattaaaggtgaggtaaaaagaatgaataaactgccaagttaaaattaaatttgggcaatttctcttttgcagtaatgtatgtatatttactcaaaacatatgccaaatttagtgttgaaaggctcattcaaatcaattgggaaagcacgtaaatgaacaattcataaaagaaaagcattgcaaatggccaagagcatagaaaatgtgctcaatcttaccagtcattataaggaaataatgaaatttgtgtatatatgaaatacttaaaatatatataaaataaaacaattatttgccttttttcacctatcagattaacagattatatgtgttaacaaggtggggagaatttacaactcctgatatgttaaaatctttcaggaaggtagtagaaaatatatgtaagatggaaattagcacttttgaccaacaattttagttttagatatttacctataaggatataataggaggtgttcaaagatgcatgtaactcaatgtagtattaattataattgtaaaatagtaaataacatttttgtcaaatcataatgttaggaaaattagtgatggcacatttaaccaattgaattatattcagttctgaataccgtgatgcatgttcaaattaattgatacaaaaatccaacaactttagcagtttgtttaccagttattgagtaccaactgtgttcaacattgttatttcactcatatgaaatgataaatgtatgtgcgtgttatgatacggtcaataaaaccacttttataggaagaatactcacaaaa

SEQ ID NO: 1827 - DNA, 784 bp, Homo sapiens
aggaaaacagcctgttcatttcatggaaggacgttttggaaaaatagatccagacctacatagaaaggtatgacagctaccttaattcatccatcaagacctttcttcttaattgtgaattaccaactatagatcatcagagaatttaagaaaatcgacaaactaaatgcaaagaaacaagctaatgaaatagaacaaatgactaaaggaaacagaagtaattcaatgaacataagaaaacttaaaaaatattctaattacattctcagaaagatttgagtgcacactacatacattagaagagaaaaataaaggaaaatcagactgctatgaaaaccaagtttcccacttcatgctaaaaagtggtaacattgcatgtcagactgaagaaagacacctgagtctatgttgagttgtgtttggccccttgcaaggttgtcataaatgattcattgttttggcttaaggggctttcagctggatgacaaagcataaggacaaaaaatatgaaatttgtcattaaatgtcttcatcatttagcctgtttaattgtgctaagatcttttaagaaacaatgaatacagagatttccagattatacttccatgaaagcctaaatcttctcaggtattcacagtttaaaaaaattgaagtataccaaatgatatccaagtttactgtgaaagcaaatggcccataaaattttgcatttacatttgaattttaatctagagagaaggagaccacataagtaaaacacaatctatctcataggctgaagcgt

SEQ ID NO: 1828 - DNA, 581 bp, Homo sapiens
agactctccagccggccgctctggtgtggggagggagcgtcatctcaaggacactgaaaaagctgtttgccgttttgctgtttgcctccttgtcacgacctcagcgacggcagatggagccagtggagggagagagacagacggcaatgcttgggtagccagggctccctgccggccccactcctcctgcagacacgagcacgcacacacacacgcgcgcaaaacacacacgctgcccttcgccacacgtagccaagtaaaatacacaaaaagcaactgagataccattcgcacatgaccacatggaaacacacaaatgaacaaacgcattcaggcatagccacatgccagtcacacagatggatagacaagagcctggggtacaaagccacatggcacaaagccacctggatgtatatgcccctacacacgcacacagaaaaaaacatgcaaacttaagtacacacctatccagacaagtgtgagtgcacacacacacacactcacacactctacctgacacgttagtgcatccccattgggccccagtttctctcagcaaattcagatcacccagcctg

SEQ ID NO: 1829 - DNA, 2835 bp, Homo sapiens
tgcgaggaaagcaaagtctgggccatggagatgagcctagtcctgctgttcctgatccgcactgccctttttgcaccccagggagctgctgctgagccccacagtctttgttacaacctcacggtgctgtcccaggatggatctgtgcagtcagggtttctcgctgagggacatctggatggtcagctcttcctgctctgtgacaggcagaaaggcagggcagggccccggggacagtgggcagaagcagtcctgggagctgagacctgggacacagagactgaagacttgacagagaatgggcaggagctcaggaggaccctggctcatatcaagggccagaaaggaggaagaggagataaatatatgaaggtgctgtttggcacagaatttaatagggaagaaagagacagtataactcaccagtgctgggtctcatcatcctgcaatttcagaacaactatgaatacaaaaagaattttaaaatcccagtcctgcctagaaaggggaagtcatctctaaatatggtggccctggggcagctggcctccctgccaggcctcttccatgggggccctttctgcagtgactgtggtttcttcccattttactctgtcctgtgtcctgactgaagcgacaaggtgtgtctgcagctgtgctcacacctggaggaaacctcaatggtgacatgatgaccctagcagcacatcctctttcctgtgtcaagaagcatcgtccggggaggtgagaagaagacagtcctccctagaattgaagaaccagggagaaccagatgggctgggcagatcaagcacaaacctgagatccaactgtccctcttatgcgcctgggtttcttcactggacaccagtatgagtcaactttcctgtaaagcagaacaagcacgagattggaccatgttagaggaggaatggtgtcatctccacttctggagagatcactgtccccgtgtttgggggaaggaccaagcctcactcccatgcagagaagaagctctgactgtaactgcacctgtggagagtggagagacaagaagtgtgagctatttataaagctgagcacctgactgccacgggagtgatagtgaccacacacagcaagacctgggacatggcagtgactgtgtccagaactgacagaactaatctatcatattagaaatcaagaaagtgtctgctctagggttggggagggtgatttatgaccaagtagaacccaatggtgtttcctggaggctggaaatgctattccttgatgtggctgctatttacctgagtgttcactttgtgaaaatccacggcccacttatggtttgtccacctttctccatgcatgttgtccttcattcaagtatacatttctgatgttttgaaacaattctctctaagctaatatagaatctccattactgaaagtccttagaaatgctgcattggaaaaaattagtccaattattaaaaatctatgaaataaatgctgtgactcagacattaagaggagaatctacaacaagagcagtaggcttgggagctaacgcaagaacagctttggaaatggctgttgagccaggaactaggaatcaaaacccaaaaaggcccatgcaaggtggagggtgtgaaatgatgccccagtagtgcatgaatgaatgagtcatgggcagtggctcatgggttgcttggtcagtcaggaacttgagcaaaataaagttggaaaactgggggatggaagagagaggtatgcacagacctcttgacatgggcagagcttcagaagatggtggttgcaggtttccccaaatagagaacatcaataaaaaggtagaaattttacaaagagaccagataaaaagtttggagctgaaaagtgcaataactgaaatgaaaaattcactagaggggctccagagcaaatttcaccatgcagaatggagaatcagcaagcttgaagataagacaattgaaattctctagttcagtagcagaaagaaaaaaaattatgaagaaaaataaacagaactttaaagatctgtgagacaacatcaagcacatgcactttgggagtcctcaaagaaaggagagagagaaaggagaagaatgactatttaaagaataactccaaaccttccaaatttgatgaaaaacattattcatccaacaaacttgacaaattttaagcagcaaaaaaaattaaatttaaagaggtccacaccaagagaacattataatcaacctgtcaaaagccaatgacaaacagagcatattgaaatgaataacagagaaggaacttttcaggttcaatggatcctcaataagattgcagcccagttttcttcagaaaccatagagttcagaaggcattggaatgttgacaaatttagaggtcagaaaaaaaaagactgtcatgcaggaattgtgtgtctggaaaaactctccttcagaaataatggattttatatatatataaatatatatatatacacacatatatatacatatatatacatatatatgactatacatagtactacatatatataactatatatagtactactatgaaattatatatatagtactatatatagtagtcatactataaaagctagtagtaatatgtatatttttggtgtttatatgtgtgtgtgtgtgtgtgtgtgtgtgcatatatatatagtactatatatagtagtcctataaaagctagtagtaacatgtatatttttggtgtttaattcttcctttgtttttcctatttggtttaaaagaaaatgcccattgactaatgaatgaataaacaacatgtagtgtatttcta

SEQ ID NO: 1830 - DNA, 2447 bp, Homo sapiens
agtaactacagacgcgaagctcagcctctcggtttgggaattttcttggaggccgaggccctgcgcctctgtctgcacccaaggcgaccgcccagcttacccccggctcttctgagcacagggaggcctcccagcaaagcctgaaccctctaagtttagctgcaggcttcgaaccccgaccgtccccgccgagccttgggctgctgaggtggggatgaactgggcgaaagacacttgggagttaggaagaaacaaacaagcagggaagtgaccaggagacaagatgggcgtccacagaatgaatacaggaatgtctgtctgcctgtctgtgtatactctgtgaaggaatataccaacattacatgctgacccaaggatagccagtacgccttctgcaagaggaaagtttgtgtttcaaaatccatcaagtgaaagagaacagaaaaattcagagggcgtcattcacggtatcatttgaggatatgctgcagcaaaatgagtgaataaacaagaaagtcaaagacatgggattgaggaaacagtgacttcagcccaagattggaatgacagggagccccaggccactgggcagcagcacagacagcaatctgttcagactgcagcagaacagcaaactcctggagcaggtatgtgggagctgggaaaagacggttgcagagatggagtagtatccttgaggatatgaagctactcaaatatgtagtaaaggcaaatgatggggggaaaaaaggaaggcaattagaaactccaaaaaaattacacagaaaatgtaatctgggtcctgcaatcaactattttaatacaatcataataaatattttactgattttctatgtgtagatcaactgactacaaagaaaaactatgattacagaatacaaagtagatatttttaattctcagcaatacaaaagtacaagtgataaaaactgagaagcaaagtaggagttagagaagtagaagaaaaaattggggcactaatatcttcatttttaaaagtatcaagaggtggcgggggttccaagatggccgaataggaccagctccagtctacagctcccagtatgagcgacacagaagacgggtgacttctgcatttccaactgaggtaccgcattcatctcactggggcttgtcagacactgggtgcagcccacagagtgtgagccgaagcagggcgaggcatcgcctcacctgggaagcacaaggggtcaggaattccctttactagccaagggaagctgtggcagatggtacctggaaaatcgggacactcccaccctaatattgcgcttttccaacagccttaacaaacagcacaccaggagattatatcccgcgcctggctcagagggtcccatgcccacggagcctcgctcattgctagcacagcagtctgagatcaaactgcaaggcggcagtgaggctgggggaggggcatccgccattgctaaggcttgagtaggtaaacaaagcggcctggaagctcgaactgggtggagcccaccacagctcaaggaggcctgcctgcctctgtagactccacctctgggggcagggcatagctgaacaaaaggcagcagaaacttctgcagaattaaacatccctgtctgacagctttgaagacagtagtggttctcccagcacagtttgagatctgagaacagacagactacctcctcaagtggacccctgacccctgagtagcctaactggtaggcacctcccagtaggggccgactgacacctcatatggctgggtgcccctctgagacaaagcttccagaggaaggatcaggcagcaacattggccattctgcaatatttgctgttctgcagcctccactggtgatactcaggcaaacaaggtctggagtggacctacagcaaactccaacagacctgtagctgaaggtcctgttagaaggaaaactaacaaacagaaaggacatccacaccaaaaccccatctgtatgtcaccatcatcaaagaccaaaggtagataaaaccataaagatggggagaaactagagcagaaaagctgaaaattctaaaaatcagagcacctattctcctccaaagtaacgcagctcctcgccagcagcagaacaaagctggacagagaacaactttgacaagttgagagaagaaggcttcaaacgatcagtaataacaaacttctccgagctaaaggaggatgttcgaacccatcgcaaaaaagctaaaaacatgcaaaaaagagtagacgaatggctaactacaataaacagcatacagaagacctcaggtacccaatggagctgaaaaccatggcacgagaactatatgacacatgcacaagcttcagtagccgatttgatcaagtggaagaaagggtatcagtgattgtagatcaaatgaatgaaatgaagtgagaagagtttag

SEQ ID NO: 1831 - DNA, 568 bp, Homo sapiens
gaccccgagccaggcctgtcccaagtcctcccgggcccgccagcccgcggccccttaccttggcctggcatttccgatgacaggagaagctgcagactgcaagagggcgagacacagaaagaaagttttagccgcgaggctggagtgcaatggcgcaatctcggctcaccacaacctccgcctcccaggttcaagcaattctcctgcctcagcctcccaagtagctgggattacaggcacgcaccaccatgcccgggtaaggggctggctctcagcaccaggacctggcacagcatctgacccagaggacagctcagttcatgattgccagatggctgcacgcagcgcggaggagagccccctgggtctgaaatagaggctggagaggaggactgtgagtccagaggagggagagtgatggtatcccacacacaagccagcgtgtctaggactcctatctgaagacactgcagaggtgagtcctgagtgacagagactaagccatagaaagacagagagaaaaacagacaaaatgagaccgagtcagaggcagaaagccagagaggca

SEQ ID NO: 1832 - DNA, 356 bp, Homo sapiens
tgggcttgacaattataactctaggatgtttcatataccatacttggctacatctgttgtggaaaagagggatgatgtcatttttttcacctctttctgtaaatagaatttatgtagcacatgtgggcttcctcaagagaaatttaaaaccccaaattgatgggatggtgagacctaccacctctctcaagcatgtgtctctccaagtgacacacataagacactatttaaagcatgtactttggatgtgtgagccactgctcctggccttgcagtttttatagtataagttgtctcagtccgttttgtattgctgtaaagcaggggtccccaacccctgggcctattaggaatgg

SEQ ID NO: 1833 - DNA, 4059 bp, Homo sapiens
ggtgcaggagcgctcgagaaagcaggacgcggcgagcggttatgtaagcgcaccccccgcgcaccgccgcccggcttgtgcccgccaggcagcagcagccgcagccctaggagagagacgcgagaggccggagccgggggaaaagtcaaaagccccttcacgcacagcctgtgttaaccatgtacctcagtcccggcgcttcccccacaaactgagagcgacagggagaatttccgcacagtttcatccttggacacttcaggactgagcgggtgaggaggcgatctcgccagcctgctttatttttcggtggagaaggatgggctgagatgaaggcatttggggactcctacccctacccaccggcccccgccagcgcccttaggccccgagacggctggctgcaccagcctgacctctgctagggctgcagcctgagaccgcggcttgctctactgctggcgcagtttgacccttgggcttgtaccctgctccagcgggcttctcctttccactccggacacagcagtgagcagacccagccctcagcagaccccaagtggccttcttccccgttccagcttcaatagccaaccccactcccaccttccatccttctagagaggaaatggtgaaggggactccagagggaaggcgacatccatggtgccctccagtatacaaaggcagagacacagagccctcaggtagaacggggttccctagatggcatctcctacctccagagctcctgggtacccatcgagccccctaccttctgcctaagccagataggagtgacgatttttatactcagcgactttcggcctccttctgagagtgatgtcaggtcatcacccatagaagaaaggaagtgaaagaaaaagttcatgccttcttggagtgcagatgctcagagtgaaagaaacaacaagacttgagacagatgggtgccattgagcaaacccgaacatgcatgtctctctcatgtgagtgagtgcatgagactttattctccttatttccccagtgcagtgaaatctttctggataaaagaagtgggctaatggaaggagagacagaccaagtcccaatgacattgcctgaccattttcaccttcgccatcagcagtctccctcacagcattggtgtgggcaggtaagaagaaagcaaggccctgaaagaatatacattggaaaatgagcagtaatttgatactcttgtggaagagcatgactcttcgccccagaaaggccaatgacacctttactacagcgtaaagatcaaagccagggactgtgaaactgcctcatgatgtttctcccatgagacctgtgtctggatgtttatatggaacaaaacatggaacagaggcaatagtacttgatgtgtcttcagctggggctttggataaactaaactgatctatattcagggactaataattagggtgtgtggttagagcgcgtcctctctagggcctgttttggactgtggctgggccaccagcagtcctactgggcctttgcttcccccacaaattaaatatgttacaggggtggcaccaaggggtgacttgggaggcctttagtcccctctacctctctataatctccattagatcttctctgttatttgctattgatgcttttcagtttcatataggacgctataagaacacagcttcaaggcctcccttccgccacatactccctactaggcccctctacgtagtcactgcctctgggagtggctagagggagaagccataaactgggtcctttatgcagacattggatgctggatggagctgatttaccactggctcttagggacagacaagtgactcagcctaaggcagtttgaatttaagtttcctatcacaactagaaaagtcctgattaacacgcccagccctagtcaatgggctgattgagagatcgtcacatatcccaagaaaatctcacaagactgggaattttgtggatctgctggaaagagaagctgccagaagccccacgtgaaagggaactactgagagtgaagctaatgggaggaaaagtagagccaagccacggagggaaagacagatcaagttccaatgacattgcctgagttcctgaattcagtcatgcctgacatcatcctgacctctgcaggttttagctataggaatcagtaaattatgtcttacccaaggcagtttgaatttgggtttcctattacttgcaattagaaaagtcctaattaatacagtgggttttgcatctctgacttatgtggactatttcattttgaagtttaatggagattgatgaatcccgagctctttgtaaagaggggaaaactgaaatggtgaggtaaaataatgaattccccagacctgctcctccaaaatcaaaggagaaagtgatagttctgagtaatcagccaatcaattagtctttatcctagtatatactgaaaacctattgtgcacctttaaggtacacaaagtttaagacatgatttctcacctgttctatgtcccatctaattaggaaaaatgatttacaaactaatgaatagcaagacaaagagtagctaagagctaatgatgcgacacaggctataagcactgtaggagttcagacaggattgctgctccagtctctactcaaattgtatagaccaaaattgcaaacgcgtagctggcaggctgaaaatctggcttttctggcttcaaccttaaatttgtttttctaaaaaagacaggcatggtggtgctcacctgtagtcccagctactcaggagactgaagcagaaggatcatttgagcccaggagttcaagtctggcctaggcaacatagcaagacccccatctcaaaaaaataattgtagaaaaaaatatttttttaatatagcaaagatttcatataaaaaaatctagatttcaaacttctcttttaaaaatatcaaagtcaggcaacattgggcatatgtaatagtcaggataagctaggttttgctgcagtaacaaatatccccccaaactcattggcttaacaaaagaaaggctacttcccactcacacaagacaactgtggattgaggtgattctccagggcagctgtcttatagatgatgcctcagtatttataccttcatatcaacaagtgcatttacagccaccatggcagagaaaaagaagtagagagggccgaacactagcagtgaaatctttcctcctgaagtgacatacatcactttagcttacgtttcattggccaaagcaagtcacatggccatccttaatttcaaagatgcaaggaatctcagtcctcccatggaccatggaggagaaaggaaccagaaaatagcaaacaattaatatctgccacggcacgcgcttccttatggcaacaataggctggagcccattagaagctgccccttgaaatgggacttaaacacccagtttgacagtctccacccagcctgcctagcccttgggggcatttgattttgcaagtcctggtaaagataaagccaatctcaatatcagtctttcagatgtccctggtgatccgtggagttatcacacagttttcaaaaacaaatgttttgctctgcttgagacaaaaacttatgacatgcagaattcttacaatgaaaagcaggatggtatcatgaaatcaaacatgaagttgaaactagctgttattgtagtctgcaaattacataaacctgtttatggtgatttcttcctgttgctcttccctccatcaatcaaacacccaccaggagaaacaagcctcccaagctcttccctggagtggtagtgacttgggaaggggggcggggggatgtctaatttaacattttgaagcatttatatatatatatgaatatacatatatatagatgtgtgtgtctatataaatattcaaggctaaaatatttgagaagaaaacttgtgagctaggaatgggaaggcttctcttccaatgaccaccaatgagaatgttataaaatatgtctaaaggtttaagaataaatcagcatccatacaaatgca

SEQ ID NO: 1834 - DNA, 1417 bp, Homo sapiens
tgatgaatttgtgtgtgttgtggctgatgtgcattttggtgctttgtatgcaagtttaagaatatcttagcaataggaaaggaagatttatggcagtttaattaatgaatataatgaaggctaaaacttgtagataaatttataaggtgcttaagagctcttcaatttgttaatggaaagaaacaccatttacaccggatggctacaaagcaaccttattctgagagagaggatctcattctgtcacccaggctggagtgcatgatcatagctcactgcagcctcgacctcctgggctcaagtgatcctcctgctccagcctctcaagtagctaggactacagatcttttctcagaatagcagtctgtaggctgtcacctaaagtgtcctgttttcagtgctgcacctgctctgagcttcatctttttacgaagacgtcatggtgtgctatctgtactgggaaactttccccagcatcagccatctcctgaagataacattgtctgctagagattgtcatgtatgtggattgaatctctttatcttcatggatccagttgaaaatcaggcattgcatccagttatcatggctttaatcttaatgccttccctgcactgttttgggaatatcttaatactgctatttttgaagagtccagctcagttattctgcagaatgtctgttgatttggctttgctgtttcctcataagtagatccagattatacgtttttgttgatgttgggttcttctcagtgaatcacatccgatgatgtcagcacgaggcctgatcatttggtttaggtagctttcactagactttttcattgtaaaggtacctatcccttttctaattaataagtaatatgttgggtgatagtttgtgtgtgaatatccttttctccagtgacctttcatccaatggtttcagcattttaaatgatcctgggctgagtcagttttcagtggtggctgcagacttgtggttttccaattctttcatcacttttacatttattaattggcagtctatgacttcttatagccacataaagataattcaggaattatctgaacctatgaatgttaccttatttggaaaaagagtctttgcagatacaattcaattaagaatcttgagatgaggagattatcctggattatccaatgggccctaaatccaatgacaaatgtccttggcagagggagatttgagacaggagaagagaagacacgaaggagggaaggaagtgatgtgaccacagaggcagcgattggagtgatgtagtcacaagccaaggagcaccaacagccaccaggagctggaagagcccaagagtatatactaatacctggatttgggacttgggacttctggtctctagaagtaggaaagaataaacatctgttttttgtt

SEQ ID NO: 1835 - DNA, 207 bp, Homo sapiens
tccactattcaactcagtagagcattcataaatgccttgtggaaactctgaagccacccaacaacacactttgaggttatcttgattgctctaggggaagccagctggcatgggaagtagtgcagtggagaaatgcacatggccagagactaagaccaatcatttgaatgagtttggaagcatcctacccaccactgccaccagtca

SEQ ID NO: 1836 - DNA, 612 bp, Homo sapiens
gtaggcatcccgggggacaaacgctgggtcgtcctgagtcgctcccactcgccaggtcccataaccttgaagactgccagacttccccagccgaagcatcgcaccctggtgctcgagaacttggtcgaattttctcctctgtcagagaagagactggctggcagagcaaggggtcttgctgtgtccctcgggctggagtgcagtggcaccatcacagttcacttgcagcctcgacctccctgggttcaagccatcctcctgcctcagcctccagaggagctggactacagatatggagtcgcctaagctggagtgcagtgacatgatctcggctcactgtaacctctgtctcccggattcaagcaattctcctgcctcagcctctggagtagctgggattacagctgggtgcggtggctcaggactgtaattccagctacatgagaggattgcctgaggccaggagtttgagaccagcctgaacaacataatagactgggagctccatgaggtccgagacaacctgaagacgcccagctcagcagagactggctacggcaatcactcagtaactatttgttgaattggacataatagaagagctgaagaatt

SEQ ID NO: 1837 - DNA, 861 bp, Homo sapiens
cgctcgcgcctctccctccacacctctctgcaagctgagggagccggcttcggccttggccggcccagaaaggggctcccacagtgcagcggcgggctgaagggctcctcaagtgccgccaaagtgggagcccaggcagaggaggcgccgagagcgagcgagggctgtgagggctgccctcatgctgtcacctctcacctgggtctggagctgcagctgtgcccagaagtgtgggctcccgctggccttgtggagcgcacaactctggccacaccccccacttcagccagtttcttctcagcagccactccagagggaccacctctggcatcttaaatacattaccagctctgctccaagattttttctccctgggatcaggctggagtgcagtggcatgatcatagctcactgtaacccccaactcctgggctcaagcaattccctcctcagcctcctgagtggctagaacttcagggatgtgtcaccacacccaggtctaagtcatcagaaaagaacattagaacattctcacagagccttacaatctgaaaacccactgcctttcgaaaggatcaggcaagtggttggactaaattacattcccgctgacagtacgaatttggaatagagatgtacaaagacacgagggaaatgcttggaagctctcaagtgcggagaattctttgcacagactccctctctctgcacagatgaacaccatgagcttgctggaaggggttcaaagaacagcccacagcagcactcgagtttgctaaagtgactgacgttggcttcagtttggaatccaaaggcgacaactgacaaggaagagcggaagggaagggagaagtgagattt

SEQ ID NO: 1838 - DNA, 703 bp, Homo sapiens
atgttggaatttctgatgaatctgcagtcagcattttgcatgaactgtgtgtggattcattgcctacattggatgatgaagacttgagtgttgctactaagcagtgtgtccccaagaaagtgtcagagcctttacgtggaccttctcatgaaaaaggaaacagaatagtcaatggaaaaggaaaagggcctcctgcaaaacatccttccttgaagcctagcactgaagtggaagatcctgctgtgaaaggagcagtacaaagaaagtatgtacagacattgagagcagaacaaaccttaccagtggctttagaggaagagcaagaaaggtgtgaaagaagtgaaaagaagcaatcacaggtcaaagaaggaaataatacaaacaaaagtgaaaaaatacaactatcagaaaatgtatgtcatagtacatcttctgctgctgctgacagattaaccaaagaaagaaagattgggaaaacgtatcctcagcaatttcccaagaaactgaaggaaaagcatgatagatgcatcttaagacaagaaagtgaagaaaaaacaaatgttaatatgctgtgcaaaaaaatagagaagaattagaaaggaaagggaaacaatataagaaagaagttgaagcaaaacaacttgaaccaactattcaatcactagagatgaaaccgaagactacaagaaatactccaaatcag

SEQ ID NO: 1839 - DNA, 583 bp, Homo sapiens
atcccgcgtcgctgttgtcgctgttgcagccgagttcagccgggagcagagcgaaccgcaccggcccgagcggagcgccgcacgttcccaaccgcgaggccaggtggggtctcactctgttgcccaagctggagtgcagtggcacaatctcgcctcactgcaaccgccgcctcccaggcccaagcaattctcccacctcagccttctgagtagccaggaccgcaagtgtgcaacatcaagcctggacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagaggtcgaggaccctgcacggagctgtatggagggcaagagcttcctacagaaaagtcccagcaaggagccacacttcactgacttcgaggggaagacatcattcgggatgtcagtgttcaacctcagcaatgccatcatgggcagcggcatcctgggactcgcctatgccatggccaatacgggcatt

SEQ ID NO: 1840 - DNA, 75 bp, Homo sapiens
gtcagatgatttgaattgataagctgatgttctgtgaggtacaaaagttaatagcatgttagagttctgatggca

SEQ ID NO: 1841 - DNA, 803 bp, Homo sapiens
gtgagggtggctttgtgaggatggctttgtgtggctgcacattgcccttggccaagccccgctgccaggagaggcagctcggctgccaaacctcctgaacccaagttacctgagcaagcagccctatcccctcgcctgcttctcactgcctcgcctgccttgggcctgcccgacccagggggtcacatgccttgttccccatcagtggagaccagggacaagaagacagttctgtgggaagagccaggaggaccatttgggaaaatacaggttccaggtgtgtctccagaccttgagagttggtgtctcctgggaagaggccctgatgagatctggggagattcggatctgatgagattcaggaagccctggcctctccgtacttgaggagacgggacacacaggacaagctgcaggctggtgagcaggttcaccttctattttgaagacccgcttcttcctcaggtacctgatcttgaaaacgacctcccctttcaggtcttgcttcccctcaacccagacaccgactcgcccaagggtcttccagctggctgagttggaacctgcattttttaaccacaaggaaaagaagcccagagctaccaagaataatattttattgacttggaatgagttttggaatctgtatttttaacaagctgcccagtgaaaaccatttcctcctcgtcgtggcgcaggtccagaggctgcgcccatctctcccacgtcaacagtcctgtgtccttggcgaaggactgttctctcattcagtgcctttcctctcttcctgggccaaatccctg

SEQ ID NO: 1842 - DNA, 3620 bp, Homo sapiens
attattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttgagttgcaaaacgtaccgcgtagacgcccctggtggcgccgagagaagagctaggcctgcccagcacagagccggagagcgtcgggccttccggaagggtcgacgagatgagttcctacttgacctctgagccgaggtgggccggaaaccgaggcctaggccccgccggggctgcaaggaaaaggggaaactccgagcgtagcgtcttttccttgtggttcctttctccggcatcccggactgcgggccctgcagccacctggaccggcattcaaaggattctgcaagtccagcttcacagactggctttcccagacgctccgaagcccgcaccacgaacagaataaaggagagacgagagatcgcaactagatttgagaatcctcgttcttttccccaatcgttcgggcagtaaactccggagccggctacagcgcgcatcctcccttcctcctttcggagaactgtcgctttcccgaagctgctcccagctgggttttctcccgaagtttatttttctcattttgcaaaattcctgccctgattttaatactgcaacaggacagcagaggttcctctttaaaaagtcaaaacccaaaccaaaggggcccattgctgttgataatttttttcttcaccttctccttccgtttttaagaaagacacttccaaaactacccattgttttcctctcaaaagagaactcgctttaaaatgcatccctttctatttctctccggatatgtccccacctgacccggtggcaacttgtggggcgtgggggtagtgaaaaatagaagtgtggacggggctgggaaaatgaataagaattataacaatagaaatgatgacaaaactaaactttgaccaattcaatttgcaaaagaaagggttggtctgagggtgagacattccctggtttctcaagggggtcactttccctctcaccgagttaaatctggctctgttatattttttccaggaacacagtatgtctcttcccaatgttttattcggtttctggtttccccacttttgaccggaagtatgtgggaagaatactggctgttattattatgattattgagtgtccaatactctcctccaatatttccaccaagaattattatcgctgctctcctcattcatgttagtgttgctttgtgtgctttagatgacaatcgtcctctttactctccaagtttggagggtgagggttttttgttgtggtggtggtggttgggttcttctttgtttttgtttttttgtttttcctgttcggggtaatgaaatgagaactggaagagaggatatcatttcgaggcccagctgagaaggatcccaatgcgaaaaatttacacacttcaaagagcagaaaggtggaagcgagtggtgcttggacacaaggatgccactgttcttatctcctccaatttgggaagtgcccagcctagaaaggtgagggtcccatctgggagaccatggagtacccccagggtcacactgagcctaagaacttcaaccatcctgcaggtcaaaacccactgataggtctcccaaaatgtttggggtagggggaagaaacatagggcattccaggtctgtaaccctgcaagagagagactcaaactaatatgtctaggtctggggtgaaggtggggggcctgtctggatacctcctccctcaattgaagggctcgttggaaacataggaacccactgctctctgggactctggaaagacaaattttctttggcaaacggaacagtgtcgcgctgtcgacagagcagactatttttcttgttccctcacaaggtgggggtggggggaaagaaaaggaagcaagaaagaaagggaaattaaatccacacgtgttaagctcgctcaaagggccagagtcaaaaccagagatgaaacttcgactccagttctggctgcccgcgggcctctttccaaccagccaggcctcacagagcaaggcatccccactggagagaattcgatctgatgtttcataaagcgctttatttaaggagaaggggcatgggtctgtctccaagtctgtgctgcagaaatccagaatttgtagcggcaaagaaaacaaaggagataacaattgtaatcataatgaccctctttatgaaaactcatcttgatgtcctccaaatcaaaacaacaattcaggcaatattcaagcaatggccaaaatcatccaggccattaaatcatccaggccattgttttacaaaattcctaaggtctgatcaggctttcggacttgggcctagctgggtcaagagaacctgaaatgctgttgtcaagagactctgaaatcaccagtttaatcaggacagctaatctctacatccttgaggcctctcttttggggagagactttcttgagagaggacactacaggactcagctacagagctctgctatacatgggtgggagtggaggccgccaccccacctggaactgtgagtgaaaactctagtaatgatcttgaggaggtgaagggaggtaggtgggggtgtgggtgatgagggaggccaaaccccaatctggaaggatctgtcactgaaacaattgcttggtcgagacctctaatttttcttcctctccagccagtctcctgtggctccctggtgctgggtttctggcctttggtgacatcctaacagaagggtccggaagcagggaccccagacaccttgctccctctcccaaatcacacccaaaacatactggggtgaaacaactgacagagggtctctgtggtgagcaactgactgaagtttccagtggaaaagttcctgacgattgtttccgcagggaccttgaatttcctggtcaccatggcgacctggaagtcccaccgaatgctctcaacaatggggtaccccgaggacattcgtgcaattggctgcgcagtctgaggcctgaaaagcgtttctgccaatcgttcttgactttctggagcctccttagtgggttcaacggagcagggatttttaaaactgcccccttttttaaacaggggagaaaattgagatttagtaccaggtgggttcaggtcctgagcaaaagccccatctttgaattcagaatgctgaccccagggccgatcgtgtagagcctatggtgtatcttaatcgaaacccgtggcccaaacatctcagccaggaacctgggactttaggtgtcacttaatctcttcacacctgttaactacacctatctgcataggaggctccccacatcagtccaggcaacttttttctttgcctggggccatttcttctaaatggaaggagaaaagtctgagcattagaaattgtggcattaatgtctgcaagggctaatggagtgaaaagaatacattattctccttttcttcttagaaaaaaatttcaattgtggatgtaatagaaataccattaaaataatatttctgattgc

SEQ ID NO: 1843 - DNA, 2969 bp, Homo sapiens
tgtcgggtcccaaaatacgtggtctaaagtcctttgggctcctgccgctgccagcactgatcatatgctcttgaccctggtcgggtggggggatgtctggatacctcctctgtggaaagaactggccacacatccgcagaggtgactcgggctgagaacccaggctcctcctccctttggtgacacgcccctcggtccctcactggcacttctccctccggccacacggcggcgtctcgccatagcgcagcggccgatggtacagcccgctcccccctcgcgctctcggacagtgggtccttccacttgtagaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgcactttggcatttgtgttttaagtgattaactgccagaaacagctatttctaaaaagttataagggaggaggggttcttttttgatcagtattcactgctgtcaccataattaatagccttaaaatagcttgtgtttggcccaaagagaaatgtactttcttccagtgactcaaaaatcgtggctagaactagactgatttctagtgacaggtgtgctttactgcactcaatgcgtatttttcctccaactaaattgtacatttaatgttgccatatcttctgcctttgctttgcaggaaacgacaaataatgtatagaggtattcaaaaaatttattgaaagcactgtactaggagctgagaacacgatgatgagcacaacacagttcttccctttggaaacatagataagtggagggaatgtcatcacaaatgtaaaacttcactatgagatgagttccgtgataggattttcttagggaaacctgagaaagagttgagactaaaggtatgtgtcatatttttcacaaggcaaaactgggggaatgacatatacagaggcttgggctagaaaaaagataccgttagtccacttacttttgagacagttttggctgctttccctcttcagtgccctgttttagaactgagtccttactgaggcttgtaagatggctattatgggaggtgagagtgttacaaaatgaggctgaagaggtaggtaaagaagccagaccacttcaggctccctctggctttattaaagcaagataaatccatggtggaaaatcagatttgcaagaaaaggtagttgaactaggttgcttattgttgtctagacaagagaccagcttggactagtaaaattagtgaaataagatcgtttatagttggatgacagagccaactagacgtggtaatagtggaggtgtccataactgctaggtgtccagcttgcacactgatgagcataatgaccctagattcagctggggagcagcatttaaacagctgaatttttaaattacctttgagaaacccaaatggtctttttgcagtagcacattactcagtagtctaaactacagaaataaaccttaaggccatgggtataaatgagatctgctggtggtagaggaagagggcctagggtctgaagtttgagaaactccactaattaatggcaaggtaaagcatgataagccagaaaggatggtcagtggtaggagcaaaataggattatattaaagaagcaaaagaatgtcctaaaaattctccctgggattaagtaacacagtgattgatattagtggagtagagggaaagatccatgttagagatagcttaagatagggattagatgaattgagggcaatgactaaagatactgcttgcaagaaaactggctgagaatgagaggaaaatcttagttgcttggcgggagggggtttgtggttgtgaaagatagttttgtttaatcttagtcttaaatttaaaaccaagtagcaaggatctagctgagagaataattgaatacattaatataggaggacagacaaagatcctgaaaaggctgggagaagagcatccaaagcacaggtggagagacaaaaaggttagggctgctggcagctgtggagagaactgtacgtggtaagggggagatataagatgtcctgcataagtattttccctgtagattgcaaagtcatctatggagaggaaaggtacaaaatagtcactggggagagcaggtgaattagatggccaagcagggtggatggatcatttgaggtttggggtgacagatcaactgagatccacttacacttctgaaaacgcaagaacactttagaaattaacaacacttaaagctttttacatcatttgtaaataactggtggaacttaacaccacaaaataaagtattataaagaactttatatgaataaaaatatatgcagtctgaaa

SEQ ID NO: 1844 - DNA, 137 bp, Homo sapiens
atccaaggtgattccctctccaaggggacatcagtgcctctcaggaaagtagcagcttggaatagaatctggcatgcctaaggcctttggggaactgggatgcttatttcctctgccttccttggctgcccacatgg

SEQ ID NO: 1845 - DNA, 542 bp, Homo sapiens
gccgccgccgcagcctctgccccactcgtgagggatccgagggctccgtccttgtgctgtcttcgccccggctcccaggggtcaaacgagggtcgggggtggggacacgcagcctagccactgtcctgcctgggatccggtctcccccgccccccggctgcagggtggataaagaggaagatgtgaagaggaggcagacaaaagcaaaaggacatcctgtcagtaggaaacggccgaattacaattcagatgtgcaatgtttgcataagtaaactgacacgggactattatatgcagaaatccacgtgcaaaaattttcagacacacctttgtacctcttcctaatcctgccctggtaaaatggcggttatcagtgcaagtttgaggatacatacagctggaaaatggacatcaccaaactggactccagaaagttctgtctaggattttattagactgctttttttctcaatatacctgtattggaagattgagacaaaaaggcacaaactcacattaaataaacaaggtaatctaatcaa

SEQ ID NO: 1846 - DNA, 634 bp, Homo sapiens
aaagatcctggaaggtgccagcaagtgaggttaggtttcccactgtagatgtaatggaaacatggtttccccaccaacttcgaggcttgagagcattcagaaaaagtttggtcaaccttgtaggggaaccagcccgctataccacccgcgggttctccccttcccagtggagacgagggaatgagaaaagaaataaagacaaacacacaaagttcaagagttaacaaaagtgggtccaggggtccatcgcaatgtggaaactgcgacagccctgagctctggattccactgatatttactgaataatccttaaagtccaactaattggttaacagaacaggacgtgaaagcagacagcccgtcagaccacaggcctgtgcatcaaaggagcggtccactccaagcaccatcagcagggcagcagagctctctgcctctgggaacgagcgagagatagaagactttccccttatcctcagaggacttctcctcttttacaagcaacctcctgctgttcccttctggggaatggagcaggggtcgcttcccttcccacaagacctttgttcagggactcaagtgggaggttgagcaataagcaagctttcttgcttagaggctccgcacacttcct

SEQ ID NO: 1847 - DNA, 436 bp, Homo sapiens
cccggcctcttcggggacgcacggttggaagttgtaccgtgacgtgatggtcagatcggatgatagaattttgaaacctccccagcattaaggcaagaaaggtgtctctgttttttccgaagtgtgcctgcttgactcctttgatttttctctgggattcttcatcctccatcaagttgatcgatccctctggatcttggtcagtttcctgacatctctatgaagttcagtgacccagactgagtccacgtctcaaataaggttctgactaatgcagagtctaacagaaagattactgaacatgtcatgcactattaataactcctgttatcgaggatttttttttcacaataggaatgaacagagttctgactcactctaggtttgtggtaaattgcagatcactttctgctttatttagcgggagtccctgttg

SEQ ID NO: 1848 - DNA, 854 bp, Homo sapiens
gcaaacctttcattggagaacagtcttcccccacaccatcccatagaaatactgttcactatatctggttcaggaggactgactctcccaactcctttctccaggagtggatacatgatccaggactggccagaattctacatcaagcagcccgtaggcacggaggagaatacaaattagaggatcagccagcaaacttgatgggtgatgagaactgttcaagacaaccctgaagatgttgcttatttgataaggttgctggtgctgctgctactgaagatagaacaacagttaagctttctgtgtatgtgtgtgttttccatctgtttttctttgtaatcagtcggtataaaagtgagcagtgaagaatcggggggaaataaatgtactttttaaacatgttaaatttggaaaatatctagagctcagaagaaaagtgtaaacttaagttagagatttgagagttagtgaagctctaagaggggcagagtgtaaaggtgagggcaacaagtatatgtgcacacacaatcacacacatacaccggtggcaggcaaagaaagattaaatcccttcttagcaaaacttcaattctgagaagatttttcctatctgaatttgttgaacaatattagagattttttttttctaaccacttcataaataataaaactgagcaacagagaggatgggtggctgacttgttaaggaactcctaattagtgctaaagagtcttaaaacctaggtttctgggctcccaattccaggttccttggaagtcaagagaagacaaaaacatacgatcatttactttatccctaacttcacttgaataaaacattccataagattaag

SEQ ID NO: 1849 - DNA, 2586 bp, Homo sapiens
gcgcccgccccgcgcgcccctgtactccccgcgccgctcctcggggtcccgcggcgctcgcaggccgcgccgccctgccgcccctctctcgtggcttttacggcccgcccgcccctcagcagccctggggtgcccggggcggccctgcaagcgggagagagcggcgaggcggcggcgccgagtgcggggggatgcggagccgtgcccggccctgtcgcatccctcggccgcccgcccgcgcccggccccgcccggccttgcccgggctgcacgcacttctcccgcggcccagaatccacttgaccctgctgggcgctcccgcgggcggcggacccgggtgggtgcgggggaattccccggccgcccaggcgcggggagagtgagctgtgccgcccgcagcagcgccccaaacaaaccgtttaaggtctctggagcccgcaagttcagcgaaataaagcggcggcgcggaggaaacctcttccacccggacctgctctccgttgcggtttggcctccagtggtggtcccacccaccctctagctggccagccctggaaaccaacctcctttctttttatttctcaccgggaagggggacaaactggcctctgggtgtcgacttcaaacttgccgcccgtctccggtctggaaaggcaggtgatcagctagaagggtgataagagtatcatcgtggctcctaaagagtaataataatctccctcattgtaaagacagctcttccccctggcttacttttttagacatgctgagaagcgcatgtctccatcagggccctacctctgcttctccacagttggcctagaaccggaagcccctccaaggccccctgactctcctgacctcttggccacagctccggattctcaccagggattccccagaattcctagagagcagctcagagccctgcagttgtgcctcaccacgcgaaccaaacctcgcactccccgccaaaagggagtcccttccagcactctcccctttgttcctttttctgggcaagaaccgctgactggggctgccagaaatgtaaaccctgggtgcaagtgacgggatccctccagcgtcaagccgaagagtcatcctctcacctcacccacctccgaatgaggattaacaaactcaattcaggacacaggtagaagaccaaaaggccaatgagacttctttcctatttgagatcggatttgagaatgctcagcctggctcccttcttcccccagctctgaatcaatcctttcttcattagcatccataactaatgtgcaaaatgtaaaacgctaaattaagacagagttggcatcaacatagtctgagaaaatgaaattgttattttacaagctgataactctcagccctcaaaaacccctctcattagctgaaggtagcaagtagcaagaagattaggtaaaaacatagagaatatgaatataggaaaaagtacaggtgtgaagggctggctgcccaaatcccaatgcacagtgtatttggaaaaagaaaaaaaagaaaaagaaaatctgtctttctaatatccccttagcatacgccttgttggaaatgtttgctttggcgaaagtgagatcgagacattgagacagcattcccaggaacaaaggctgggggtggagggtggaggagggagcaggaacagcccctgtctggaagaactgcaagttctgaggcctgaacaagaaatgtgtcctgttcccgtgctcctggctgcagctgggaagcttcttcagaaaggagacctcccggccctcaccgggatctggctttccttcccttcccaccacatctgtttatacaaaggagggccgctgaaggacaaacataaccgtgtttactgcgagtcccatgctgggcctggagctcagatacagatttgccctcaccatggaggctgaagataaatagatgatcccagaaaaggaaagagggaaggccctgggatggtatagagctggttgaggggtttactcatgaaaggcctctcccaaaaagccatgtagtaacgggcagatttacgtttgaatttaaactctggtgccttgtgttaatatatgagagtgtgtgcacctaaagcaattgcaaggcgggtatttaaaaatgtttctttaggaatagccatgattttctgtttggggcctctaacatggggatagttggattgattatttccagtgttatgttttcatgtaatagtgtcttggagaatgaggacttttgaggaaacccaaatagtagttgcagatcctgttttttactaagctgtcatggagataaatccaaaatagtttttacaagtaaaatgtagaacagttagtgagagcctttatgggagatctttattatttatctggtttatgaagatgttcctattatcctccagcctctgggtatgcaaaccaaaacaagcacttaatctagttgtcaaaattttaactccttaatacaaagcaaaaaaagggtttggacttttggggattagaatgtcagaactaaaagggaacttttttatgtaaaagagaaagagactctctaaaaataaaaatgttagagtga

SEQ ID NO: 1850 - DNA, 581 bp, Homo sapiens
actgagactaaggtagaaaaagacacttccaaagggtgtcaatgacaagagagaaatagacatagagtggtcacttcatttaccaaccctggaaccgcagacctctgggcttcctggctctaggaatgcagtgcaagacaggcaaggttcttgctcatacagagcttctagaaacctgggatacagagatgcaatcaagtgataaaacacatggatgaaggctctgccattgaacacatggttcttgacaagcccacagagaggcacagctaagccagccctggggagccagggagggttccctggagggagagaagctggatccaggtctgaaagatgacttgaagtcagccatgagcaaggaagagattttccaggccaagcgaacagcctataaagaaaatgggtacggccaagaccatagacctagtgattgtcagatgaacaattagacccacagaaccatccaagctacagaggacgcattctgccttcccttggatcctgtggtttgaggatggaggtctaggaccgtggcaggctttttgtcccatgagggaaggccatggagctgaggaagg

SEQ ID NO: 1851 - DNA, 522 bp, Homo sapiens
aactacagacgcgaagctcagcctctcggtttgggaattttcttggaggccgaggccctgcgcctctgtctgcacccaaggcgaccgcccagcttacccccggctcttctgagcacagggaggcctcccagcaaagcctgaaccctctaagtttagctgcaggcttcgaaccccgaccgtccccgccgagccttgggctgctgaggtggggatgaactgggcgaaagacacttgggagttaggaagaaacaaacaagcagggaagtgaccaggagacaagatgggcgtccacagaatgaatacaggaatgtctgtctgcctgtctgtgtatactctgtgaaggaatataccaacattacatgctgacccaaggatagccagtacgccttctgcaagaggaaagtttgtgtttcaaaatccatcaagtgaaagagaacagaaaaattcagagggcgtcattcacgtgtacaacgtggagggtgaaagaatgagctggaagcaggcatcataaagcaccatcgt

SEQ ID NO: 1852 - DNA, 938 bp, Homo sapiens
acactcattttactcagcattcctggagggcaagagggcaattcctaagggcctgtctatggcggtgcagctaatgggaaaacaggagaggagcctgccactctagcaaagagaatttccagctctgcgtctccagggagtaagaaaagagaaatggaaaatagaaaacaaagctggctgcttcaacagtaactcagtgctctccataacagcaatcccatgcatggtctccagaggtacatctcagttcccttttcaatacccaaagcaattttcctgagagattggaaaatcaggaggaggcaagccgatgacattttgattgcaggccccactcggagaggcattgtggaactttctggttaacaaagttaaaaccaaaacaaagtaaatgacgaatccaccacctcaatctgcattgtattttttgtttttaaagaaaatggtaaaacttttgctgctgcttttagtgactgagattttcaagagtggattgaagaaattattatcagtctgtttggcagctaagaaacctgctttgagatgggtagttgcttattaataatactgctttccacttcagcctcatctgtaaggcactgaactagctgctactgggtcttcaacctaccttcagacttctactgcatgaagtctttccacatctactgtgagatggatcacttcttctccgttcccagcactttttgggtatctctcctatgtcataggagagacattacatctatgtaatagatgtaatgatgttgtacaaggctgagcaacctcagccttgctctaaaattatttacatcatagtttaccattctttgagggtggcactttgcatttcatagaataattgaacatttagagaattaattgaatgaatgcatggatgcagagttggatggaggaatggatacatgatggtagat

SEQ ID NO: 1853 - DNA, 2696 bp, Homo sapiens
catggcggcgtcggcggctctgtctgcggcggcggcggcggcagccctgtctggcttggcggttcggctgtcgcgctcggcggcggcccgaggctcatacggcgccttctgcaaggggctcacgcgcacgctgctcaccttcttcgacctggcctggcggctgcgcatgaacttcccctacttctacatcgtggcctcggtgatgctcaacgtccgcctgcaagtgcggatcgagtgagcgccggcggcggcggcggccgcggaggcccggctggaggggcgacagtgtccccgcccgcccccggccgggtcgcgggcatgaaggacagctggatcgcggcggggggcggaggtggggcggcccgggcccctggactctagacctacgccgcccgggcacgaaggcccagccctggccctggccgcggtctcagcccgggaccccggatcgcgcagaaatgcactgaacaggcccctacaattgggctccagaaactacctgagctcggactacctgttgcctcacattggcaaaagagggggaaaccagaaggagggaattctgctgcggcgacttgactttccccgccccgagcagaaaggcattgacgtttgtaggcggtgacccgccccttctctggccttgccaagagtctcatccctaccctggggcacctctgaccctggacctgcttgggcagaggcagcgtgaagggcctgaacaagaggagaagaagggccttcctagtagaggcacagcatggacaaaggctcacaggggtgggggtgcccagtgatcgagtcctggcttgggagggaaggtctgagttccctgggaactgaaatcggctagcagcactgtgagagaggtgtatttccccctcctaatgacagaggaaaccgaggcttcggggagggggggatttgcccttgacatgcagataggatgaggaggaactgcgtgtgcccctgggcctgcaggctcccacacccctccccagtcttctccaagacctggcatgatgggaggagggaggggaaagtgaagagggaagcatagggctcctagggcaccaagggagaggggcccaagggtagggaatctggggatctcgctttctttggagcagtacagaagatcacaggaaagattaggacagacagctgagatggcagacaggagagatgggccccaggatccctggggagccaagctttcccccacagcctagcctccccaccccacctggagcttcaccaagggcttttcagcagtgaagtggcacaaacctcccagtttggtgggcaagtggggctgatggtggtgtcatggctcctggagacacgacataaccaggagggtgaagggataaacctggggtgggctggggctgagacccatggcatgaccccaattctctctcctcaagctcgacccccccgccatccccaggatcacacaggagaatctcatcctcacggcttggattggtcctgggggcccccggttgtgctgctaactggtgtacaatgctcaagagcagcccagaggggagccaggaagggaccctcgccctcacctgctatccccatttccgcatctcttgcactggtaccctgagggccacattctcagttcctgggattgaaaactgcagcagtctggccagctccagggacagagtgatccaaccacctaccacgtaccctcctcagcaggccactggacccaggtcctgaatgaagctgtccgcctgcctcaccccagaagaggctggacagtggctgcctcgtgccccctgcagtctcccacagccagggcccgatggggtgcctccttgtcccaagtctcctgagaacccctgaccttgctggcctctctcatccgccccaaccctgtccacccttgaccacctctgggggcctgtcagcctgctggtccccccaacagatctctgggggcagcctctgtgggacaagagtgatacagagctggaggagaagaggagtgaggggcctccttgtgtctgatgcacagatgtggccctttcaaaccctggtgtcaccctctgggtgactggatccctagctccagcctcttcctgggccagccaggaagggtggaggaaagttctttgctgattgcatgtgtgatacagtggggggtgcctgagccctccccatgcaaggggctcatcctgggactctggaagctgcttccctactgggagaaatgtgtgtcggagctgcaggggtccctaccctcagagacccccgactgcagggaacccaccccataagagggtcacggatgtccatgtccgcccaccccccgtggcttctgctgtggctatattggcctagaggggctgactggggaggagcagggctaagccctcagcatttgctcctgtccctgccttttcacccctgctgcctgaagtggtagccccgcctgctgcttctctacctcccctccccacctcttctctcccctacagggcccttgctgcgtgatggggtctccatgcactttatttatttgcagtctgttttctaggcggtggagcttctagacaccgaccggaatgacatacgtttctgtgtgtgattcactgtgtactggtcagcacaggctggccagagagatgttcttgtttctggtgttgtcacgtcttcttgttttctctaagttt

SEQ ID NO: 1854 - DNA, 3004 bp, Homo sapiens
atcttctgcttcaccccatgctcggtccctgagccagttctgtcattggttctttcagaccagggcaggaaaagtcaagaaagcaaaagcggattctaggctgtggggtttgctgtttgctagccccctggcagagatgcctgtccttgcagtcctgaactggtggccaagtgtgcatgcatgcacgtgcaggtgtgtgcatgtgcaggtgtgcatgcgtgtatgtgcgcacacacattcatgcttgtacatgtttgtgtacacgcacacttttttctgctttcaatttcaagctgttgcctccctgatgtgtctgtttagtgacttgagccagaaagattcccggttctatgtgggatgagaatgaacgcaggcaggtctccacagaagtgagtaaagtagagctgagaagaaggacattgtctcatgccagcctgtccaatagccactttgccccagccctgcctcaagccccagagagatgacaaggctctctctgtttgtcgactccttgaagctcagaaaggtgggtcaagaggtgcccgtcaagcgtttaggcaagcacaggaccctgatctttactaagtctccacatctctcttgcacagccctgggctcagggcttggtcccctctgggcaggccatccagactaagtgacagtcagattgtgtgtggggaggctagagacatccattcttcatggatcagcctgaatggctggacagatcttgcaaatggattgtgtaagacagagtgtggaagaggaggctgtgatcagtggcttggagagcagagtgtggtcaggcgctaaacctaaggcttttctgggaagagctgttaagattagactgttctcccaaaaagccaataattctgagtgtctccattaatgcctaggtagcccatactctcacccagccggtgcccttcagcctggaacctttggatggaggattggaccttgtgaccttcaagttcccttccgaaccaaatatgctctaacccaggagatggtgctgttgcccaggaagccggtcaccatgacgagagtacccgctcagatgaggatgcaggcggaggcggtgaaggtgctggaggccaggatgctgaggtagctgctcctctccaccagggtccagatgcccatggccaggacagctgcccccctgacctgcaggagaccaccaggttggagcagggggtggcgggggcctcaggagctgccattccttgagtgcccgctgggtaccaggcacttctcgtgcattgtcttattcaatttaggcctcctaagagcctgtgagaacagtgtggtggcctagctttacagatgaggaaacggaggctgagagaggtttgcaggcttgtccaaggtcacacatgtaagcgagctgcagattttgaatctgggtctgacttctgattctgtgcatcttactatggttcctactgcatatgaggcggggagaaatgacttcagttttggggatgactaatatacctgagtcccttcgcctcccctcccctcagagcgctccctccctctgtccacgtttccctgatggatgtggaggtgccattttgagcacctccccttgttcaatccttatatttgcccattggggaagcacggctgggccccttatccctccctgttctacagaggaaggaactgaggcccatggaggagaggtaaatggcccgagttaggggcagggccaggaccaggactcagagcccagggcctgcttgctcagtctcgctgcctccatgatggaagggccactgtgctggacaagttggagctccctgggaccacaggaggagggaggagagccttctttgctgtctgactccctttcagtcctgagagggggcagggacgggacactgctgatttgcaggtctgggggatgccttcttggaaatagagtacctgggaaatgtagctggggtggtggggcttgactgttctttcctgccatgaagctgaggagccttttagtgactgttatcctcagcagagcatagtgggtgggtgcaagtgtcctcaaggtgccagatgggggctgtttggagtgttttcccaggatttgggtcctctgggacctctgaccatctctgtcatttgctcctgggaaggtggacttctgtctcccagtctctctgcccgccatttagggacgggtccatttcctctgatggtcagtagatgcttcctcaaggggtcttgggtgtagccaaagctagagaagccctcccgggctctgttcacatcccctgatgcttttccctgcaagttgtctcccgtctgccccaggaagactctctgtataacctaacctgtcacttcccagttctctgttccggggagtcgcagaccttggctgagtaaatggaaggtggttcttagcaatgaacaggcacctacattactcaactcgcaagtattttaccattttgccattttctcttctgagctttgcaacagctctgtgaggatggggccgggcaggaggggccaggctatccctgtcttgcagataagaaaattgaggcttggagagaataagaatgtgcccaagatgacaccatcagagggtcagaattgaggtgcaaacccagttatttgagggcaaatccaggcctctgtccttggatcccccagagtaggctgggcctgcttctctcttacttctacgtttttaatagacatgatttcttcaaagtgccattttatctccataggtacctccagacaccacccaggctgcagcaaatggaatgggagaggctaacacaccataatttttcaattccatgatgcccattttttctcacattttaacgtctctaaaattggggcacatcttatgattgatggcatcttacaattacacttggcagtactttttcttggtgatacaaaaaaacaacagtgtatcttacaactgatagcttagattcagtgaaatcctagaatacaacaggtttgaaaattc

SEQ ID NO: 1855 - DNA, 4315 bp, Homo sapiens
tttctgtattccgggttcttgccttggtgtaccagaagaatccgatcacccgtgggctaggagaatgagtgcaacgttttattgagtggaagtagctctcatctgatggtggaatcagcagggagatggttttcccctggagttgggcttctaggtggccccgtctcttctctgactgccctggccaaactccaccttgtcctgccggtcaatggcctgccagcatgccagtgcctctcggtgtgctgttctgctggcgtgctcctcttgacgaccagctgcttgggtcttccaccgaagtgttcctcacaatgtccagccgctcgtgtgtctgcccactagggtctcgggtttttataggcccaggattggggcatggcaggccaaggtggtcttggaaaatggtaacatttgggcatgaaagcaggagtgcctatcctcacctagatctgtgggggtggagccctagccagggacccacctttctctacccagcacttcccctcccgctttccgtatcattttacgggaccacactcttcccttcccagcactcccatatcaatagcacataaaacctttagttctactgaaaatttggagtgaaatctctccatagttagagcacatgtactatttggtaagcttacccttggtaattcatgataccagctgaagacatcaataccaataagtgagaagattcttgccaagggtggaaggatttgcttggtaatatagtaagtagcattcagtctcagagttgggtcctgcaggacttccactgggcgccttacaagctggataagtggtactccgggggtcccataaatgatgacgtatggcactcgctccccaacctgaggctcagagcgccggtcataagtcagcattttcctattcgaattcaaagaaaaaaaccacacccaaatactgttatggaagccatctttctcacaaattaagtcagaattaaacaataataaaacaatgaaaaaactacaaaagacaatttcaaaacagaattactatttctttgagaataatatatatacattttgcttagttgacaccaagtgtagatatcctacaagagtttaaaaattactctgtaaatcactgttacctggaaaataatgagttggcagatatcaactagcttaagatgtattttaggtgggagtggtggctcatgcctgtaattccagcactttgggaggccaaggatcacctgagcccaggagtttgagaccagcttgggcaacatagcgagacccccatctccacaaaaaaattagccaccataatggtgcacacctgttatcccagctacttgggaggctgatgtgggaggttcgcttgagcctgggaggtcaaggctgcagtgagctgtgattgcaccactgctttccagtctgggcgacagagtgagaccctgcctccaggggcaggaaaaagatgtattttatcccctaagaatgagaactaactatcattaaatctatcatgaaagataagagaaaatttacctggttaaactatctgattccagaatgataccatctaaatgctttggtagaacaatattaaggactacctagtgattttgatgtgggaaaaacaaatgaatcaaggactgtgtcacaatttctttgcataagtttctgaaggaaagcccaaaagaggatttcctcttcacatcttacgaagtatgagggaatattcactaactttcagtgaggcttcatgtgcgcaggtaaagaaacaattttgtgtctgtgtctatggactgtcttttcatttgggtcttctagacctgtgcagaatctcaggactatcctggcaaggtactgagggtatcattaccttgtaagttcaagggctggcacacaagctcctggtttataagaaaaacttcctctgtattccttggcaaagataaagtcttgtatgctggcctttccttccagaagcttcatacattgtcgctgaacatactgtttaattagacttatatctctcgtttcaaatagcagctttagagaacgctcaagtatcttaaaacaaaaaagatatgcaagtaaagataaaatatctcctagtatgtttcaccattgttattacactttcaattatgtaactactgggtaacctgctaacctacctaaataatctgttacttacaatgatgggataataaaattattaaaaattgaaagttatttgagactttagagagcttgctatttctaaaaatagaatatcatgtagtttaaggaaaaccatgtggaatgacatgcaaattaacatttgtcatgtgataagcaacataaaacacgttaagttttttttttttaatagtcaaagcctctaggtacaagaaaccagacacgatttcatgtattgtttttttatttaccagtatagaaagggtcctgattcagtcacaggaaacacagagaagtttaaagatcaccaggcagtcaaatcaaaatcagcctttttgactttttataaaaatgttgataaataactatgacagaattttctgtgttggaaatttctactaggaaataaccagcatgcagtggatttatgtaagattaattttttttttttttttgagacggagtcttgctctgtcgctcaggctggagtgcaatggcgtgatctcggctcactgcaacctctgcctcccgggttcaagcgactctcctgcctcagcctcccgagtagctgggactacaggcgtgtgccaccacgcccggctaattttttgttttagtagagatggggtttcaccgtgttagccaggatggtctcgatctcctgacctcatgatccgcccgcctcggcctcccaaagtgctgggattataggcgtgagccaccgtgcccggccaagtagattaagttagttctaggtgaaagctctgtgtcttattctgaatactggaaccaatggatatttatacaataagcttattaatttagcttgagtacaattctgcctacagagaaagaaggtactggattatatctcttccagaaatagtgctgaaaaaaatcccaaattcacataatattatatatatgacataatatattgataatattcaatccactatgcttttaatgctctcatcaaacagtatatagaatgctattcccatttataccatttatttttgttttgctatagaaggagtctaggcccgaataaagaaaaagccaaaaaatatcagggttattatggttgagaaatttgagtaatttatagctaattgtttggaaatcttcctaatttgtatttgataatccaaataaatgaaagttcagttaatctggaatggattatgtttctctctttttattttgatggagtctcactctcttgcccaggctgagtgcagtgttgtgatcttggctgtctgcagcctcctcctcccgggttcaagtgattctcacacctcagtctcccgagtagctgggattacaggcatgcgccaccacacccagataatttttgtatttctagtagagatggggtttcactacgttggccaggctggtctcgaactcctgatctcaagtgatctgcctgccttggcctcccaaagtgctgggattacaggcgtgagccaccacaccgggtctgtttgtcttgtttatcctgctctgctttcaggagttgttacactatgacatatatgatctccaggcaataggcaggaaactctcatgtattgctttttagtaatttttgataaaacgtaaggtatgggaggaagtcagaaacttaaggactaaaatcaaataaattgtttttattagaaataaaattctagctactcaggaggctgaggcagaaagattgcttgagctcaggaggtcaaggctgcagtgagccaggattggactactgcactccagcctgggtgacaaagtgagaccctgtctcaaacaaacaaaaacaaaataagacactacaaataaaattctcaaaattcatgtagttactcctatagttatattaattatataggctatagttccttcacctagatgcatgtttaagggtagttacattttcaccagacactttagccacttatttcttacagatgaagacaagatagataaaccttaccttagaaacagcagggcaggaatctcttctgactgtttctattccttttgcatcaaatactgggtccttctgatccagtgtttcatacatgtaacccacatacctcttttttgtttgtaaaacacagggcaaatatacctgtggtaaaattaataaaatgcctctt

SEQ ID NO: 1856 - DNA, 1521 bp, Homo sapiens
tgcgcctgcgtagccggcgggctggcagtgagactgactgcgtcggggttgagactgggtggatgaggctcaccccggcggggagaagggacgaggaggggcggacagcggaaggtccgggagtgtccgccataaagtcgtttgaggtgaccgttgcgtaattgtgagtctgtgagagaagatgtgaagtatggcctcgtcccggtcatctgggcgtgcgggtcccgggttttgatcgcgcgtttgtgtagttttaacttctagtcatggcgaatgatcgcaggagagcacagactggaccctgctacgatctctcttggagtggatcagactgatgatcaccaacaaccaactcattcccggataaggaagaagagagtgtcacctacttcagtgtggtttcaaccctacttctgcatcttaaagacactgtatggtttcagcagtagtgcccctgttcattagtccccctgatgttttcattcctcatctcatctttttcttagcagcattcaatgaatccttcattctagaaacactctatatctttggttttcatgagaccattctcaccttgttttgtcctgtgacttttttgaaaaaaacaaaaacaaaaaaccctttttttctttttaaattctggtaaaaaacacaatgaaaatttgctatcttaaccatgttgaaatgtgcagttagtaaagtacattcacattgtggtgcaagccatcactaccatccatcactagaacccttttcatcttgcagatctgaaactctacccattaaacgacttcccatcttcccatccccacagctcctagcaaccaacattctactttctctatcagtttgactactctaggtacctcatatgagtagaatcatacagcatttatccttctctgcctggcttatttcacttgtataatgtcctcaaggttcattcatgttgtagcatgcatcagaacttcctccccttttaaaggctggataatatttcatggtatgtttagatcacattctgtttatccattcatccatcagtgaacacttgtgctccttccaactttgggctgttgggtgtcctgccactgttgctcctagtgctcaatctcgtttattccctcctaatcaagtgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgccacatgtttctaaactttccaataaatcaccttctactg

SEQ ID NO: 1857 - DNA, 1920 bp, Homo sapiens
attctgcactctggactcctacggaccaagatgatcaactctgaggaagaaaggcaatgaggacgttgcacaagacagtccctgatacccagagtttactgcctaagagaggatacatccttcaaaccaataatctgctaatagcaagatccaatagcttcatggatattgaaagaaactgagaatcaaatttgcatacttctgagtcacttggaaacaaaaaacaagtacagtcttagattctgagggaacaaaaattaaaaatcacattaggaagagaattcctaatgtaggaactcatcctggaagattcttcagcaaaagtacagacaataataataatactccatgaagttaccatcgatattgaatgaattaatgaatgtaaaaacctcaaaaccctgcctggcccagagctttggaatgggtttggatctaccactcaactgctttatgacttcagaccagttatttaaattccctgaagctcagtttccacatctttgagtttttattaatgacctgccgacatcatacagttcatgaaatgctctggatgtgtacatgctgatgatacgacctcagacccagcaagagctcagtgcagcccggagagctgtgagcagtgccacaggaggagatgactggtgagtgaaataagcaagataggagttgaagtgtacatgaagcagagtccaagccttctccttctggatgttcagctggatcatcctgactgctcccactttcatcttggctttcaaaggcaagaggaaattataaggaatattctgagtggctttcatccaggagttctgtgggacccgcaacacctggatggtagatgcaaacagataaagaatattggtcaccaaaaggagttcttttcatcatagatctctgaaggtagacacctatttgcagacttctcaaagggctatatggatgtgctctacttgttggaggattgtccatccactcttcttcctgtacttaccaggacagaacagccgcaacttctcagacagttcattcttcttttcctcacctactaccatctaagaaaggtacttgatgactgtggctttagacaagagtccttttcttaccacagggtgggcagcaccagctcattagaaccatttgtgtgactgactgaagacagctcaccttggaacactgcagaatatggcgtaagtgacattttacaagttccagagcctgggactcaagatgtcttggagattctgtctttgcagtcttataatgatgccctgagatcatcattaaagaaagccagtctggcctactgaggatgagaagctacataaaggagaatgaagattccccagccaacaggcaatatcagtggtcagatatgtgaataaagccatgttgaacctctcggctagacgaccctccagcatatgaaaccagcagatgaatatcccagcctgcctgaagaactgtacaggaaataagaaatcattgttttttaagccactgggttggtgggtggtttgttacattgaaattgttaactaaaacagaaattggtgcatagaggtcaggtgctgtcataataaaaatctaaaacatatactgttggctttggtgatgggagtgattggtagctaaagaggcagtgaaacaatgattagtagatactgggaagttaataaggaaatttctattggagggtggagaaagggccacccttgttatatagtggccaaagaatcagcaaaatgttgcctgctgcaacctggaaagtagaaacttttcttaaactcacggatctggctgggagatttccaggatgcatgcaacaaatgtgaatcaactttgtatagctgtgtataataaagtgtgctgtatttgtccattctgatgctgctaataaagacatacctgagactg

SEQ ID NO: 1858 - DNA, 963 bp, Homo sapiens
acctgtctaattttttgtagagtcaaggttacctatggttcccaggctggtcttaaactcttggccttgagcaattctcccattttggccttccaaagtgctgagattacagatgtgagctattatgcccagcctactttctgagttttaaaagatgaaaataaatttttcagaatagcaggggaaaacatttgtgatgtaaaaaatggggtgcacactaattgaggtataaagaacaataattttgcaaattattagtaactgccaactcaattagagtcttgttaaaaagatactgttatgaagtatagtaaagcattacattgtatattttgactgtatttcaaatttctgttttgtttccaacagttttgttgacttatgttgggtggaacaatttgtgagtgaccctgagattttgcatggcttgaatctggtgatatctggtgtctccccaagtgttttgttgaagttttggataattagaagtatttcttacagaagtaaatatttcagtaaacattgtttcattcaaactctcaaaatataaaatacaaagaaatgttattctctatttatttttataaagattatagtctttatctaactcttcttagttcatttgaactaaatcaatgaatttgtcaacagaacaaaccttaccagtggcttagaggaagagcaagaaaggtgtgaaagaagtgaaaagaagcaatcacaggtcaaagaaggaaataatacaaacaaaagtgaaaaaatacaactatcagaaaatgtatgtcatagtacatcttctgctgctgctgacagattaaccaaacaaagaaaggttgggaaaacgtatcctcagcaatttcccaagaaactgaaggaagagcatgatagatgcatcttaagacaagaaagtgaagaaaaaacaaatgttaatatgctgtacaaaaaaatagagaagaattagaaagg

SEQ ID NO: 1859 - DNA, 778 bp, Homo sapiens
ccatgccgtctcttcccggggagctggagcggctgggcccaggggcctgaccctttcccgtctcccacagcgtgtagcggccaatgggtcggtaggttgggctgatgatttcagggactcgtgagggaggggcctgggagggcacctgagatgcactgcccttgcgaccatagttctccaggtagtcgaccaggtattcagggcagctggctgtctggtagagcccctgcagggtgcagagctccttgcgcgtccgggccagcatggggctgcggcccaggttcctggggtctatccggtagctatctgaggtccggaggctggagaaatcccgggccaggtctgattggctgtccagcttctgggttagggtcaccccctggtcataggcattgatgggcaggtagctgaggcagttgttggtcactccataagggaatccgctgcccccgctgaggccactgcctaaaggccgctcagtaccccgggtctggctctctgcccgcttaccacccccagtgatgtcgggtctcagcagggggcggccccggtcatagtccaggagggaggaggggccataggtacggggacgggtgaggaagctgctggtggggaccggcttgaaaccaagtttctccttctccagtaaggagtatggacgagtcgaaccgggcacaagcatggagctgcgggtgagtcccggctggcgctggcgcggcgcagtgagcaccagctgacgaagagggctccccggcctcggctcctgcctgactctctc

SEQ ID NO: 1860 - DNA, 868 bp, Homo sapiens
gcctcttgagctgcttgcttggcccactctcactctgtggagtgtacatttgtttccataaatctgtgctttttttttcattgttttgtttgtgcatttcatccaattgtttgttcaaaatgccaagaatctggacaccctccaccagtaacaggcattgggaaggggaaggcagaaaagcggagtgcaaaatgaagtggtagtgggtgctaactaacaagagaacctttgaacacgatgggacagaaataaggtcatgcattttctactatctgtcacctgtggacaacttgccacttcaacagttctggacacttttaagctcccccgaggagaagataggaaacttggacaccctgtgtgggattgagaatcacaaaggggcagtctcgcacctggtcaagataaagctgaactgaactcttcattcacaagtgggattctcgtaagaggcaggaaagcagggaccgtctgtcactacagacagcaagaagaggtgaaccttaatgagggaagaaaacagattctattaggggaaaaaaacatttaatcagaaaataaggctctggaaagaaaaggccaattggggctttgtctgaagaaataacagagtatttttctgccagagaaagcaagtccaagggaggaattttcagattgaccaaagagtattggtctacatcattagtactttcagtgagaaataactgaaaataaactagagcaaaagttccccaggtgtggttccaggaccagcaactgaaacatcacctgggaactgttaaaaatgcaaattcttgggctctccgccagaatcactgaatcagaaactctgaaatgggacccaataatcagcagcttaacaagc

SEQ ID NO: 1861 - DNA, 852 bp, Homo sapiens
ggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagctgaagtgcaatggcgcaatctcagctcactgcaacctccgcctcccgggttcaagcgattctcctgcctcagcctcctgagtagctgacattataggcacctgccaccacgcccagctaatttttgtatttttagtagagatggggtttcaccatattgggcaggctcgtcttgaactcctgacctcgtgatccgcccaccttagcctcccaaaatgctgagattggaggtgtgagccaccgcgcctggccagtgtgtcctttcttaattgacagtgacattatatctgcaaaataggcttcatacctactgtgttagttttagtttcctaggcctgctgtaacaaagcaccacaaattgggtagcttagaataacagaaattgtttgatagttataaataaaggtcagatgtctaaaaccaaagtgttggcagggccgtccctctgaaggcactgaaaaaaaaatttccagtccttctaatttcttgtggttccttaacttgtggcagcataactccagtcttcacatgaagttcttcct

SEQ ID NO: 1862 - DNA, 1816 bp, Homo sapiens
tgggacctttcagatccacctgacttggccaggccaccccttcttccctttgtggtagtgatggggggtcttcaggatacacagaaccactgccctctgctccttcccactgttctgggagctctctcctctgcgaggctttcctggaacctgattggcgaagaccgtttctcctgagctcttttctctgagacatcaccatagatggctatgagtcaagtgcccccatcaaccattcctgctctgcctgggggcttggagtcccttctgatggacgaatgggtattgactcaactggctttgtatgctgggcaccactttgcaaacagcttacaggatggactgcagtcctcacaacgatcttcaaagcacgctcggagttgtggccctacggggacccggtgaattcagctgcctgtatgaggtgatgttgttttgccttaaatggtcccctagcctctcccaaagacccctccttactcttcccaagaatgtcccaattcctttcccacttgtgccactcattttcaagagaggagatggcccagccctcttctcttccccacctccctcccccaaactgtgtgaccctcagcacccagggctcagggggctgccagagatggagaggaggcaaacccaagccagctcctggggtcctacagggagggagggcatgtaaatcttgcctcaccctcttccctcccagccctgctgtcagctggccagccccatccctggagccaaactgcttccatgcaggagggagggaagcctgctcagtgggaaaagatgaagctggtccccccgcgtgtcagtgaacaaattgggccaatttggtgtgattagtgaagaattcacatctggccagcagagtcctccccccagccccagcccagcctggctcctgctccccattagaagctattttctctgacggctccatttgtctctgtagtgggggatttgacagctccctggccagcctgggaggcctggctctgagtgagaggcccaaggccaggctgtgtgcccacacccttgacctgatgccacgggggatgccatgctccaaacagggcccaggcacctgtatgggccctgtaggtcccatccctcttctgtgtgcacagatccatagttgaatgggggcctggggagcacagttcactaggctccctgacctgggccccccttgggccttggtcatcttgcacaatgattattgtgttttaagatcaacagagacttgtatgtgtgtgcatggtggtagaggaagcaggggtctggtgtttcctaaaagaaaacagctgggcatgtaataggcgggcctgcaccccacttccttcaccccttcctcacccctcccagagacctgttgctgcagctacccctcaggaatgcctgtagatggctgtcgcacagctggaaggctcgccccgagaagcggcttcaagcagcaactggcctccaggagacggaacccgaagaagtcaagatttttaaatgtctgaaaggacttttggaggaaaaggggaccagcatcagatctctgctcctgctgtcctgggagcctggagctgctggggctggttccccatctgtcctgccctcactctacctctcctccaaaggccccttccctacctcagcctctcccttccccttctctgcccatgtacccagaggctggaggccgggtgcagtggctcacgcctgtaatcccagaactttgggaggccgaggcaggtggatcacctgagatcaggagttcaagaccagcctgaccaatatggtgaaaccctgtctctactat

SEQ ID NO: 1863 - DNA, 1054 bp, Homo sapiens
gttgaacggactcaccaggaaacgtgactttcgtgtccgacctctgctgtatcaggattcgattcttggtgttaaacaagacaacgctgaaggctcggtgcagcagccctgcaaaggtttttccagcgctcttgggaggtgggctgtgccactgcctggcccacctggcccacctggcccaccattacctgaagggaagcatgaacagcctttgacgtgggagtggcgactgctgagagggaactgtctgtacacaagcaatgtagccttatgggacctgagtggagccccaacccacgcagggcgtgtcttcatggcttttcctggccaatctgataccaagatgcagtggccagaagtacctgcacttccactcctgtcaagtctctgcatggctatggtgaggaagagctctgcactgggcaaggaagttggccgtcgagtgaaggaaatggtgatgctggtggcccctttccggcagtcaagttccctatcaaggacattcagttctcggaaagtggtgaaggcacatgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacactatttaacgaactggaaccaacgagaaaatacggtattactgaagactgcacttccttgaacagagtgctcttctcagcaaatcggaaatgcctacacaaatcgctttacaagaaagactgtttcaaagcagcacctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaacactaatattaaaggaaaagagaaagaaa

SEQ ID NO: 1864 - DNA, 499 bp, Homo sapiens
aggcggtgctggggtgcaccagggcagcagctacaggccctgctgaaagggttgacaatgaagactctcaggccaccgtaactcatggagaagccctgagcatctggcccgcttaatgcaccagctggagtcgacattaaagggccccatttcccatttgctgcagaagatgtttaattggaagtctctccctgtccttttaccctctggtgctgggcaccaatgagaagctcatctggccccgggatcctggcaggacactgggagcactatttccatgggcagcagggttgttcctggagacatcactgacccaggacacctagcacaatggcactcgatgtgaaagtggcttcgtacaaatctgccactcaagcctaaataagtgcattccagaagagccgcagcccctctaacagctcctgagagatgacagaagagacatccaggagtagatttcaatgcacagcagcagctgagagaagccagctgtgaaaaa

SEQ ID NO: 1865 - DNA, 404 bp, Homo sapiens
ttgcctgcttgtaatgttacccctgagaaaagtcatctgaaaatgggaaatggacctggacaggaataagcagagcatgctgatttaaaattatggaaattcttcaggcagaaaatgggcacatatggttatcacagaaaagctgttttaaagccagttttaaggtattattatgccgctaccttcaagaagtaatttgcgtgctgtttattggagctgtgaatttaatcatctcaatcccacgctattacaggatgactataagaagatgtattgacatttctttggacacataattttgcctccattgtgtgttgttttgccagaatactgaaggcagtgtttgtatgatggcacatccaaataaaaagcaggtcctccttttgggacagtgatccatttaa

SEQ ID NO: 1866 - DNA, 1638 bp, Homo sapiens
gtttaacggccggtcaggaacccaacaattagtcccttctcgtccgagaggaaactctgtgagaagatgggaccgtgagcactctctttaacaaggacatttccttttcagcgaaagcagcgctctgatttaccaagtctggcggaccgcagcgctttaaaggaatgaggttccagcggtcgcgccaagcagcgtacgcagcctattttaagttatgctaccttcgccacagaaaccaagaacgttgtaatggtccggcaagtgcccacgtataattgttctccatcacttacccactctagttcgggaacacccttgtcgccgccgttccggtaacacctctccaacgctttcgatgcttctacttcttcgggaacaagacaagatggcgcccgatttgtctcacccggaagtaaagaataataacatccgtttgtcatctgaagccataccatctctcatccaggtttgtgaacacgtgattgtgcggattgacatgtttcggcgccattttttttgtgggcaaaaccatctctactctggtcaacaccgggcaactgaaccattcctgcacgttactttttaacgtagctggcgccattcccgacccatctttatagtggccagaaagccaagaacgtaagtgttctacacatagggcgccttcaaattttttactttagcaacgtgatcttcctttaaggggaagtatgttccctcctagaaacactcccgccttggagaaggggttgagttcgcaactccacttacagactacggaggaaccccagggtcaaaccaaaccaaaccaattctggccagttgcttagcgcagttcaagttacttagtgcgctggaagcggcatttcaggcaatccaacttctggctcgaaccttctcggagtattccaaggatggaatactctcacttgagcgctgccgagggtgccgcttgaggaaaacgtgagtttgtgaagaatgtttgttgcagatacagttccaccactgtacattaagtatgtggaaaacagaagatatccttttggttcctgggtctccagaacagtaggagcaaacatccaaatctgatatagcacttccagagagcctggtcttggaggataaaactttaccttgatgggacttttggccccggtcccttaagagttgggatttggggttgtactgcagcacaactcagcctatcctaatacatatgggaatgcaaacatctcagatatttcttcttgggtgcaatttaaaatacgtatgaaatggcttcagaagtgtccatgaaccttcaaaattacatacaagaattagggagatacatttttctgggaacatacagatgttaagacttcccttctccgtctctatattgccagaagagagggccccagaattaaaaccccatccttcctacaacactcagctttctctttcaggaatatcagtactaatatcaccatgccttttatctctaggatatcttcatcccctgtaccttaatttctgcatgacttcatagggagtccatattgcttgatttttctccatatcattaccattgacataaattttccttacattcttagaatgtgtatttcctcaccttttagatttctggctcttatg

SEQ ID NO: 1867 - DNA, 141 bp, Homo sapiens
tgtctttcatgtcgctgtcacctctctttcaggtctcctgacttcccaccatgtgatgcaatgatcatcttgctggatttctgtgatgagagagggatgctgtggtatagaataaacatggaaatgggtcttgggaaattc

SEQ ID NO: 1868 - DNA, 2683 bp, Homo sapiens
ataggtaattatgtcttcatactatgggacacttccctcagatgcatcctctaaactggaaagagttaatttcccaaagcttaaactggttggcttaggattgggctcaggggaagagaacccagaaactcaacatgctgacaaaagggtgaagttttttaccagtcggatttttggcctccctctctctgtgaaaaacagtaaaaggtctcagtatttttaaattttcctcacccctcccagtgtttcattttgatacgttttctaataacccagtgtgtcttttcttgccttcaagccatcaaactccaaacggtcatgcaactggagcctccggcgatggtcccttttgccagggaccctgagataggcctccgagggagctctgactgccatttccccaaaacagcccccactatcagcaggaaacagctgcctgagcaattgtgtctggttcgtgaagtgacttcccattttcatccaattggccctgatctcacatcccaagcccatggatcataccacattgttctttctgcaaaacagttgagaattaccagtaattgggactgtttacattcaatgccatcatgacagaagcagctttattatattgcagaggaatgattaatacatgatggggattaaagattgcactgcagcaggccaaggcaagaggcaataaagattaataattttagatttccactgtagcaagaacgggaaaaaagcgtcatctgaaatgccaacttcaagcaattgcagtgatttcctggaaccctacgtgacaagtccagattcagtgggaaagactgtgaggatccgttagcaatgtttacgatgggcaagtcttgtgatggggttaccctccttgcattagaatttgcagtcttctattaggccattagtctttgagagcaaaaactgtatgtatctcatttttgtagccccagtgccaggcacacagtagctgctccaaaagcaaaggacatcgagtctgaatcaagctgcttgggtttaatggctgtctttgtcgcttactagctgagtggactcgtcatatttataacttaattgtggttcagtttccttctctacagaaaaggcatgagttcctcattcatagagttataataagggttaaataaagtcatgcatatccaaagcttagcatagtacctgagacatagcaaatacttgaggaatgcaggtataaattaacataggagtgaataacattgcaaggaaacagagaaaaggatcctaaacagtcctgctggtatattcatttatgattcaaaaatcctcaattgttaaaatttgggtcagaaccttattattccaggttgttggtaaatgtgaggacccttctgggtttggaagtagaacaataaattgagaggccaaagaagctgcaaataaaaattggcttctctgggaaaatgattttcacatttatacctacctgccttttgtcctcccatgcatttctccagatgtgataccaatgtgatacaattgttgtttattccttctctgacaatagcaaggtagagtgagccttccagtgagggcttaaaatatagctccagagacattcaccactacttcctgcctccatggttacacattccctttcacaaataaaacatggcctcatgcttcatgctgagcttgcattttacatacatcatttggatcttctctgcaaacctatgaagtgggcatggtaatcttcctttacaaatagagaaactgaggcctaagatggggagcaatttccctttaaaaaccttttattgtcaaggtccaaatggctgatgattcatgccatagacatcccaaaccagctggtaggcagagctcttggcattccaaatggaaacgtggaacagacacagatcacctggccacacagacctcagctctaaagacagatgactacttacctgttaaagttccctgtgcactattttttaaaatctagagatagataataaataggttaagttacattttaaattagcccaagagcatttgagaacagaatcatttttagaatcttaattctgagattcactgttgggcttaagtcactgcttctgtgatggttagttttgggtgtgaacttgactgtattaagggatacttacctgggaaagcattatttactctccatgcttcagtagatactgagcccttcccttttctgctgaaagggaaacccaggtggcttggcgtttgattagaataattgggctgccccaggtgtgtccgtgagggtgcctctgagggaaactgggactaaatgaagaagatctgccctccatatgggcaggcactattccaattggctgggggccccagatagaacaaaaaggcagataaagggcagtctccctggagaagagacctgcctgtagacagacatcagaactccaggttctccagcctttgggctccaggactcacaccaatgcgccaccgggctctctgaccttcagctttggactgagaattacaccatagaatgccctggttctgaggccttcaaactcagactgagccacgctacaggctttccggattgtccagcatacagaaggtctgttgtgggatttctcagcctccatgagtaagtaagaaaattgcctctaataaatcctttttcatatgtctctct

SEQ ID NO: 1869 - DNA, 712 bp, Homo sapiens
tgggaactcacccagcgcatccgactgcacggacaatgctgaggagacccccctgactcaaaggaaatagactgcagcactgattggatgactttggaatgaaaaaaagtagttttcctttacaatgaggcttggcccccagggcgatggtgccacaagccagatcactgggaccactcagagaaagggaacacagaagcctggcatgccagcaaaaagcagggtttttgtgagcagtgtcttgcaccaaactcctgtctcctcctgtgacttagaatgcctaacttcctgggaatgcagcacaggtctcagcctcattttgcccagcccctattcaagacggatttgctgtggttcaaatgcttctgacaatattcctcatggtgaatgctggattttgcatgcccgaggccctgggccacactgtatgtttgctttttgcaagggctgtatggctatgactagttatgtggaccctgcattcctatgtaaatgaccctccataaaaaccccagaaatgaatgcttgagtgaacttccctggcttgtattataatactgtgaacatcttgtcacacatctttgctgggggaattaagtgtgtccctatgtgaccgtaatgggagataacacccagagttttgtgcctgctttcatgtggacttcattctatgtgatttttccctttggtgatcctggtctatatcctttta

SEQ ID NO: 1870 - DNA, 750 bp, Homo sapiens
ggacgcgagcctgcttccatctgacgctggacgcttgtccctgccccgcgttgccttttaaattttagctcattccgagacacctgccgtcagacatttatgcagtgtgtgattctttctaaaacaactccctggaagagaggacatttaattcaacaatttattggccacctactgtgcaccaggcagtgaacttggaactggggctactgggttacagcagtgaccaagacagaggtccctgttcttaaggagcaagtgagggcaacagaaaagagcagtcagctgtcatgcgagggcactcaagcagccctgtggaaagctctacgtggtgagaaactgaagcctcctgccaacaccaacaaggaactgagacctacttccaacagccatctgagtgatcgatccatcctggaatcagatcctccagccccagtcaagtcttcagatgactgcagccctgaccagcatctcaactgcaacctcgtgaatgaccctgagccagaaccatgcaactaaactctgcgtggattcatgacccacagaaactgtgagatggtagctgtttgctttgttaagcctctaagtctggaaagaatgtcttaagcagtagcagacaatgaacacaagattattattcagctgttgaattggaagaggaggggaagaaaaaattttcagatcacaaaatattcattgtgtaaaacttcaaaaattctgaaatttaaggaaaaaatatcatttgttggg

SEQ ID NO: 1871 - DNA, 925 bp, Homo sapiens
cgaggcagggctttggctactggagatcgtaggttcgaatcccgtctgggaagttcaacttgtgcacctgtaaaagaagctggcattattggcttgtactcaagggctggcacagagtgtgtcggggtgcggacgccccagccacgcccatcatccgtgcggaagatgcagaggtcatatcggatacccttctgtaccacacgatttgggcagtcatagccgcagcggcagcgggagttgcactcgtagatgggcagcccggctcgaagccgcacctggccctggtcattgtaggcaaacttgtgcagtgacgcccccgggcagcagcctccagtgggtgcccacagacagtcctggcactcgcagcccacagccacctggttgagggtgatgccctcaccaacacggtactcattgatgtacacgaaggcccgcggagggccgtccaggtccacctcattctctacagtgatgcgtcccagatggctgcgcttggcattgagctcctgctcccagcgacggagcgcccgcctctgcttggccttctgcaccaggtagttggccaagcttgggtccaggtgccggggggtctttgaccggtggtgccgccggagcagctccctttctaagtccttgtggaactgcttgaggatacgcacacacttgagattctgccgtggctcccaggtgctctctgagtctggatatccacgccatttcaccagggtcaaaggagaaaattccctttggaaacagatgtgggcagttggggacaagagggcaggacactaacttccttgtgacctgtcccctcccagagcatggtcaccccagactcacgcggatcttcttgtaatcgcacaggtactcgacttcaaagtcatagaggttcctcttagagataccgagggcagggcaggagagc

SEQ ID NO: 1872 - DNA, 497 bp, Homo sapiens
tcttggcagtgagagcagagagaacaaagctaaaggtgctgaagtaaggtgacagcgctttaaagaagaagaaaaaaaaaaaggaaaaagaaagatagctaccaagaaaaaaagtgacctggtctacaaagatgaagaaactgtcgattagggtggaataaacttatcatgcaagaagttggcatagatactcgtctcaccttaaaggtgctttaaaaataaagtggggtcaggcaaggcagataggtggcatagcagttaagctcaagcagagataatgaacagaaataccagaggaattaggattaaaagcaataaagtcttgaatattggcgagaaaagatgaagaagagagtgtataaggaggagttctcactccaaacaacagtggcatgcgaaacccaagagatcagaccttgaaagctatgcactaataggttatttagttttcaaaatcttaaattaataacaattggcaataaagctcattaaaattc

SEQ ID NO: 1873 - DNA, 1558 bp, Homo sapiens
cggggcgccaggtacagccggcgggacgtccagtgccagcgcaggagccgggcgaggccgtggcctccagggttcctgggcggaggacaaggcgcgcagccgcgttggcgcgagttttaaatcggtgccttctcagctttgcaagttcttatcaattgctgcatgccagaggaagtttttaaaaaatggcccccagctctattgcggtgtaattgatggatagaaattgtatttatttaaggtgaacagctggatgatgtgatggaggcacgcagggtggaggggttaccacagtctaggtactctacacatccagagcctcccacagttgacaaatggattttcctaatcagtttcgtcgtgttttgtacttaagttgaggattccacaccgtgtggtactttcagaagagatgtagtggtgaatcaatcgcaacggttgtgatgttttcctaattaggtattgagaattaccattggtatttggaattagattgcggagcatttaggaaccgttctcgctatgttgcccaggctggtcttgaactcctcagctgaaatgagcctcccacctcggcctcccaaagtgctgggattacaggcgtcccctctgccccagtactgtttcctctccccagcccagcccccacagctgcctgccctggcctcactccctggcctcccccatcccagcctctgggtccctgagtcagtccctggggctgtctgccttctaggggagcctctggtgtggaccagaaagtaacctaatcccttccaggcccaccctggaaacaaagggatttgtccactagcctggtggtgagaaccatgtggcctcctgtctctggcagagaggactccaggatcaagggcaggtaaaaggaggagcctcctggggagcttcagaaggagggtcccaagtccctcctgccccacttctgtgcctgggtcactcacacccctgcctgactctagccccccttctccaggggtctccacaacatgtgaatcatgcccagcgtcttccattacacccttgataaagtcctctcctcaccaggacctctgtcattttacctcatggttttgaaataatttttggtcttcttagcagtttaaaaatattgttttgttttttttcctgagtttggagcattcctgttactaattacattttttttttagacaggtgtacactactacacccagctaatttgttttgttttgttttgttttggtagagataggatcttgctatggtacccaggctggtcttcaactcctgggctcaagcaatcctcctgcattggcctcccaaagtgctggaattacaggcatgaggcagcacgcccagccctaattacttctattacgccaaattccttgtgtggaattcctgtgctttgcacacaaattgccaggttggccccaaaggggaaaaaagtggatcccattttcccatcttctatgcctacgtggctgacaaatctcccgaatcccacaggagctgtcgctgatctttgtcctctattcgctgaaataaagttcaccatgga

SEQ ID NO: 1874 - DNA, 549 bp, Homo sapiens
atgccctctatctctctacgctgactccctgaagccataacttacggcacacccagcgcaggcccagtggacccaggggatctgcagggcaggaggtagagctgtttagaggcggaagtgaggagcacaggccctgctctgcatttgcctacctgagcaacgggaataaagccggactccgcctcccctggtgctgtgtggcttcgcgggccgaggcgctcagcactgagcccagggcctgttggtgaaaaacgcgtcgctccaggcgtcctaagcgccagtgatgtagctctgcgctcatgcacggaaaggcacctgagagcgcggacgaggaatgggagggccttgagccgtctcgccctgtctgtgaggtgctaatggacccagtgtgcaatgcatcagacatctcgggagacagagagaggaatcgcccaatccgtcaccctggagagctgtcaggaaagagagtgtggctctgcccctccccctgtgaatgacacaagggtagaccccagggtgtttgacctggaaagggcctctgagtcacct

SEQ ID NO: 1875 - DNA, 491 bp, Homo sapiens
gttttccgtgcagccgattggggttttgggcgctcggagcagcatctgagagggctcactctgatcatcagctgcacgttaagccacaaaccggcgtcgcttcggcgttccggaacccaggcctgggggccgcggggattgcctctgcgtgcaactccggaaagtttcaaggggtcccccgactgcacaggtccggaaatcggctttgatatggaactactccgctctagcctggaaaggagacccgcgcactcctctcgcagctaatttcggatcattaatttaatcggaaatgaggtaaccagtgtaggagacagagaaagcaaccggagcatcaaatggcagttctcgagaatcgacgaggaacttaaatctggactcagggtttcagtgcggtctccgactcccaccaccccgcccctccgcctgtctcgccgccaggtgtgacctccacgcgaaggaatcttcttcggatgggtgcaccttgccaa

SEQ ID NO: 1876 - DNA, 303 bp, Homo sapiens
gctttgctgaggaacatggaagggggaaaacaccgactgtgataaacaccagcaggatgactggagtccgctggaacctggaatggagttttctgacagcaaaggattacaggagcgtaacagaaattatggagatttccccgctaggcataaggatgcgatcactgtaggcacctgtgggcccaagcaggttacccaccaatatccctttaaacaccaaattatggactattaggccactgcttcaaggcttctacaaatgtgaaaccttgacaaattcccaaataaaagccataaaaccaa

SEQ ID NO: 1877 - DNA, 1156 bp, Homo sapiens
ttccaggtgaccagtggtcctcctttctgaaggctcttgctacaaaggaaagatgaggatattctatttcttgatccctctcagctactgggagctgctttgtgccttggaagcctcaagctgaaatggatgtcagcctcaagtttaactccaagagggttcaccttgtttctttgaacaaaatgtgctgcctgttgcttccctttgccaggagtggtgttcccttttccacaggtctggaccacagtgtctctagctcccgctcctggatacttggttactgtgtgtttcggtaaaaaagcatccacaacatgaatatccactaagctgtaacagggcctgctgcaactatagtatttcctgaaaaagtatcaactgccacaagggccacaaataaagtctgtgaacttgaaataaccatggagaatgaaatgttctgattcagatcatcggtgggatttcactgggaaatctcccactgggcaagagtagatgatggaggaggagaaacagtcactagaaaaaggtgatactttgtatcaagaaacaattaaaaattagatcacatcctgaaacattaagcatatgctcctttgtgaggcttgcctggctgaacttgaactggattgagtgaataatttcttaaaaacaatcaaaatcacagatttattctattttaaatacttatatttacttatatttcattcagaaattagttaacaaataatttttgagtatcctgggaactgttctaatcattaaacatgcaagtttgaagaaagtaaggatgaatctgcctgcgtggggctctcaatctagcgagaagcagataagaagacaaatgtcagggaagatcacacaaccttcaggatctaaaccttaaccttcctggctgatgctgaaagagagcttgtatgaaacacgttcttacaaaactatttggtggatcgtgacaaagacgaatgactgggtactataatttaaaatggaaaataagggatggagaagacttaatcctatctggaaggagccagtgcacagcaaagatggcagagagagaaaagagagggagtgacaatgaagtaaggctacagagagatgaccaagtgtcccagaggaggaattctctttcggaaagagatagacacctcttcct

SEQ ID NO: 1878 - DNA, 981 bp, Homo sapiens
gggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgagttttggcgtgaggaaccgctgatcggccacgggcgccgaacttgctggcctccggcatgtgcctgagcggcggcggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcattaaatggaaaatccactaa

SEQ ID NO: 1879 - DNA, 2949 bp, Homo sapiens
atgtttgtattttgcacttgcccggaggtgtttcacgggaagtgagcattttttaaaacaaaaatagaatttagaaaaaaaaaaggcagacacgatggatttctagtgttgtacgtgctgtagaaagcacttgaaaatgcgttttgccaggggccgcaaccagaagctacatgacttctggaatctgttccttacacagtaaattcctgggccagttggtaaacagcaaggagccacaagaaatcactcataggcaaaagccgagtgagcccaggccaagctccactttgtccactttgccctatttttggaattcagggggaaacatcttgggagcaggcccattgcacccctctgcctcctctcgatgccttacagttggtggggtttgacacatggaaaattgtgaaagttagaacacggaacaaaaatgaagcctcaacatagagttaatagaggcaaggggctacagagaatttagatcctaatcaagcacgtcttatgtactagcgcttccctggaaggccaggataactttatgactacaaagaaaacatgttttcctgcttggaagttgccagaacttgtctaatataaaagctgggatttcttgcccgtgggctgtcgcgtacggctacccaggccgcctcgtgaagcctcctcctgggagctcggcgccctcaggtgctccctgagatgccagcacctgaacgacctgctccagggaggctttagccccaagaaggttctggaaagctccaggaagtttagccggcacgcacaaaagccagagacaaatctccagcctgcctggaaatgctgtgggctcagggcaatgggctgaggtcttgtgtccaaaactgctcttgcatctccctggggagcccgggtgggcaggaacaacaaggtcctgtggccatgccctcgccccatgctcacccacactgcctgtgcctgctgggcccatctcagggctgcactggcccctagtggccaagcatgggctctacccctctgcgcctgcctggctgcctgtgcaggtgcccaccacactgtccctgagcagagcagagaccagcctgagccccgggctccgtggctaccatgctgagagtgagccctgtgcatgcacacacacttacgatgctgctggccccgagcagtggccggccacacgggctgctagtcatactgcccgctgctcctgggactcctgagcccctcactctctatagggtgaggatgcccagctctgcaagacacacagcaaacggagcctcagagtgcacagcgtggagatggggctccccccacaggctgcacccccatctagtcccggggaacgagaatgaagggcctacctgagcacacaagccccaggagggcatgggagctgcatttgggggcagtgactgggagggctgctgactccaggctcagattaaaagacagacggcaacactggggttgcagagctcaggagccagtcctggccccctgcctcctccctcatgaggttcccctgatccccaggacatcggcttccacatctgcacatctgggagacaaatgcaccatcagggagggcaaatcatacctgggaagggcctgactccagcagtttcagcagtggctgaaagatcatggctatttttgccatcattacaatggaatgtccactccctccagccacctccacagcaatcaacaccggtgtccagccactctacatggacgtgtggggaacagagcacaggcctcttggcttggctgtggtcaccgggagggagcagggagggacagctgccaagaggatgggggagggagcctgctactcaggaacgctggggcaagacatgagacaaagggctgccttcacccaccagtaggagcctgaccctgagcccaaagaaactgcccacctgtgtgctgaccccagggcctgaggacaggtccccaagtggacgtctcaaagagagtcccacattccagggcacatgggaactatggccttctggcagctggagggcagcaggaagggcacagctgtctgagacccgtgtggcttcccagaaagaggtgccacccctgaggaggcaccggtgctcacggactcctggttgccagtcttgccagggcaaaaaggcaagcgaaggaaaccctctcttcgtggggcactctgccttgcagtgtcaggtgagatcccggggggaaagctggcttgagctcctctggaatgtgcagggaggactccgtcaggcccggctctgcctccaagctgggcagcaggcgagccccagagctccaccagccccactggcagaggagggccctcacgaggcaggagcccatgattcatgccctgctggaatttgtcgagcatgccgagatttgcagctcctccgagattgggtcctgccctgatcaaaagaaaagaagatggatgaggacactataaataggccagagccacccagctggcctcggggatgcaggcggtatgtgttctgggctctcacgaagctaagaaactctaaatccaaggtgacatcgtggcacaccgccacctgcttcagggggacacaggggacaaggaggagctattggcagagcgctcggttcctgcaagttccaacttctgctaaaattggttaattggttcctttgcatgattcagggcacacaggcttctctgtccacaaaatttgctcgcctgcacacccagagaaatggacttggcttggtttttctgaacttttgcctctgcggaatcagcagtggacgtgtgagctggggcctctgtccctgtcatgtgaggaggtcaggcaggacaagcaggaagcactgggcaatgagtcaggaggcctggtggggagcttgggtgagtctgttttcctctctggacctcagtcttctcctctggttgatgtaataaaatcctacaaactg

SEQ ID NO: 1880 - DNA, 2044 bp, Homo sapiens
ttctgctccaaggacagtgggtttcccgctgggcacccactcttaagtgcagatcgggagactaagacaggaacacccgccgtgggcaggccaggctggaaggatagaggactgtggtcgaaccaaggcaagttcaactgtgacttatgccagtgtggtcacgaaggcagatgggttgaactgaaaagggggcaccggttcctggcatggaggcacccaaggtcttaggaggtggatggactgtcacatgggcaaagaaatgtcccagggcaggactgcaaaggccacagaagaataatttgggagagagacaacccatgagaagtcactcagaccagggtcagaaacagaacaggaacaacaatggaaagaggatgacaccattgatgggcacctaggtcaattcaatgtctttgctatagtgaatagtgctgcaatgaacatgcaactccatgtgcctttctttctctgcagccttgcaagtatctgttgttttttgactttataataataagcattctggcttgtgtgagatggtatctcgttgtggttttaatttgcatttctctgatgattagtgatgttgagcatttttttatgtttgttggccacttgtatgtcttcttttgagaagtgtctgttcatgtcttttgcccattttttattttttactttttcttcttttttcttctcctttctccttctccatctccttcattcttcttttgcccatttttaatgggttaattggtttttgcttattgaatctagttccttatagattctggatatattagatctttgtcatctgcatagtttgtgaatattttctcccattctgtaggttgtctctttactctgttgatggtttcttttgctgtgcagaagccctttagtttaattaggtctcagttgtcaaattttgtttttgctgtaattgcttttgaggatttagtcataaattctttctcaagaccaatgctgagaatggtgtctcctaggttttcttttagaactcttatagtttgaggtcttacatttaaattattaattcatcttgatttagtttttgtatatggtgaaaggtagggggtctagttttaatcttctgtatatggctagccagctatcccagcaccatttattgaatagggagtcctttccccattgctttttttctgtcagctttgtcaaagataagatggctgtacatgtgcagctttatttctgggctctttattctgttccattgttctatgtatgtgtttttgtaccagtaccatgctgtttggtttctgtagccttgcagtatagtctgaagtcaggtaatacgatgctttgttatttttgcttaggattgctttcactatttgggctcttttttagttccttgtgaattttagagtaagtttttttggttctgtgaaaaatgacattggtagtttgataggaataatgtttaatctatagattgctttggggagtatggccaccttaatgatattgattcttcccacccatgagcatggaatgtttttccagttgtttatatgtcatctttgatttcttttagccgtgttttgtagttctccttgaaaagatctttcaccttcttggttaaatgtattcctagatatttttctctgtgtgtgcctattgtaattgggattgtgttcttgattttctctcagcttgaacattattggtgtatagaaatgctactgacttttgtacactgattttgtatcctgaaactttactgaattcatttatcagtcccaggagccttttggcagaatctttagggttttctaagcatagaattaagttttattttcaacatttcggtgtcaaaagctgaagcgttccatctcagctggctgacctgaacaacattatactaatatttacacaatgaaaatgaacattaatagtcaaaaacacaatgtcaatataaaattgagtttagtctgatgctccttcttggaaagctgacatgaaccatctgcctttttgattatattaaaacctatttttaactata

SEQ ID NO: 1881 - DNA, 254 bp, Homo sapiens
aaggaactttgtaaatgttttatcttaaaagtttacccagagttggctgggattacaggtgtgagccaccgtgcctggctattttctttcttactctaggtttctaaaatcatgcatttgttttatgacaatgctttcctgttattcctgtgtccagacatttggcttttgaaattgctatttctctctcattaagagactttactgccttatataaagatggagggcttaagattttagattgaatttctgct

SEQ ID NO: 1882 - DNA, 2953 bp, Homo sapiens
atagttctctttagttttcccatgatttatcacaagcaagttcacagcaggttaaaataattgaatgcggtgatagcatacatactggcatgattttatgagccgtcattcataacatatttgtcccaaagcataatttccatgatagaactctgattcacatgtaatttttttgcagcgacgacacagttgaaataactccttcgtggaggctggctacattttcacaacgtctggtcccaagctagatcttcgggaaaagggatcaaggaaatgactattcctccaaataaaatgcaacaagaagaatgaaaaaacgtagaagagaaagcctcgtgaaactgagaagcatctgcaaccacaaactacaaaatgtagctgctaaacaaaatgaaagttggatcaaagtggtggcaaatatcaagagtgaatatactccacggcagagtactgcaaatgctgcacatctttcatggattctggtccacctcgtcctcacgcggggatgcagactgacaagcttccaccatgaagggttgtcatttgccatagcagggagaggaaaatggagcaaatcagtcaccagctcgtcatacagaagagtgtcccacgtcatatctgctgatatgttatggccaaagtacatgactatctccaaggagctgagaggtgaaattcggacatttgtctggacggagtagaaccaagagagtcgtaaacatcctgtggactacacaccgtttaacaagatgcaacagtattctggctttgcctttcctggagcccttaaacaggctgaagtgaaaagcaccatgacctgtcactacaagacgagaagcctcaggagaaggaaggagatcccttttcattggttttgccgagtttcccgagctccatcctcctacagttaaatcaacactctttatccttagactgctgataatctcaccaaccgcttcctggtaagatctgtaatgcgtgaggtcttccttcttagttgtttgcaaacatcagtgattagggacaattagggactggtgtgcctgtcattcttctcctttcagctgaggaggaaatcctcatgcaccgttatcgggagtgagacttcatctgtcagctgcagtctcaggaatccacgggttcattcagtcgcaactctaatctcactaactttatctgtgttcctcaaatgccttagactatttgcttcccactgatagggaaacctgacatctcattttctcagtgtccagacaaagattcgtacatagcaagaaactaagataggtgttacagaacatggagggaaccaggaaaaccaaatagaggacccccttcatggggcttccaacacgacaataggcaaaagagaagaaacatacatgtaagagacaagcaaaacccagaaccatcacttatgaaggatgtcctcatcaccctcttttgctgcctgtcaaaaccggtgagggctcatatgacaccttaattatgaattaatcttcgttcctcctacaccagcacttcccctcaccccagtcgaagccatctctttatatttccatagcttaaaatgctatttttggttctagatgctttgcctctagatttggatactgcatccatattgttgtatattttttcctttctatcttttccacaatgttttttttttttaacttttaagtttaggggtccaagtgcaggtttgttacataggtaaacttgtgtcatgggggcttgttgtacagattatttcatcaccaagatattaagcctagtacccattagttacgtctttcttctcccaccctccaccttccaaaaggccccagtatgtgttgtacctctctatgtgtccatgtgttctcatcatttagctcccacttataagtgagaacgtgcggtatctggctttctgtccctacgttagtttgctaaggatgatgggctccagcttcatccatgtccctgcaaaggacatggtcttgtccttttttatggctgcatagtattccatggtgtatatgtaccaattttgctttattcagtctaccatcgatgggcatttaggttgattcaatgtctttgctattgtgaatagtgctgcaatgaacatacacgtgcaggtgtctttatcatagaattatttatattcctttgggtatatatccagtaatgggattgctgggttgaatggtagttctgtctgtaggtatttgaaggatcaccacactgtcttccgcagtggctgaactaatttacactcccaccggcagggtcaaagcatttctttttctccacaacctcgccagtgcctgttgttttttgactttttaataatagccattctgactggcgttagatggtatcttgtggttttgatttgcatttctctaatgaccagtgatgttgagctttttctcatgtgattttcagccacatacatgtcttcctttgaaaagtgttcatgtcctttgcccacttctttatgtggttgtttgtttttttcttgtaaatttatttaagttcattatagatgctggatgttagacctttgtcagatgcatagtttgcaaaaattttctcccattctgtaggttgtctgtttactctgttgatagtttcttttgctattccacaatgttttgtgcaagataagtgcttagcaaatgcttgtaaaggaatgcctgcaccaggaaagtccaatagctatgaataaagaaagaaaggacaagttccaggggaggtgatttttttttcattttcatttttttagacagcttttaaaggaatggagtagcatgttcttctggagcaggagttacaaattggacctctaagggccacattcagcctatccacatggttgcagcactgacagagtgttttgaaattttaaactctgaatacttgtagataacatatgcatgccacaataaactgcatttccatc

SEQ ID NO: 1883 - DNA, 2755 bp, Homo sapiens
aatgcctcaggactggaggtcctcccactctgctgatgtgggagaccccccacgtggggactgccagtataccgcttcccttcgggctggccagtcctcaagtagagacactgaggtagggcaagcgcatctacggggaagagcgctgcctcgggcgttaatgggagagagagctgaggcagaagggggatcggaactcccgctccagaagcgtgaaggtgggggtgtatgagagcacccacccagaaccttgcaggaaaaagttgctttgcacatgggtgaccccgcaggccacatcatccacacatccatacgccgccccgtaggtaaggggtccgggcctccaggacaggagactcagctctgggaggacggccaccatctctggctcagtcacatttggtccccagattctggcaaccctgggtaaaagctcagtcacctgacctagtgacgaccacaagggcactgggaggcatcccaagacccagctcactccagggctggacctcaaccttgtacctgcaggaccacccaccaggagacagaagagagaaaactgtatatgaagacaaggatttctccagaagagaccaggagcaagtataaggactggaggaataaaatgggctacggaacacaggcagatgaagcaaatcacccacccctcaatgcctgctcagcaagcatccacgcctaggaaagggccccaaagtattcctctgaaggtctgggaaaggtatggtaattacaggcacacattatacaggatagctcaatgtcagcagaactcacataaacaggatgaacatggtctacaagagtctgacctaagctgtgctcccaggacagagcaggggcaattacgggtggagctcctgcctagaaggccagtgggtaggggcctccgatcctgggatatgatgcctcaatgtgggctctgatcaatttaaagatttcttatcatgggtgaaaaccctactaaattttttttttttttgagacagagtcgctgttgcccaggctggagtgcagtggcgtgatctcggctcactgcaacctcctcctgccaggttctagcaattctcctgcctcagcttcctgactagctgggattacaggcacacgctgccacgtccagttaatattttgtattttagtagagacggggtttcaccgtgttgcccaggctggtctcaaacttctgggctcaggcaatccaccctcctcggcctcccaaagtgctgggattacaggtgtgagctcatgcctgtaatctgccccttcatgctaaggtaaagctgctcctggctcccaggctctatgagtgctctgatctcatctctggaaccggcctgtaagcctggcaaacatcaagacctgaccccactgcttacctcaatgggagccgtaatgccttgacactttcgtcccaagccagagccttcccgccagcccatggcctgcagcatcttgttgccaatgttactgtggtcaatgccatctttggtgggttgctcgtaattcctgccagtggcaaacacacagttacttaaaacagccagggccccagcttacgaactggaaaatgtgcacatcacatacacagtgccggcatcaaactgcttcttgcgcttgggctctggaggttctggaatgccgtacttctcccgtctttctgcagctcggtctcggtatttcatctacatgggagaaaaaacactgctggaaatgttcacagacttcaacctgtaaccgtctaatgcacctattcaaaactatcccctcaagtatttttaaatctgaagaatgctttttttagactgctctgaaataccaaattcccttgttcccatcatcatacctagtcatatctgaaatgttaaatttgtaaatatgaattgtgtggaaccaggggcagaactatgtctccaacaagcagttttatttaattagccaccctctgtcaagctactcaaccagcccactgggcagtgggtacagcttgcgaagaggaaggcagagttgcccgttctcctcagcatttggacaggcatacctccaacatttggaaaggcatacctccaacatcaaggaggcttccagagacctgttcagcagtcgctggggaggtggaaccatagatagtagggcaggaagggtgtggggagaagaaaagcaaaagccttaactacaaacacttcagaaatatctcaggtgggagatttcaaacccacttgctcatttctaaaccacaggcctctatttgcatttaaatccctgcccacctggccgccaacctgccccaaccaccagcactaactgcttgcccattattgtgtcacaggcttctctcttgcctttgttcccagatctgcttgccatgccctgcccacccttcctttcatatcacctgcaataacctcacgtcctgctgtcccttgggattaatttgaagcgcacttctttgcccatgaaggcttccctggccaggccaaactagaccactctctccataacaaaatccagcgtatttaagcagcaagctctggcattgctgtgagagagtctcggcagtgtgcttctgccttgtgcacccttatgatgaagggacaatgtgaggctcacaaggcacacagaggctgggtctaggctacatgaactacaatggtcagatgacaagggtatgacaaatcctcctaccctgcccctgggatctggaactaaatgctacaaataaaagctaaaggcaatt

SEQ ID NO: 1884 - DNA, 1894 bp, Homo sapiens
atagaaagacaaccacaagataggagtttacaaagcccaggttctttctgatgagtgttgagattcatctacataatatctttattacttacagggaagggtgatgttattggggaagacgtgcaaatgccagtgaagacagagagatacagtaggcctgaaatggttagaaatagaagaatagaatgcacattcaaggccccgagagacgtggaaactggacactcgctggaggaggaagcaggctgggacgtgggagcgctgaaatgctttcagttgagccatgagcctgaaaaacacacgattcctttcccagagtagaaactatttttccctgattaaaatcgatgccgtgaaactgggctgaactctggctgccaggctttatgccacagggaattttgtgtcagagcgatctcaacctcttctgggaggtgatttctgaagtactgcaccaaaaatgatttcacttataacacaaatgcacagcatggaccacttaggagttaaggaacgaaccaggcacggtagcttacacttgtaatcccagcacttggggaggctgagacaggaggatcacttgaactctgaagacggaggtgggaggatctcttgaccccaggaggtcaaggctgcagtgagccaagattgtgccactgcactccagtctgggtgacagagtgagaccctgtctcaaaacaaaacaaacaaaggagttcagaaatgatctggcctttatattcctgcctgatcgtcagtgtattcaccaggacggaacactgactggaaatcaggtcctagctccactcctggctgggaaagagcatgaagtgttctaggaagaaaagtcctcctggaagacttggcaacagccaggagtcctgagtgaaccgctgtccttttgaatccctgagacgggctgcagggatgaggggctagaactgacaggaagacaggacagagagcagcacagcctcagaagtgcaggacagaggtgacccaggcaggcatgacgggctgtggcttcctgccctctgctctcacagcacccctgatcccactcactgtggtaccacgcagatgggttggggcctgtaaatgtcaggtgggaccagccagaggagctttgctgccagtactggcatgtcaggatgggggtctggtggtcagcacctcctctggccagtggtcttgtggggagaggcatccatgtggcctcctcctctgtcgggagggctgatgtgcagagaagtacggacttggagggcagctggatgagctggggcttgctcagggacacaggtctgtgtgttgtgccaaggctgaccccctcatcccacaccagaccctgcctctgactctgtgacctcagcacctgacttctgtctctcaggtcatctcccagtcagtaaaacatttgtgtgacgtgaggaggggcactgaagtgggtgatctttaaggccagatgtctctgtaaaagccttgactatcggaagcactgggctagggcagtgtagtacccagggggatgaggtgcatcagagcagcacctgctgaggccaagaacggaggtggctgctgccggcctccgggaggtccccttagggaagcatttcttcaggggtggcccagggacctccggcatcagggcctgcatggggattctgtgccagcccagccctgctaagtcccagccttgggaacctgaggagggtatctgcctatttttcttttaaacatgtttcttaggttattcactaaagtttgagaaccactgctttgtggctttgaaatgttcatttgaatttttctatgattactaagatttttgcccttaaggctctgtatataaacaacatactgtataaaataaactgggaatggcgtgaaaaca

SEQ ID NO: 1885 - DNA, 738 bp, Homo sapiens
acttggaagaagggctgtaacctttagcttcccccagtttagcccgttggccttgtctaggctggtctgtttctgactcttcttttcctcatctaatatagacctacttttcttttattggaagtaggaagaggaaaaatagacaaaggaagagaaaaatactagattaaggctcagatattgtaggcatgagacctggaaactggagactccttttgggacagagttgtagcagcaagcccaactatagaagaagggaactggggcctgttggtggcatggtgaccagagattttggtgttgttttggtgcaacaacagaccagcatttcttcctgatgagagacaattgaccatggagtggttctggccagtctatggagaatgtgcagcaaaggttttcctgtcatctgcttcatcttttgatgtcagagggcctaaaactccaccctgggattatgctaacactgccattttttgtacacaggacccatgaagaggcatgaagctcaattgcacatgtgcatgtttttccttttgtaaatattaatgactcctcctataatctgttgaatatgtacacttaaccactcaacttaccatacgtttctgttcccttttcccctcccttgaagtatctgtttttggcttctgaccagagactacacttcccagcctctgggaatggccaccctgcaggctgaaactcttcatgagaaataaagctcttctttctaaa

SEQ ID NO: 1886 - DNA, 521 bp, Homo sapiens
cttgtgcacattatttaaaaatcagttcatgctgggcatggtggctcatgcatgtaatctcagcactttgggagagaaggttgcagtgaactgagatcgcgccactacacaccagcctgggcgacagagcgagactctgtctcaaaaaataaaataaaatgaaataaaataaaataaaataaaataataaataaataaataaaataaatcatcagttcatgtggccatgttccctctccctttccttcacatattatttccaattgttcagtagagatactgcctattatcaccttgtaaccactttcccttcaagagactatctctggcatcttacctaccttttcttcgaattttaggaactctgtactccaattctctatattccggctttgttccatattcctcttcctgcttattagtctgccagctatcatttacaaaacaaccactttgtatcagacactaagaacataaagtaattccagtctctgccctcaagaagattacattacggtggc

SEQ ID NO: 1887 - DNA, 659 bp, Homo sapiens
tataaaaataaatttatttttagtccatcaaggtgtctgaagattttatgcctaggtatctccatatctaacttgataaggaaaataggataaacaatgctggtaatagcaggaaagtaagtatttgaataagatgtcaaactgatatttcatgtgaacctaactcattttatggtaactaataattatcttatttaaatcaataggtaaaacctgtttagaaattaaaaatgagttacgatttaaagaaaattcagatgactcattgtgagtgctagttctcttgtaggatgccactggaaatgttgaaatgaaaaatattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttgacttttttctaaaatgtctttattggattgaatgaatgtttatacctgaaaaaaaaaggttc

SEQ ID NO: 1888 - DNA, 1806 bp, Homo sapiens
acaagaactggcggcggcagcagcagcagcagcagcagcagcagcagcagcagcagcagcagcaactggatttgctttttcaccagaggatccagatttccctgtggcctcgcaaacaaaaaagaaggaagacggagcagcacagtcattcctttgtgaaaaaggcattcagagacggggtttcaccgtgttagccaggatggtctcgatctcctgacctcgcgatccgcccgcctcggcctcccaaagtgctgggattacaggcgtgagccaccgcgcccggcttcagctggtttttcaaaagtcatggcgtgtaactgtccgaacagtgaacttcggagatccaccggaggggcgaggccacagctcgaccgcgagcacctgagcatcctgcaccgcctgcgacggccgtcagggggcgcgatgccgcctcacagaacctcaagaggcgcccgggttccggcacagacggcctgcggctccagggggcggaaccgagccgtctcctcaggacctacgcaggaggcgccgtcatccctacagggacacctgagagggcccagcctcctcctcctcaggacctactcgggagacgccgctggctctctaggaacacctggggaccgtggccagggacgacccagcctccttctcctcagctcctcaggaacgactggggaagctgtggcttcatggtccccgaggctgcccgaggaaaggtatttcaggacagccaggagggggcgcacatccgccgcgaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattgatgatgattattccccaccttctaagagacaaagaccaacgagccaccacagccaccagtcccagaacctgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatccgtttcctggccgtagaggtggcctgcactccgcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaattttttttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccat

SEQ ID NO: 1889 - DNA, 567 bp, Homo sapiens
cgaggtgggtggcctaggagttggagaccagcctgggcaacatggagaaaccccgtctctactaaaaatacaagaaattagccaggtgtggaggcacgtgcctatagctccagtatttgggggactgaggcaggaggatcacttgaacctgggaggtcaaggctgcagtgagccgagattacgccactgcactccagcctgggtgacaaagtgaggccttgtcttgattaaaaaaaaaaaaaaaaaaatccatacaccttcactctactttagaagcagtcatattgaaaaaaggagaatgatctctgaatgaaataccacatttcctcctttatcaatttaataagttttgaggaaaaaagatgccattatttaaatgtacagatgaattgtaagatgcaagcaaatttcagaactatcagaatgtgagaagttattcatcatagaattaagaaatatgagctctcaattctctttaaatacagtgctaagagattgtgacattgttttttctttttaatttttatttgtgtattgacattattttttaattatttagggtgtgct

SEQ ID NO: 1890 - DNA, 677 bp, Homo sapiens
atgttggaatttctgatgaatctgcagtcagcattttgcatgaactgtgtgtggattcattgcctacattggatgatgaagacttgagtgttgctactaaggtaaagtggtctcttgtaaaattaatcttctcactctgagtgtagttttgcatagtatttacttttcaaatttagcagtggtttacctatcattgttttatggtggtaatggaaagctggtcagagaaaaacatacacatggctagttgattcaaaaaatgtgttaaactttggtaactaataaagattggtaagtactgtgacagggtgggagctgaaaaaaaatgaactggaaaataagtagtcacgggaaaatcacattaggaaatgctttctccaatagaggaaatatgaaatttggttaaagtttatttggataaatactaatactttgacttttaaatcatacgagtgtgactttcttaatatttattcctgtataaaccttcagtggatcaaattgtttgcagtaatcatggaatcctcctggtaatttttagtggcagaaatgttcagcacataacatatagcttttgttcttggaaacttatcattttggtgtcatatagtttttaggagagattgtttctctacttatattattggttctgtagtgagactaaaaaagtattaaaa

SEQ ID NO: 1891 - DNA, 686 bp, Homo sapiens
ttgcagcatcacagaaaatgatgctctctcctgccaagtcccattttttgggaggaggaaatggattaggtcctggaggttgtcataaatgcatcaagtgactttctcagcatcatctgaaacatgcagccatccagcccagaacacaacaagaatagagttgatgagccctcttctcctcaacaaacacctgtgaaaaatgggccaattcacagctgcaatggttgggagaatttcctgtctgggagtctggaaactgccaagagtggaaagctgcagccagccagcgaggcctctgttgtcactggcccaaacaacaacaaaaacaaccgcaacaacaacaacaacaacaaaacatgccacgtgtgcactggcatatacaaacacgcccacagaaccaaaccaagcggacaaggcttcaaggagagcttctgggcggctcattcccgcggcgaggcatatcccttggcatggtgccactgcagcccagctcccagcccccccgccatctgtcatcagcgctctgcctactgtggcatttccctctttgctcggcacctctccctattgccgccatatgaaaaaggaggtgtttgcttccccttccaccatgattgtaagtttcctgaggcctcccgagccatgctgaactgtgagttaataaaacctctttcctttataaatta

SEQ ID NO: 1892 - DNA, 1018 bp, Homo sapiens
gagagagggtgcgcagacggccagccgggccgcgccagggacatactggagacaggaagtggctgagagggggagagagttggagagagacggccgcggaggacacggggacgggaaagtctgagagacggggagagcctgacccggcgggacacaggcagaaagaaacacgcgagccagacagacgcagaagaaacgtgcctggtactggataggaacttcatggaatggagctaatgggccgtagggcaggtttgagtcgtgccaccctggagcagaaggtggagggtagggataagggggtggagcacctgattccaatcttgccacagggaagaagagtctgtgaagaaggtggagagaaactaggagaaaagcacaggatgtagaggtctattcggcataatcttctccctcattttcatcttcaccatcaacagagagagcagcatacttgcttgcagaactgaacttctgtaacacaacgagagtgacaggataatgaaggccctgaattatcacatcaaaacccaagacacaggatactgatcctttggcaatgggggatgacagtcagatgacacccacttgcttgctcatcagcattgtccattggagaggagctagggaagagggtcagaggcacatgcgatcttactatagtctcataccacctctacaccttgcagaagggatgagaacaaaggaagacagaaaccaggaaaaagctaaacttctttcgctatttcagtaaagaccaatgtcttatttccaaacactttgtattccaaatggaaagaagtccaacggcaaaaagtttagaatactaagaatttttaattcttagtaagaatacttagaattctaagaatttttcttagaatgaaaaattgggagcagccttcaacacttacggaagctggattttcctcaggtttctttggctcaggtgcagatctggagtcttgatcctttttgccatctttcctgcagagacgtaagcataaaaccatgtctt

SEQ ID NO: 1893 - DNA, 504 bp, Homo sapiens
agtgcgacaaggcaggccacgccccctcgctccgcctccgcagcttcgggtagacacacacaaacaaccagcttgctgcagcctggcacaaagagggcgcactgcgcaggcgctgccagcgagctcttttgggaagaatcggtcccgcgaacaatgaaattgggtttccgccccaccctctttactcctccccagcacgcccctgcgcttcgccgggctagggagtggtggtactgaaatgtcccggcggagtttgttgatgggggtggggaagggagggggcagggggagggcggcaggaagaacgggggctgggaagaggggatgactttggcaaggccacggttgcctcctccgctgctgaccttggggaagtatccgttttattttcagcccaacataacagcgttatcattttaaaacaaagatttctaagtacgctgtaaggatttcttccctagcaatcgtgaagaaaatcagtctacatttaaattttatctactg

SEQ ID NO: 1894 - DNA, 215 bp, Homo sapiens
agatgatgctggtgcttctggtccacagaccacacttgagagtctggcttagatatcacaaaacagaatgctgaggaaccttgtgagcctgaaggctggaacgcagtcgacaatcgtagtgctccctgcagcctcgacctcccaggctcaagcaatcctcctgcctcaggctcccaaacaaatgtacttttaaaagcggaaatcaagatgtgaag

SEQ ID NO: 1895 - DNA, 1028 bp, Homo sapiens
gagggagtgggcttattttcttctgctcttctaccatgtgaggacccagctttcaatcctctttgtccttccctctcttctgccatgtgaggacagagcattcatttcttctggaggatgcagcaagaaggcatcatcttggaagcagagaatagccctcatcagacaccaaacttgctggagccttgatcttggactttacattctccagaacagtgagcaataaatttttagtgtttataaactacccagtctcaggcattttgttatagcagctcagactaagacagactaagacaatatacaatgccttagtttaatactttaatactttcatgaataacaatagtaaataaatgaatacaattatttaaattatgagattgttcattgtctcattgtctagtccttacctgtatctgtctctctccacattctgaaatcgaccttgtgatttttgcataattgtgttatacataactgtatacccagatgtccctcaatttcatatatatgtttacaaaatagacattttatcttgctcttctctttcctttttatttgatacttttcttatctattattggtttagctattcctagtggcctaaagatgtaattttattgcaaacatctgaacaactcaatatattcttcacactccctgcttactttaaagctttagtatttacacagttggggatatatctatatagaaatacttatcagtgaagtaaaccttttttccctgatgtttcatcttaatggtaaaatcatcctcctgttgccattacactcttcaacttatgtataagaattctgttaactctaagcagcatgtttaaagtaggttagttcaaagttgtgagatggttgcacattttcagtaggtctaaaaattaagttccacattgaattgttttaaagcactatggcaaacattaaagtgtttaattcattattgaaacactttcattacagcaacaacagtttaacatcctgcagtggtaattctaaatgaaaaattaa

SEQ ID NO: 1896 - DNA, 2355 bp, Homo sapiens
gcagataatttctttattgaaactatcaggaagttttactatgaaattttacatacatgatggaaagtggaagacatataccaattatattccaggaaaaaatactttaatagtattgttatatagtgtattggctaattccagtggatcctcatctctcactgctgacattatctccaatatttgactaaaacaaaacaaaaacaaaaatggttaaatctccaagtatacatttagttctaaagctatataatatttttccacacaaaggaaaatattggcacacctttaatataataaagcttaacagttattaagtttttcagcaatatcaatagaaaaacttactgccagtaactggaaacagatttatggactgtcttgcatataactagagctaagaaccaggttcaagtaaattattaaagcagccatctgtattatgttcaccaattatagcattaactgagtggaaatgaagagtccttttcaattgtgagtcatagcatgttcattagtgggtcatgatgagcattttaaacattgacaagtacattgtactcaataagggtaagtactgttccattttttgttaggttttattatgtatgtgtgtcctaagtcacaacgtaatttgtactgtgggacagcagccacagttggaaatctactgctagagaactagtccttgagagacagcaaatgaaggtattaggttgctgcaaaagtaatatttacttggaaaaatgtgtggttattgagggcgagggctttctgtacctctacccttgcgagagaaataagcccaggtgtccatccttcagtttctttctttctctgtctctctcttccttcccttccctcccttcctttcctttctttttctttcctttcttttttttttcttttttctttcttttttgagacggcgtcttactctgttgctcaggctggagtgcagtggcacgatctcggctcactgcaacctctgccgcctgggttcaagtgattctcctgcctcagcctcctgagtagctgggattacaggcacctgccatcacacccagctaatttttgtatttttagtagagacggggtttcactatgttggctggccgtggtcttgaactcctgaccttgtgatccaccccacctgggcctcccaaagtgctgggattacaggtgtgagccaccgcgcctggccgcatctttcagtttctgtgcttacagtaatgatgatccgtagtgtctccatacttattatatataagtggaagatttttaatacatgaattagaaagttccaaagtccaaattgaacatttaaatattctttgcctaagctttttgttcccttagtatcttaaatgttaacacctaaaggaattaaggatggagatctaagattaatgggaatttaaaaaattgttttgtaatgtgacacaaaagccttgcttgatgtttatactaagcaaacactacactaaaattttatctgacagtcaagatacactaaaagcaaatctattaacatttaaattaagacagtgaaaatccatttttcttaggaaactactgaatgtccctctgtatgcacttctcagaattggaactcttgattaatgctgctgatgacacagttttgaaggtcacagcagctttgctaagattatattgcatagcaaattcattttattgaaatcgcttataagaaatctattgggctgggcccagtggctcatgcctgtaatcacagcactttgggaggctgaggtgtgagccactgtgcccagccaggcaaaggtttttaaagtcttgcaagatctacatgattcctaccctatctcctttccagcccttccccatactgatacaagttatagctttaaaaaaaataattgccactctcctgcttaaaatcctttgggtagtgataaaatctaagcaaaatgctggcatataagagccctcacaatctgggctcactctaccttcccagacttgacttctgcttacactgtgcatcctactttctgccacacttgttcctctggattagccaggcccttctgcagtctgcctttgcttaaggtgtttgtttgtctttctctggcctaactcccagtcatgggtaaacaactgaaatgtcaccttggtataactctctcctgtttcccctcaaagcagacagttgatgtgccctatggtcctggtcatagattcctacttgtataacagcactactatcttggactctgtctgcttatgtgctccaggagggcaggggtcctcgcctgactcactgaatgccttatctaaagtgccaggcacagtgtacctattcatctggtggat

SEQ ID NO: 1897 - DNA, 3210 bp, Homo sapiens
tgaaaactttcagatgcttcttcattgttttagtcatttaccactttaatgaaattatctggcaactttattgtggtgggtggggatcaatgacggtgtaatgaggcaattagcaaattctgatagttccatctactccatgtgaaagtctcttgatgttttatatggtactcttattaataatcccagagagcaggggttggcaaactatggcccatgggctaaaatggtttttacattttaaaagggttgaaaactttaaaactggaaggatacatgacagagactggatggcctacaatgcctaacatattatctagccctttacagaaaacaactgaccaatccttatgagaccagacttgcaaaaattacagtaacagagtgaaaaaccttcttgaagtgttaggaggaacttgagtcataatttgatgttgaatcagagagaacaactgtttgggcttatttgcctcagagtatttgcccagcctctggtaactatcattctattctctacctccatgagagcaactttcttagctcccacatgtgaatgagaacatgcaatatttgtctttctgtgcctggcttatttcagttaacatcgtgacctccagttccatccatgttgctgcaaatgggattcagaatgtgttgctggacttcaagataggaagaatctttgccttgatggctgatgacagtaaccaccccatctaccatcatctattaaggatttactgtgtggtcactttacagtcatccaagtaaattttcataatcacctgattacatgggtaccgcttttcagaaaaagaaacagatttctggagggattcagaatccatggctggaagaggtagtaaggccattgggagggcatgcctctcctcagcccacccccaccctgtgtgggtctccattctgaaatttccattcagatgacccggtcctaggcagggaccaaaattccttgtcagctgaggaagtcctgaagaaacatcctgaagatgatgactgcactgccatcgtgggcagatgcagcttccatctacctgagggctgaaggggaaaacctttcacacacgtgaggaaggcgcagctctgtggaaaggtcactagaatggcagcggcagcaaatagggctccaatgcacgtttgcagttaactgggtccaaggagagcatggccctccacagcaagtttgctctatagaataaagtcctgagcttgtttttatcacagttagacagagaatggtctcttgtttctcagttatccagggaagaacagtgtatattctctgtagatgagtgttgtctaatgtagtgattaatctctgctagtgttaggaaagctccactactgtgtgtgtgtgtgcgtgcatgcgcgtgcgcatgtgcacatactgcagtcttgactttccaattacaaaatgcctaagtcaggtcacattgtcttcttccagccagtttctaaggcaggcaatggaaacaggagccgatgccaaatggtctagaggcagaagggctgcatgctttgcagggccagccccaaggctgccttccagagctgcactttctctggggacagtaaactctcaccgcagctgccagccccctgtgcttggccatgcccctcacatggacttggaatcagtgtctctcttgctgatgagcacctccaggagcctcagtttcgcctttatgtgcttatattcactgtattcttcagccataggagtgcggtcttccttctggacatttctaatgcaaataaaggaaaaaggggtctgaggatcattttctgtctttgctagatactattcatcgggcaaattatcattgtttagaaactttgcagtttatcaacttgtagaatcagtgttgccgagtggcccttggtctcaagactggggctggatttagacaagtaatgaaaatgtttcacccagaaggcaacatgcaactgagtttttatatagttaatctggcatcctgtatgataagaaggctaagaaatgcagaaattctctctgctaagtatgaattcacattgagctctcatacaccaaaatcttttattcatacttaatgttttctcattcttatatatttcatctcgtgaaattttaaatttttaattagcaactggtccacaacttagtttttttttttttttttttttccaaaaacagatagttaatactcctacttatcataaaactgtgttagaattcagcagctggattacataatactattataataagcctttattattgagtaactttacatacataatatttatatgcacaagtatttgagagcttataggtcaagccctgtgctaagtactttgtacccatgatctgatagaacccttataacaccttgatgagatgcagccattttctacacactacacatgatgaaaccagcacaggaaatcagataacttgcctgctcttggccaccacgcggtgcgctgctgctttgtgttttatgggaaattgcacatggcaaacattcaaccataggcttcctgcctttattattaaagggcaaatatgggtaaggaggatagcatggggcttgatttgttcaatgacctaaaaataaactgatcttattcataccctgccttgttctaggaaaggattctagtggcttctcagcagagggcagggcaaggaacaggtgctcaggaattggagcatctggcacgcaggcccccactgcactctgaggggcttcactctcctcagacacgaagtcatggaaccagagcttatctcctaagtccctcatagttctaaacttttttgacaattaagttaacgtcctccattgacattttcttaaaacctgggtggtttgcgtaattctacatgtataagatatctgtgcataatgtgacttagaataatataaaaaaggataagccaaaaaataggcttagatgaaagactggaaagatacacgtcaaaacattaattctgacttgtctttggttattattgttttgggaattactacttaaatttgcttacctatattttctaaatactgtgcaatgggtgggaaatgaaaagcaagtgtttaggtataaaaatatatgagacatatccaaatcagagatcctaaaagtaaattcatacaataattgttaaactaaactgaaatacaatatattttaaatgacaaagtt

SEQ ID NO: 1898 - DNA, 371 bp, Homo sapiens
ccgatggccttctgccacttagttaatgtgcacctggcagcttaggtggccgcggagaaagcaactttggctgcaccaaggtccggcacaagtctggagaagcttcagccagttccagctttggtatcaggatgacgctggcctcataaaatgagttagggaggattccctctctttctattgattggaatagtttcagaaggaatggtaccagctactccttgtacctctggtagaattcggctgtcagtctgtctggtcctggactttttttggttgatggctggagtcagctggcaaatacagaagcaggaaacattacactgaagctcagaaaataatatccccaaatgaaggcatcagaaataaaa

SEQ ID NO: 1899 - DNA, 1108 bp, Homo sapiens
agtgaatgacctgttgcagtgctttcattgaagtgttcttcgttccctcagcaatatgattgtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacagggtaaatataaaattgattcattaaaaatgtttcataagaattcaaaggacatagaattttgtgaaatgtagtatttttacttaagtgccttttctctgcttctaccccacagccaattttttataaaccagttgataacataagtagtttttgggggatgatacattacttatacattttctatgtagtaaacatgtatgtgtatgtgtgtgggtgtgtgtctaattactttgttggacagattcctgtggtttggaactgctggggccaagtttatacaaaaatctacatttttgagtaaactccccatgactctagtaagtttccacagtatttgagtattctttatttcctaaagctgtacaaacatcagataatcaatatttgtaaggatcgataatataatttataatgaaattgctttatcagctattaatgttaactacatcatcttcatatagccttataactcatttgtgctattccattttcctctgttccttttattttcacttcccttgtaatgttagtctctttgtactgatttctgaagagttcatttatgattaaacatgttaacattttgtctagaattgcaaatatgttttttctcattcattttactatggtgttttattttttggttatacagaagttgtatattgaaatataatcttgttctgttttatga

SEQ ID NO: 1900 - DNA, 522 bp, Homo sapiens
cttaagataaccctgtgaaggctgagattgatatttgaaattcacaactgatcttggagcctggtacagcagtcatggatttgttcatgtgtggatgtgatggaactgaagtcgctaggttcatgctacctggaacatgagactgacaaatagaggagcactgagtcaaatgaatctcggagaaatggagctggaagaaaactggaagtttcattcttgttgcccaggctggagtgcaatggtgtgatcttggctcaccgcaaccttgacctcctaggttcaagtgattctcctgtctcagtctcctgagtagctagtattacaggcatgcaccactatgcccggctaattttgtatttttagttgagatggggtttctccatgttggtcaggctggtctcgaactcccgacctcaggtgatccacctgcttcagcctcccaaagtgctgggattacaggtgtgagcagccgtgccctgctgaaacttatttgtttgagcaataaaagccacatatttcctc

SEQ ID NO: 1901 - DNA, 2946 bp, Homo sapiens
ggggcggaagacaagacaaaaatgactccagttcgctagacgcgcagaggggcggatagcgcgcggaccccgccttccccaaccgagtgtgggttccagtcgctggggaggacctggtggccccctgaccttggacgagccatattggacgccccggcgccgtcccgtcttccacgctgccaactccaccgctcccgccccgaactgcggcctaggagccaccgcagcgcacccagcccgcgagtacagccgcatgggaataatcccaacatttgcctgatttattttcttccctctccttacgcttgtacttgtttttctcctctcgctgttttcccttcacactaattcgcaacctggcagtttgcaaagaggaaactccctttcggaatggaaagccgcttttgcttcttgttgttgggggtggaaaacattccagcgagaatgagttcaaaaagaagggaaaccgcgtcactggagagaaagtaacattaagagatcgatgaggacggagtgggtaggggggacagagagaggaacgtctgcaacaggcatctaaaaacaagcgtggaggagcaaagattcccaatccccgggttactaccgcgcgcgttctgcgcgagccattgcaatgccagcatttactgtaagcagaatttgaaggcttttgaaatctttttttggtaagacttacctttctcttcggcataatgactatgtcggtgaagcaaaaagtaaagcaacggactggaactgctggcgccgccgctggatgctgcctctgcctctgcagctgctcacgcgcagggcacgacgtagcccggcctcttcgacctgcacctccgcggctccctctgggggccctctgctcgcctccctgctgctccaatgaggagccccgccagccggccgcgaggccccattggctgaggcaacgttctaaattccacgagggcacgcccacctccgcgcgcggtacgcgctgttgtagtttccacttcaccgaaaaaaatctgcctggcgactgagcatgcccagttcaactagtagcctccaggccacacaatcctgaagtttcattgtttcgctgctctctctttgagattgtaagaataagaacagtgtgtgtcttcataggaaggaaaaagagtaagaatgaatacgtaaactttataatgtaaatatatacacagcaggtaccttattcatttcctacccataaaggcttttaatgaatgttacatggtgggaatctgtaaagcgtgggaaggtactctgtactggaagagcgtggcaacttctaaaggcctcagtttccccccctagatatatagtgacaacagtccctaaaatcacttagctctaattttctgaaatctgtgattataaatcactcactaattcagctaacttcaaactagatgtgaagacgaataggacatgtttgttacggaaattaggaaaagaaagaacaaggcaaaaactgattattttatatttgagacatatatttgaatgacacccgtcatgttacactttatgcgtaatatttctcaaagttctgcaaggcataaaatgagcattgcaaaaatatttctgaattcattttatgagaccagatttactctgataccaaaaccagtgaaagacttcaaaagagagttacagaccaatatcactcataaacatagacacaaaagtcgtgaacaaaattttagtaaatgaaactcaacaacatttaaagggacaatacatcatgacctgtggggcttatcttgggaatgcaaagctgcttttttaatatctgagaatcaatcaatgtaattggcaggattaatagaataaagggggaaaaacaatcctttcagcagatgcaggaaaagcgctagtgaatgggtaagcaaattgtgatgagcacatgcagtggaatactattcagcaataaaaaacaataaaaaattttcctacatggatgaatatcaaaaacaaagtgctgtacgaaagaagtcaaatacaaaagaccacactgaatgattgcattcatatgaaattatagaaaaagcaaaattgggcaaagttagtttcagaatcatcttagcaggcaaagctcacatcataggaaaatgtgttgaagccttacattacaaatatggccaaatccactttggtaacacagaggctgcaaatatgtattaaaaatatcatgtattaaatatgtattaaaaaagcaatgaagtttaatatttcactttttctttagtaattttcagaatacattaattgatctagtactctccagaggtggttgattactttcttttttggaacatctttatgaactcatggatttttacatatttggtgtgcatcagtgtattgctatcattattattacctttttaatgctcctattaccacatctttagccaatgcataccctttcaaattagtgcttgtgtccttttgacatgatcttaatcatttttgatagattccctgttcttgggcattcagtgaatgacaatagtatactgaaacgaattaagataaaaaccaattgcttagagctagataaaaatttacaagttaataattttatcattaaaataatatttataatgaagatgtctttcaagatattaatttgccaaatacttgatagttaaataaagaaaaagtcagtgaaaacatttttagtaagatatgtgtgagaaggatactgagtagcacttgcaatctggactggatggctatttttcttcatggagatggaaaggtgccacaacaaaggtagtgctaaggtgaatatttctcctctgtgatgaaaaataactcacaaaattggcttctttgttaattttttttcaaaaccaaacactcagatcatcaacagcaaacaaaattgtgaatgtttttactgcacacaataaaaatgctacgatgaaa

SEQ ID NO: 1902 - DNA, 1536 bp, Homo sapiens
tcgtccctgttggaggcaagggtctgcccccggctcttacttaaggagcgggacgggggacgagagcgtgcgcggcgtcacacgcacgcttagccaccccccaagaagccgccgccgcgctcaagctccgcgcgctcaggaccaggtagcgtgtagctgtcgtgaagctccctttgctccggttgggactggctgcggatacctgtccgttatccccggcaccaatgagagggacgaacaggaccacctgcaccgcccaccaccctcgctaacaacgctttaaggcctaacgcaggaggcagctggtgcgaatttacaaatcgggtttttcacccccgcgtggctgcaatgtccgcccagttcgagccccacattctcccgctggctccgcctgggggtcgggccaactcttgctgctaaggaagcctcaccagtccccttcccgtttgctacctaaatgtcctcggcgggaaactgctgagaacaatttggggaagcctgaacttgttcctagttccgcgctttattacttgtgatcatgactggtcagaactccgcccggagcctccatttgttcatctgaaaaatggggttgagaagctcaagtaccagaatgtgaaaacgctttctaaaggcgaaggcatggtatcttgtgagatagtaattccttcaaactcacgcataggctattcctattcctaactttgcgatctgctttcactaggcaatccctttccctttgtatccttataattttcacctatagattttacccccagggttttttaatgccctctgaacattatttccatttcagttaagcttgtctggccaaatttggttgtcctccagagtctgacctctttttgcttggcgcttgtttcaccaggttgaagtggtcctttaggtctcagtttttcccgtatggggtgccttacttaaaccaaggtgcctcggggccagtgctagtttcctagatactggaggaaagcaagcaaggaaggagtagagaatccagtcacttgacttcattatcctcttcaaaccgaaattttgaaggacaaggaaaagtttcaaggctgcagcctttcacagtcctctgagggacaaaactcaaatatagttcttgccttgaaggtggtcacaaacaaaaagggtaaatgatcctaaggtttaaatatagacctaaaagagagatatatacaatggaaatttaatcttgtaattctttgcaggcagcagtaatttataggttaaagtcctggttgtagtttaattataaaatatgttcttttattagtatttatcactatggtgacttctttagccaaagagtatctaaactgaactctcagagctaacagaagtaactatgttgcagtgagagcaacagtcctgggtctctacctcttgttttctatgtgaccttggcaattcaaccaacatctttgaggctgtttttttggtaaggaatggaaagaacatatggcaacagggatttgtaaagtaccgtataaatatatatatttaaattaa

SEQ ID NO: 1903 - DNA, 502 bp, Homo sapiens
tggcagatctccaaccgctcggggtcccgtgatttccattaatgaattcgcacactggcgttaccactcaacacaccgacgaagcaagacgatagacaacaattagctaaatctacattattggacatgatggctaagtaaaaaacatcacaccagaatcaaggattttggtatctgcatgagtcctggaatcaatcccccagagatactgatgggatcttaacaatgacagtaattgatggtgtgtgaagaaaaaagggaagatcaggagactttaacctgtggtattcccatgtttagaagcaaaatggggaacaaaaaggaagcgaataacaatcagaaaaataggaggataacaatagtgtaatatcatggatgccaaaggagagtttcaaaaagaagaaggcaaccaatagtgtcaaatgtttcagacaattgtaaaaattcaaaaataaaaatatttaaaactttcaaaataaaatatcaaaatatcaaaataaaa

SEQ ID NO: 1904 - DNA, 970 bp, Homo sapiens
ggggccatcagcctcgctatcacctccacccccaagtgcttggctccccaagggacagctctaaaatccccagaatctcaggctggtgggtccagctgagcatcctagttttcactttctcctcccaaaaaggaaagaaccttggtcactaaattctacgccttctggaaatcactctgctaatgacttcctgaatgatcgactgagaccaacagctggcccagccctgcatggaggagtaagaaaccctcatctgtcagagttaaggggcctgaatgggtacaggtcacattcttggagctcaaggtgacaggccagagcccaggtccccaggacagtgcagcaccttgtccaggcgggcctcccgtttctggctccgggctgagcttcctggagaagaggaaggttcatctgaattgcagaagctggaagcagagagcccagttaggagctactacaactatccaggcaagaaagacagtggcttggatggggatgtggtattgaaagtggagactagcagaggtacttggaaatgtacatcttatagctaccaagacttgctgctggtgtgaatgttcaggtaaaagagagagaaatcaagaatggctctaggctgggtgcagtgactcatgcctgtaatctcagcactttgagaaccgaggcggatggatcacttgagctcaagagttcgagaccaaccagtctgggcaacacagcaagactctgtctctccacccctcaaaaaaaagaaaaaaggaaaggcatgactctgagggtaaattctaggaaggcatgtggggtgggaaatggggccagcggtgtgattaaagaatgtacatggtagtagagggatgcagatctagataatattgaaaggccaggacttggacttctgggaatgggaaacatgatagaattatctgtaattttccagaatcaatgactagttgtttttttaaaaaaagaa

SEQ ID NO: 1905 - DNA, 2107 bp, Homo sapiens
aataaattccacactcctgatcgcatgagcccagtaattcaaggctgtggtgagctatgatcaagccactgcactccagcctgggcagcagagcaagacctgtctcaaaaaatacatacatacataaattccaccctttttgatagcatgttatgaggctcaccaaggtctatcctctggcagtatccctggcctgttctccccatctcccctgccctctgctcaccagttccctaaatgtatcttgatctcactagccctacagactgtgcacagagctgtttctacctccagtgacatgcttccgcccaggcttctccccctcccgcctcaatcttcccctcaccaacttaaggtcttaggggcccttctaggaggcagtccccaacttccagagccagggtataggctacttctatgtgtcccatggtactgccacagaagagtctcagctctctccaggattcagttctaaggtcagtgcctaagataaaaatggagtgtaattaaaattcctcttagaaatctaaggaaggtgccctattgaagaccaacatcttgaggtcccatgtagtcatttcttgcccatgtgggaacacattactgtttggttgagtaccaggtgaagtgattggcctgcagttagggctgtgttgtgcaaaaatcacttgttttggggtgttagaaccacatttaggcgagaagatcacttttggggagcttgggaactgaggcaggccgcaggtgcagcagaggcatgagcttgcccgggcccgccctcttgtctatgctcatggagtgaaggaggggccagcggaatggcccaaacaactgatttgtttttctttttttaaatctttttcagacaaataccattgtgtttaagcgaaatgtgtgtataatgccaaatcactgtaccccacaaccctgcacacctctacactggactgtaatttcttgttcctagtttgtcttgctagactgtaagctccgtgagagcagggaccgtgtctgcttgttgagtgggctttcccctgtgcctgccagcatgcctggcatctagcaggtcttctgtaaagatgggatgagtttgtaaaccctccagcctcaggagtggctccatcctctgaggctctggggccctctggcaggctagtcatttttctgccatgtacgtacaatgctttattttcatgttgtattttcctttctagccagtaagcaagctcctaatgagcaagtttctttgtggtgttatctctgtatcctttcatcaggccagcccagagtaagtagtgcttcgaaagtgtttggtaaatgaatgaattatggtaacccagcccagttctggcatcactgtctgcaggttagtctaattccagatgaaagccccagattcgaaaaagggaagattattcagaagtgcatatggttgtataagaaaaaaaaatctcattaaatagacctgagtaaacttcaaattttgatgatctggccatgtcggagctgaagcttaccagctctctaaagcatttgctagggaatcatgcagatggtccaaaatattttttagaaaagcattcatctgtcccgggatagaagtagaggaagctggtaggcaggcgctagaccctaaagaaggactgctgagccagttcttaagcctgtggtcctgtcggtgaggaaagtgagagcagtccagagcaggtgaaaagagcagagctcattcctccagtggctcttttgcctaaagcagcattcctcaaacttctcactcgaagcattaagttacggtgagatgctaacacacgctttagacttaagtcaaaatttactgtgaagccacagcaaaccatggcttcacagatgaattagttgctacacaaataagttcgatacataagtacagtaattgcttttaaaccttataataagcagtaaattagaagttaaaccatgtttttcttttacgaactgaaagaagagaatgcttttgatactgagaatcgcacactgtgtccaggaagattgttcttgcataaccagacccacaataaatatctacaacttttcttacatgtttataaaataaatcttagaagaaaaa

SEQ ID NO: 1906 - DNA, 687 bp, Homo sapiens
aggggtgcctgaggagaaaggggtgctggttcttccttatatcccctgcctgcctcagctgggctctgacccagccagcagactggagtcctcttctgcatggtaaggaaactgaggcttagaggagttatgaaattgcccaaggtttcacagctgaaatgtataaggacctggacttgcaaatttggcacaaagttcttctaataagaggccataaaataaccaaatgattttttatgtgcctatagaaccaaaagaactatttcagaatgtcagctgaaaagcacgatattccagatagtcttagcaaacggcacaccagaagattatatcccaagcctggctcagaaggtcctatgcccatggagcctcaatcattgctagcacaacagtctgagatcaaactgcaaggtggcagcaaggctgggggaggggcgcccgccattgccgaggcttgacttagaaaccttggcatagtgccttcctggaaatcctggattgcatctaaaaccatgtggcagagggagaaacaacagacaggacatcctgagaagactcaggctgggacgaaagctctgctctccagggacaaagcagcaggggaccagccatgctcagaaatactccactggccagtgcacatttttttgagcaatttcacttgcttcctcaccacctgtcccccta

SEQ ID NO: 1907 - DNA, 456 bp, Homo sapiens
atcatggcaacaggacttttagaagcacgtcctctgaaagccattttctgcctgtggttggaaagggactgtgagtctttcctcaggaagtcagtagccctacctggtgaggtgatcaagagtttgctagcacaagagatgaagcaacaatggccatgagggattcaaggattatgcgtctctgcaccctacaatacaccaactggcagttccatcatttgaaagaaaatcttcaaggtaaagacatttacaatgacacaaaaacctttcaaaggcatcatggtcctaaagggctttccccaagggacagcacagtgtgttccaggccctgacaagaggtttaagacctgtgacacagactgaagctctcctggcatactctgaagctctcctggcaccctcccctttatgcttcacaggtgtttctcctaataaatttcttgtatgtctcatccc

SEQ ID NO: 1908 - DNA, 823 bp, Homo sapiens
gcaggtctgggcaccgtaacaattttgcgctttgcttccccagggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctgggtggcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctgccacctccgactggtggagaagcctggcaggttaataaacttacttggcctga

SEQ ID NO: 1909 - DNA, 133 bp, Homo sapiens
tagcaagcctccagcgtgcttgggtctgcggtgaccctatgcattccttcagtgcttgctagaacagttttgaaacggtttgaggccttgccctgctccatccagagcaaggttatagaaatttcagacaatg

SEQ ID NO: 1910 - DNA, 638 bp, Homo sapiens
ctcgccctgccgccgccggtgctccgtcgccgccgcgccgccatggaattcgaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactttttcccatagggcggagggaagctcatcagtggggccacgagctgagtgcgtcctgtcactccactcccatgtcccttgggaaggtctgagactagggccagaggcggccctaacagggctctccctgagcttcggggaggtgagttcccagagaacggggctccgcgcgaggtcagactgggcaggagatgccgtggaccccgcccttcggggaggggcccggcggatgcctcctttgccggagcttggaacagactcacggccagcgaagtgagttcaatggctgaggtgaggtaccccgcaggggacctcataacccaattcagactactctcctccgcccatttttggaaaaaaaaaaaaaaaaaa

SEQ ID NO: 1911 - DNA, 3950 bp, Homo sapiens
gtggccagggagccgcaggcaagggactaaggggaggggggctcagtgccagctgcttaaaaatgcccctgtggcagcgaggggcaccagaggctgggtctaattagttgagaagcagtgacacccccaaccactccccaaacaggctggctcccgtctccaggccccaaggagccacacctggaccagaccccaggaaagccaaagatggagactatggtacactcttcacagccaagggcaggggacagaggagaggcggtgcccaggcaggatgcaactatctccaagagatagttagaggatggcagcctatcttgagttctggctgctctgcccaggaggtccctttgaatggccagagatggtctccaatgctgttggcctcctgcagaagaaagagcccaaggctgggaatggaaacccttggttctattcctggctgtgccctaactcttcatatgaccttcaacgcgaccttgaacatgcagcttcctctggcctcagtgtgtccagcgagaggctagacccggccaggcctggtggctcactcctataatcccagcactttgggaggccaaggcaggcggatcatgaggcaagggcgctagctggtgggagccaccccgccatgctgatgtcagagaagcaagaactctggagaagcagcctcctgggaccagaggagggccagcagcaggcagcccggagacagaactaatgtgtctgggggtgagaggacgggtgtgactgctgaaacttcctttcttggtgattccacatcactcctttctgatccctgagcctgtgccacgccctgtgtgatgtgccggggacaccaggctcacccacgcctctccaagcctcccaacagaagacagaggtcccccacagccagagacatttcctgaagacatggggaacacagaggcagaaacagcccatccacccaggagctgtcccccacactgccgggagccggcacccagagccgccaggtaaaactgaggccacctggttcaacatcacctttcacagaaggggaagcagccacagaaagaagggcctcgttaagaagtggaacctgggacccccaagcggtgtctctcatcctgactggggatccagagtaggagggagcctttggtggggtaagtggaatggggcggggtggggggtggccatagacccctcttctcagtaaggccctcatgtgaaggaggcaggggttgggacaagtgctaagtatgcaagactcaagggaagagctgctggagccaggagaagcacctccctcccggcccctctgcccctcctcatagcccagctgcactgactcctcctccaggaagccttctcagcttccccaggggtgggaacctttttgtcctccaggtgtgcttggctgtcctttcttgggctctctctctctctctctcctcatcccacttgagtctgccccctattcaccttgtgaggggaattttccttctactcaatctgaccgaggtcctccaggtcaaggacagcgaggctctcagtcccacttccccttggcacatagaagaggcagtgcgctgaagggacaggtgaaatgattagaccctgcccccaaaccaaggcctggccaattggacagggcatgagacattcagcgtagaggttaaaacgagggccctgggttaggaaccccagctcagttctcagctctgtacccttggaaaattcccttcccatggagctttgtggatgcacaaggacttgcacaaagaaaacattcaatatccaggactataaaattccacaaatgattgtgcttattacattcattatcacgatgattattccagacacaaaggaacagaacgaggcaccaacagcaaggggcaagcagattcaagggccacagaggagatggaggcaaacaccttcccctggtcagaggctgtgcctcagcccttctccctgcatcagtttctccttcagaagcatgggactacctcccatctagttctcgtttctaaacctaggggagatgctatctttgctgcaataatcttagcctacatcttggaatggaaatggccttggtggaaatggtcttcaactcctctggtccaagctcaggccctgtgaccctggaacaatccccttcctggtcctccatgtaggagcaataacattcccttgccagcagcaccagccattctgatgattaaatggtatcggactctgttttccaaactcagtcattcagatgccccctattttatttcttccatgtctgcaaatgattataatatttttaaatgtaggatgagtcctttttattacacatagaaatagctactgtaaatagcaaactctaacactgtgcctaattaggaaataaaggtaaccataaatacagtaaaaatgaaacaatgttattatggtttaacctgatagtgtggcttgcaaggccctgggcctgaagcctgggcaataagtgagagttagaaaggtgtcaaagacatgatagcagcaaactgaggctttgtaccccacggtaaataggactgaaagcaaattcacagggagcaactgatccattccacaacagaatgctccctgtcaattcgctttccattctgttgtgtcctgtctcccagcagagactacaaactccccaaaaccacttacccaccagctgcacgtgagaagccaaaggtagtttatgtgaaagggctttggaaataatcacgcaccaagtgaaggcagaggacacaccttgtcagcttagttctcagcagcaaatcatctcttttccaggataaccctccctgattcttattgaaatctctttgctgaccacactaagctcttctctctcaggggcagtgggagccgtggagagtggaatagaccagctgtctgtgacctgcgagggagtccaatgtcggaatcactccccagccaaatgcacggttttaaaaaatctatttatttatttatgtagagaccaggctatgagactggctaatttttcgtatttttggatagagacaggatttcatcgtgttgcccaggctggtcttgaactcctgggctcaagcgatccacctgcctcggcttcccaaagtgctcaggattacaggcgtgagccacttcccagctacttgggaggctggggcatgagaattgctttaacccggaaggtggagtttgcagtgagccgagatcgtgtcactgcactccagcctgggcgacagagggagactctgtctcaaaaaaaaaaaaaagtcaaggagggtttcccagagtggccacttgattagagacctagcacaggaggaagagatgggcagggagagtgacggggagcagcacagtccctgggagcccgaagtgggtgggcacagggctccctaggagaatggaaggacatctatgagctgtagcccaagaggaagaggtcactggggctagatgcggcagaccctcgcaggctttgggaagggcttcagaattcagcctgagggcaatggggagcccttttgggatattaaacttgagtaagatatgagcatatttgcatcttgaaaaatcattatgggaagatggctgggaagagaggaggagtggcagaagaaagataggttggagacaattgattgctcgatgatataaaatgttaagtaccatgaatgatgctgttaggctggaatgcgccaagcataaaggtggggcatggcatcaaaaggtaggtcaacatattaaataattccatgtattgaaatatccagaaaatatatagacagatctatagagatagaaactggtctgcccaggactaggggttgtctaaggataaggagcttcttttttggatggtgaaataacctaaaatatattgtgccattgtttgcacaactttgtgaatatattaaaaacctgttaattgtactcac

SEQ ID NO: 1912 - DNA, 8708 bp, Homo sapiens
gtaaaggactggggccccgcaactggcctctcctgccctcttaagcgcagcgccattttagcaacgcagaagcccggcgccgggaagcctcagctcgcctgaaggcaggtcccctctgacgcctccgggagcccaggtttcccagagtccttgggacgcagcgacgagttgtgctgctatcttagctgtccttataggctggccattccaggtggtggtatttagataaaaccactcaaactctgcagtttggtcttggggtttggaggaaagcttttatttttcttcctgctccggttcagaaggtctgaagctcatacctaaccaggcataacacagaatctgcaaaacaaaaacccctaaaaaagcagacccagagcagtgtaaacacttctgggtgtgtccctgactggctgcccaaggtctctgtgtcttcggagacaaagccattcgcttagttggtctactttaaaaggccacttgaactcgctttccatggcgatttgccttgtgagcactttcaggagagcctggaagctgaaaaacggtagaaaaatttccgtgcgggccgtggggggctggcggcaactggggggccgcagatcagagtgggccactggcagccaacggcccccggggctcaggcggggagcagctctgtggtgtgggattgaggcgttttccaagagtgggttttcacgtttctaagatttcccaagcagacagcccgtgctgctccgatttctcgaacaaaaaagcaaaacgtgtggctgtcttgggagcaagtcgcaggactgcaagcagttgggggagaaagtccgccattttgccacttctcaaccgtccctgcaaggctggggctcagttgcgtaatggaaagtaaagccctgaactatcacactttaatcttccttcaaaaggtggtaaactatacctactgtccctcaagagaacacaagaagtgctttaagaggtattttaaaagttccgggggttttgtgaggtgtttgatgacccgtttaaaatatgatttccatgtttcttttgtctaaagtttgcagctcaaatctttccacacgctagtaatttaagtatttctgcatgtgtagtttgcattcaagttccataagctgttaagaaaaatctagaaaagtaaaactagaacctatttttaaccgaagaactactttttgcctccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaa

SEQ ID NO: 1913 - DNA, 646 bp, Homo sapiens
gttgaaaataaataaataacaaagaataaatatccctttctcttcttccctctgcctgtatccatataggggaaagaaaaaactgctctgagattcagtgagattatgaccttcacaaaatcatgaactttctgctgcctttttaaccagaaatctaggcaggagggtctcaccattttgcatatcctacctgttccttacaggctctaggcttttgagccttcctatcatttgaccagccaagttgcttctcagcaccttttttttcccctttgagtcagggtctgggtccagtggcccaattatagctcactgcagcctcagtatcccaggctcaagcaatcctcccacctcagcctcccaagtatctgggactacaggcatgagccaccatgcctagccttcaggcaccttccattcagaccacattttctgtggcaaactgacaacgccaatgtttgcagtttgcagtttaactacagctgtattttttgccaaacatttacacctaactactcttttccactagagtatataacaatttacagaagcatttaatgttttctgaatccccaagctcatcagcagagaagctccaaaacatgaaggtgtacatccctattttaggccttcatagaaagaaacc

SEQ ID NO: 1914 - DNA, 6253 bp, Homo sapiens
atatgttctgaaattaaacttgaacttttttctgtgaattttgaagatttggtatcttataattatttggtgagcatttggcatgaattatttagcttctcccctgtttatgatttatttctcttgtcatcgatttccaataggaaaatgttatggttctaaatgtctcctgtagacttcagtaattgaaaaatgtcagtcaagatggggggaatctgtaatatataatagagtttatcttttagttatgttcatttccactttttttaatgtgttttttttttagtaaatgtcaaaagtgttactcagtgcaacatattatgcaatattataatcaactaacctcttcattgataatgacttcatattgagaggttttttaaatctagaaatattcttgttttaaattccaggttaaaatgtaaaggtatttttatttttttaattttaattcttctcaaagctactagtacattataaaacaacaatttcacatttagaatttttatatgtatataaattaggattattttttaatattagccttaactttctttaacttttatgaaaaacaactagtcccaagggtatttttactatttaatatacattattcctgtgattcaaaatcttagcagtagaacctgttgagctacttaactttctgtcttgggactatccaggtgcagttataactggtttcaaagttgtgaccttttccttgcttgtttcaaaatcattccttaaaaaatgttcagtatttttcttttgtcaaaaaataaaaacaggatttgtgggttgttctgttttttaaaattagtttgagaaacttcctttgccacttgttttctgtgcaaatgttgtaagagctcaaattccctgggggtagggaggacttttataaggtttttttggttgaagggtataaaaggcacttaaaaggtatacagttacttttatttcgatatcccagtcattttgacattatgataagctttccccactttataggttatctgaaaatttggtggggggcgggtattttatttatacttaatataacaaaattattttcctatgtgtagtcaatagcacatacaaaaaattatctcctgtttgtagtcagtagcacagtcagtattcaccaaaatactgagttatttttcaagtaaaggtataagtatgaatgagaaacagtttgtgggttgggtattgtcagtccttctttttcagataactttctaaatggtcattcaatctgtaatcttaaacttttttaatgttataaattcttcaaatcagtatttgtattaaatgcagtgaccagactatgtcactgatacaatgtcatgattagatgtgcagaagactatgttacatggatgataaatgaacttttaacatatagaaattaatatcagattaaactaaaacattaagcaaagttaatacatgcttgcatacatatatatatttatttattaatgatatgtggagaatctttgtgcttcatagtcactagacctaaagtagaagcagttgtcaagaatgtccaactgctattcatctttgtggccaaagtaaatttcagattttttttttgtaatggttttctttagtctctttattaacccatcatcatgacaagtctgtcaagtgacacatgtgaaaagcagatgtcctttcttattcctggtgcttcctaaggaggcagtgcaatgcaggagaaggaacattattagagataaaggaaaaaaccagaagtgctttctcctctcacattccactcaacacttctctcaccaaatgtgtgtggggatttctctccaccaacaaccagcagttctttactgcagattctccagtggataccagccaggtgtcctctaattcagttcaattctgacattatctactgggagatagtgtcagatcccgcaagtggagggctcagtcctacaagactaccccttacttcagatgtcagtcacaagcagttagcggtttgtgattctgaccaactggctagaggtccccctcctcaagtgtgattaatttgctagagcagctcacagaattcagggaaacactttatttacatttacccatttattataaaggatattatgaaggatacacatgaactgccagaaagacaaggagcataggcaagatactgagaagggtcacggagcttctgtgccttctccaggtgcaccaccctctgggaatagtcagttcatgtgttcagctgtctcgaagctcattcgaaccctgtccttctgagtttctgtggaggcttcattacgttaaggttcagaaatcaataccccaaaatatggggctttgacatgctgaattaaagaagcagcctcaaggcctcttggccttctccagctctcctcacccaaatcctgtctctcccaaagcacaagatgaggctgttcaccaaagttcccttatttacctagaaactggaccttaaagaggaacacagttgcctgcgattccatccctgtaattttattaaccagagattaaaacttatatcacagaggaagagactaaaaattaaacaccacacctggagcccagatgacctgtcccaatctattatctgttctccagtcccatttagttcccaaagggaatcatttacaaaccattgtctgatcttccggcccatttatttacagctccccctctttccccaatgaaaatgatacttaagtgtcagccatctatcggctctttgagttttcacattttgtatgactcctgtgcacacacatgcatgtaataactgttatacttgttaactttttttcattataggggtatccaccatgattatatatgatggggaggaaagggattactccatttctgcccctgcagtctgtaggcatgattgattacatcattggtcgccggtgattaactcagtctccaagccctgtcgtgtccctggaggttggagggtggcactgaaagctccaaccatctcatcatgctttgatctttccgatgaccagaccccaccctgaagctatctacgggtccccagcaacattcatttcgttatcatacaaatgacattcttacaatttcagagattccaagggctttaggaaatggagatgaagagcaaatatatatttcacaatatcacaaacatacccttgggaattagacctctgatctaatctaggctccctcacttgccatttttgtgaccttgaacaagttgttcatcttttctggatagttctctgttaaaaaaattaaaataaaaaaatggtggctatcaggttgttaggaggactagataagagaactatgtgaaggaccctgcacagtgctagcaacaaagttgtttagtaagtgctatttcaatttattttgcttccaagctcatgtgagctccctcagtgtgtaccaccaaatcacatgatgtgtatcccagtcaaatcttaaaggtcatccaccttgaatctttaagttaattaacgtgtgtttttaaaactgcattataagaacgttagggtttttgttttgatcctatggaagttaaattttttacacaagcattcaactgtttagcttcaaactgaacagataaatagtctgtattatttcattatgtattaaaaaatgattaagcctgcctcaggcagttcaggcaaagcaggtaaaagattatcaaggagtaacattagaaaacactaatcagagtgcctaaaaagctttatgcggtccaggttgtacagggatgttggaacagtaaaacaaacaaaacattacaaggtatgaagcgttcgagataggtagaatagagcaggttatattagagaagtctcttctaaaattgtgttggctagcctgggatttgaacttataccgtgtatgtatgtccatgtgtaacaggttgaacatgcaagaagcagtgttcataaaaggtggcaaacttgttttacttgtttctcagtcttttcagatcagtacttataaaacactgatatttacagtaaatatcttatattaaatattagctaaccctattaaattgtgtgtccttgtgctgcagtcatttaatgacctcattctttggtaagttggcatgtgatttgagatagctctaagtgctaatggattgtttgaaggagttaaaggcaaaaccaggaagagaaaactatttttaggaaaaagcgatcatacaacaggccttaaatagaagaaatgagatatctctatctttactatgtaacctttaattccttacacattttgacttcatattttttgtatgtaaatgagaatgttatagtcttgtaaattccttttcctctgtgactacattcagttatttattttattgtgtgtttgtgcatgtcggtagagcacagtatttagtagaatgagttattggttaaaccacctggattcatttgtaaaatggggccacctgtctcttaaattgtaatgaggatttgattagataatctagataaatcacttagcacaagagtctccagcccccggactcttgactggtactggtctgtggcctgttaggcactgggctgcacagcaggaggtgagcagggagcaagctagcactagggcccaagctccgcctcctgtcggatcagtggcagcattagatactcataggagcacagaccctgttgtgaactgtgcgtgtgagggatctaggtttcgtgctccttacaagaatctaattaatgcccgatgagttgaggtggaacagtttcttcccaaaaccgtctcaggaaacctgtccctggtgccaaaatttgggggacctctgacgtagcacactatctggcacataccaagcactcagaaaatatcccatttctcaaaactcagttccagtgtcaagtcttaatagtatattgatcttggaactccaaggtagttggtcctctctttgtgccataaatgtgccttgtactcagtagtgctaaattgctatcaactagtgctaaatgtactactaattcatctgtgtgtccacttcccttcttagattgtgagccccttgaggacagagatgggtttactcatatttataaattcattggcatgataaatatttgctgaaagaataaaattgtattcttatgttttaagcagggtcccctccacctctgagtggaagatggtctgggagcaaaggtgacaggtcttctaaaaaatctggccacattctcaacccaccacacccccgcttttttaaacagctatttaattgccattgtaatcctaaggattggatcaatttttcacttccctttttcacacttttttccttttactaagaaaataaagtaataaagtgactgccaaatggagaaaactgtccactaaatatgaattaataagtgctattatcagaaattgtgtaaaagcaacataatggcactataaaaaggtattatcttagaatcaaaaaccttgggtttatattatagccctgctactttctagtcatatgacagtgatcaagctatattacctctttggcttgacaaaataggggtcatctctatttctggcttgttatgattgatgtgaaatattcatacaaactaccactgtgcctggtaagtagaagacactcaaatatgtcttggagttacagttaatactgtatcgtttaaatttgagaaaaaccaactttaaaaaatcacatagatacagttgtttactgctagaaattttatttaaattagttgatactcttggttaggtaatgaaaaacaatggttttatctccattatgctgtgatagggaagagtaacacagttcaaatggcaaaggcatacctgacaattaaaatgcatagttaaaggctaatacttcctgaacacaagaagacaagtctctacttgatactactctccacagttaaatcattgatactttgtgccatacagtgaaaacagaaccatctaggtgttcacggattgtatttttccttatgaaaggtagaaggttagagaaaattattcccaatacaattaatacaaataaaattggttattaggtgccttttaattaggcagtaagggcatatgaagcttcattacctatgagaattttgtcaaaattatttcccagttaccatgttttaaaacagcctctcagaattccccacttctaatttctcctttctattctaccaattttactccatacctttttgctaaataaacattttcttcc

SEQ ID NO: 1915 - DNA, 503 bp, Homo sapiens
gacgcaggccctgggctacagcaaccttaccagcccctccagcttagaggtggcagtggctctctgcggctgcgatttctttctcggagcgtcctccccatcccgttcggcctctgcctccaccgtcgtctctgtaacccgttccctgtgggagagtctctgttgcggtgttcaggggtttcggttttctggctgaacagtgattaacgcgagggaaggcgctgacggcaaggtggcaggaagaacattccaacacagaccacaacacctatggacctggaaaacattgtgctcagtgaaagaagccagacacagaaggacaatgttgtatgaggtcttattctgttgcccaggctggactgcagtggtgcaatcctagctcactgcagcttcgacctcccgtgctcaagtgattttcccacctcagcctcccgagtagctgggactacaggtgcgtgccaccacgcctggctgatttttcttgtatttttttgtagagatgg

SEQ ID NO: 1916 - DNA, 761 bp, Homo sapiens
cccggccgggggcagcctcgccgccgctcagctcgggaatccctgccccccaccagcacctcagtgggggatactgcaagttcaagaattggggccaggatcaggtggtgacagagccacctgggtttccggagactctcaagccaaccccaagtcatgacaaatgccagtcgccttggacagaggcaagggcctggacgcagagaccagaggcctgaactggcagactgtcctcacaggctgtgtgacgctggctggtcgtcccatctctctggggccccacaggactggggaccaggtcgtggaatgacagtggaccacagtggtccggggaccccgctcgttggtggcaggcacaggcccgtgtgatggggacaatgagctttggtggtttaaggcgtgaatgaatgaaggagcaagcagtaagccccgacagcaaggccaccacagccctcgccccacagggacgcctgagcaaggacccaagcaggggacaagcaggctcaccccgcccttgcggggctgaccacgaggccccgtccggtggaacacgccatgacgcttcaggaggctcatgtagctggcgccgtatgggacagcgggggagagagaaaatgcacagcccagggaatgtggagacaggcccagcgccaggcatgggggccggaaggagcagccggggagcagggggcagggcctggagtcccgccttgcagatctgaacctgccccagccccaggactctgagtgcagcaagaggg

SEQ ID NO: 1917 - DNA, 542 bp, Homo sapiens
ccaaagctttcattatccccggacaagtgcaggcccacttcaggccctgaggagtgctagctcattcttttactttgggcaaagagggcggctgtcactttcttgttcatgctgaggattcggctcactcaagatatctgatgcccttgtgacagcgtctggctgtcagagctcatagaccatctgctgggactgccctaggcccctcctttagggcacagaacgtggcaataatgtgtcccatttggcagcctgtgtgacatttcttcttgtatcttatcaggtgactcaaataatgatcatgcctgttgacacttggagctctcaaagggaattctgagcagcaaaggaaaggtgacacagaactcaagggcactggcgctgagcgctgcccatgcagctggcaattaagccattgccgaaaacaacaataaaacagattttgggcaagtagggaatggtggattgaatccagtgtggcaaaaaaggaaatgcaaagtgaggaatgtagtttccagataaataaattatataattgtgat

SEQ ID NO: 1918 - DNA, 1011 bp, Homo sapiens
ggcgcatcctcagggcctgggcctggcctccttgcctgtgagatggcactgtgacggtgcccacctcgtggggtgtgtgagggccgagtgaaatcgtgcatttgcgatgtctaggacacactggatttgtacatctggggctcaggagaggaccagatcagagctggaaatcatgccaggaagagtatgaagcagggagagaaggtgtggaggcctccctgaggaaacgaggggtcgagcaggtgaagagggggctgagagctaaggagtgcacagagacaatgacagaaagacgggaggtctggtttcaggaagggtgtgatggacagaagagatgcagcagaggtcaaggaaggaccaagatgcatcaggaggaaatgcccatgaccttcatcgcagcagcgtatgtgcgttggtcttctccagggatgccgaaagtagacatacagggagtcgcagtacggataccaccagtgccagcctgacctcacaagagacgtcttgtgtgactggccctgccgtcacagctgggccagtaaagtaccttccaggaggctccagttgctacctgactcacaaccttctaatcccatgatcttttagttctagtttccttatcttggtctgagcaaatggctcattttaaagatgacttgcagacaaatgtagagatcatcccaggggaaagtgccccaagaaaggagagtccaagaccacctgcccctcccagttctgcggctggagtgggtgggtgcagcaaccacagccccagtgtacaggagtcaccactgtctcctcccgcattggcccagcttggaagtgcacagcaaccaagcatgaggactgagttaagcttttcggagaaaaaagacactatgatcatctggcagatcacgatcactgtttggtgccagaggtaaggagtttgcttgttgtgtttgcttggaggcgacagttggcaatgacagcctgggagaagcaccggcagttaacagcactctgcaccactca

SEQ ID NO: 1919 - DNA, 1822 bp, Homo sapiens
gttcctgagagcacaagcacccccaaatgtgaagtgcactcggacacacacacacacacacacgcacgcacacacaagcactcatgttctaaagagagaggtctgagtccgaagttgctgctgctgggagcttgagctgagatggactggtcttcatgggcgcccaaggcgctgggtgcagctttccccgagacccccagatggaaaggagggaaggaggaaccccacacactcgccttttgcgagaagatcggcgcgcaccccagagtgccccaagcctttggaatctgcctgctgagcggagcgcgcgagcgtggtggacaggtcccgaacttggccagcgggctttcttggcaacttgctttgcgcagttctccatggaaccctggacccactgtgctcccggcgccttgcctttttttttctttttctttctctcactgtctctttttaaatttatgaactcgaaatgaagcggaaagcagatatgcgcgtcagcatactttggcggaccttttaaaaatggaactgtcggctgcggctggaaggcgcaggcaggcgccctggagagaattcacagggaggcacaggacagaacgctcccaggaacgaggaagcacccccagaaaggagcgctctatgggctccaggcagccgaggaaacgcgaacgtgagccccgtgactgcactcccacgtgcaccaacgctgccagtgtgagcagaagcggagcccgcagagcgccaggctgcgccgggagatgcatcacgatgaaaaactgcgccagagcatggcgggaactttccgagagggcgtgttgtttccaggcggttccaccttctaatatgaaacagtcttggttgattttccttgatactactttatgctcggcctggttgttggcaagtagctgcccgcgtctgtacgcgcccttgattagtttccactgcatgtgttttaacacagtcctcctttttccacgtttatttgggccaaccctgtctgcaaagatccagtttaatacagatttgagtctacgtgctatagcctggaaatgtactaaagacactacaacatattgctgaaagaatagaatctttattctgaatgcaaagcggacacctagtaaaaaattctggaataataaaacaagcaaggcttatgtgctcagttttggggacgctccaatttaaaggcttagtcattgtcacggtgtaaggtttacccattgcccccatcacacagatgtgggattgttgagagctgagtgtcctatgacctcttctgctgcccaagaacttggggtgggtggtaactggagaaatcaaagtgatcagctgcaaagaacgcttccattgctggagcttggttgtgcgggattctccacggaggtcttaaggcagagacaaaaacaaggactttgggaggctcctgtgagcagccaaaagggtttagagtcaggcagcctcaggttacaaatccagtcctgcaggctaggagttgtgtaagcttaaaaaagtgactgcacttccaggaacatcatttccctacctgctcctccttctgacgggttttctgaggacaatggaatccacactctgtgtcgaacacttttctaattagcgatgtgcagacactgtttattttacaggaataaaaatgccagaagaacccaagtcatattcatttaaagcagggtgacaagtacaccaaaatctgaaaaatcatcactaaagaacttatccatgtaaccaaaaaccattgaaataaaagtaaactatggaaacaaaatttaaaagtaataaaatttaaaagtccaaaaaa

SEQ ID NO: 1920 - DNA, 346 bp, Homo sapiens
tatgggtccctgctggagaagctgtagcatcggtaggttccgctggccgctcaccatggcagccggctccatcaccaccagccagcgagagggcaagacaagagggctgacgagggacgctaccatcacagagaaacagggtttcattgtgttagccaggatggtctcgatctcctgacctcgtgatccaccgcgcccggccaagtctgaacttttgcatggcctgttgccctggtgataaactgatgccttgtttcctaaaaggaataaagccatgagttgcctttgttcagctcatgggcattcacccatgcacagaggaaaaataaaatctacgactcgggta

SEQ ID NO: 1921 - DNA, 916 bp, Homo sapiens
ttttttttttttttagtagagatggggtttcaccacgttggccaggctggtctcgaactcctgacctcaggtgatccgcccgcctcggcctcccaaagtgctggaattacaggcatgagccaccgtgcccggccttttacagataattttaagtcaaactttgcatagttttccaagttgagttaaaattctctatgaaaataatttatctatcatttaccaaatgtaatactgaaaatatgtgaaagatactgattcacagattcaacaaacccaaagaatcccaagcatcataaatacgaagaaatactcaactagattcatctcagtgaagttgtcaaaaatagagatcataaaattagcatagaaagcagcaaaaattagatactttctcgtccatgtggtaatgtattagaacttaattcctttttatggctgaataatactccattgtatgtatatactacattttgtttatccattcatctgttttttggacacttggattgtttccatttttggctatgtgaataatgccactctgaaaattcatatacaagtatctgctttcagtttcttttgaaaacctgcttatttttgacatatcttttgtttataagcacaaatctatttagaataaagccagtggatattttatttccacaatcctttcataaatactgtaagctcttactctgagccatcaatagttaccaagagcactatataataatcagaagcagcagccagcagttatctactgacaaactcgttttttattttattttattttttgagacggaatcttgccctgtcttccaggctggagtgcaatggcatgatcttggctcaccgcaacctctgcctcccgggctcaaattattctcctgcctcagccttccgagtggctgggatt

SEQ ID NO: 1922 - DNA, 821 bp, Homo sapiens
atggttcagggaagaggctgcatttcacagagactctgtcccaggaggctggagtgcagtggcgtgatctcggcttattgtaacctccacctcccaggttcaagcaattctcgtgcctcagcctcctgagtacctgggactaggggtacgcaccaccacgcccagctaatttttgtatttttagtagagatggggtttcaccatgatggccaggctgatttcgaactcctggccttaagtgagcctcctgcctcgttctcccaaagtgctgggattacaggcgtgagccaccatgcccagccggcattttcatctggactctgccatggggctcagcaaatcagatgtgacctggtgacaggtgccaagaaggtctggcgaccacaggtttcttgtcggtttctgcctgggacccccgcacctccctaccagtattcccaacccaacgaaagaccggccaagtacaaaccaagggcagccctgaagcccaggaccatgaggcctggaaggccccaggacaggtgatttgtggccctggtgtctcaggtcaggagcagggcagagccaccttcctccctccctgtgcggggctgcatgagctcagggacctttggacctgagaaaggtcaggctcacttcctccccgtgcctgcggttggccgcagggggaatattctcctgacccgagtcccgaagccctgggcgtggagtttccctggactgggagaaagtaaacaccgagggacttgccaagaggaaatggagaagcccaggtgttctgggcggagctgagtgtcccgcagggggttccgcagctcctc

SEQ ID NO: 1923 - DNA, 1298 bp, Homo sapiens
ggcggagaagcaaaggagagggaagctggaagcacctttggcccgggacagaaatctggagagcttggctacctccatcctcctcaggccggagcaggcttcctgagagagtccaggtcgtaggagttttacgacttagaaaagcgggctgcagattccttcctgggtgtttggttcaagccttggctccagcctcactctcagtcttcccgggagttcgtgggatttggaccttagattattagtattattttgagggcctcctgtgtgtaagcactggttgtgcgcagatggctgtgcagagggccatgaggtagaggctggggaaatgagggcttggaggtgcttgaggtatggtctttacctacgtgaaatgttggaggttgagatgaaaactcttgctttgaattcttcatggaggactacatcatttcaatcctgaatctggctcaattctattattcacttattactgtattaaaaacgtttaattggccaggcacagtggttcacgcctgtaatcccagcactttgggaggccaaggcaggcggatcacttgaggtcaggagttcgacaccagcctggccaacatggcaaaaccccgcctctactaaaaatacaaaaattagccaggcgtggtggcacgcacctgtaatcacagctacttaggaggctgaggtggcagaattgtttgaacccaggaggtggaggttgcagtgagccgagatcacaccactgcactcaagccttggcatcagagtgagactctgtctcagtaaaaaaaaaataaataaataaaaatgtttaattaaccatgatatttgctttggtaaaacctttgaggtttaatgagaattttaaaattcattatacttttcttatggcatataaaagttttaattttttttattgtctcaactaacatcataaatgtcttaatgttaaaatccatgggatattctatttaaaattttagctttatcacctttgtgctatcagagaatgtgctttgaactggtaaaatgagttaaagtattggaaaacacttatgtcagcagaggctcttaaaaatcattttcatccttcctcttctagtgatgatttttttttaacccatgttttcaccagtctaccaatccaatggcataaatgctcctacataggcaacttaagtgtttcttaagttgatgcaaggtattttgcatgaggctgaattcttgttgtcggagcagaggatttttgttccaactactgaattggcaaaatgttaaatataaaaacacctcaaaaagtcaaa

SEQ ID NO: 1924 - DNA, 573 bp, Homo sapiens
ccctcggctgcggggtagcgggcagccctgcgctgccggccgcctagcctgcaccccccgccctgggagggaagcctcgctccagccgcgtcgtttccgcgccgaagtgcgatccggggccccgcgctggagtcccctgctctcaggctggtggcagttgctggagtaccagggcaccaagtggaggatgtggtagacagcctctaagatgcgccccctgccaatgatctctgcctccagggaggagctagaaggcagagagaaagccactcaggacttcccatcccagaagataaaggtgaggaaagcagcagcagcagccacaggccagtattccagagcagctttgggttcctgtcaagacctgctttgagaaggaggtggctgtggggctggagggctgggcctgttcctgagctggctgctggcagcacagcaatgaggcaacattgagaactgcgacacgaggcccagtcctgctactaaaccaactgtgtggacttgcatagtcacttcacccctcgggcctccatttctccactttggaaagcagtgttgggacgatgttaaggg

SEQ ID NO: 1925 - DNA, 568 bp, Homo sapiens
agccctgtcttctccacctagggagagagaccccatgagctcgtcaagctccttctgtgactgatcagagatcccaccgtgagtccagctcctggtcccatgctctggatatatcggtccctggcagcgtggtatctcacagaatctctgaccaatggagagctaatcaaagacaagtttaataggtgaagaaaatacttggattgggaggatggctgaaaagtcccattgaacaaggccctcaaatggagttcctgtggagtggtcacctttttgatgacttcaactgggaacatcagtacggaaccatcgctgggtgttcattccatcaccccttcctatgtccctgctcaggacaccctgcgtctgtctatatgcattgctaccagtttagacagtgagttacatttagtccatttgtgcattgttctttattgtatccatggtatctagcacaattcttgttcttattagagcttggtaaatgtcattgattaatccagggcagattatctctctcattttcgtgaatcctctgcataaacaatttgattaaaaatttatgaca

SEQ ID NO: 1926 - DNA, 501 bp, Homo sapiens
ttgttgagcatgttacagtcatcattttctgcatgtctaaccatcctagtagactgagcccttggtgtgcagggactagtgcctagcagactatacatatttaaatattaataaatgagattcaaataatttaagagaaactaatagatgtcaactaggaaaacgattaaaggatattaactttagtgatactataccaggcacacacaaaatatcatgtatctattgaaaaatggacgcttatctacaaaattacaccatcagtgaggaaatatatgactgaagaataccattaaagaacaaacagaacttactggaggagttttctgagacagctctctattcaacctgtcagtaaaactctgtattagtgtgtttcctcctgccactattacactgccatagagaccctaggataaaaatacaagaaaaatcaattagttccatatgtttccaaaagttttaaatacaactacaaatataaccatgtgctctactaca

SEQ ID NO: 1927 - DNA, 1274 bp, Homo sapiens
ctcatgtgacgcggtaacagctgcggcctgagtcactgggcccggcgcggggtgggccgagccccccgcccggccagggccacgtggcccctacccggaagaaggcgcccacccccgcaaagggaaagccgcaagggcaagacctcggggcgcctggggcccccctctggcgctatacctccgtgccaactcggggtaggagagcggggcggagcgcagcctgggtcactctggttcagagaagcggacgagggatcctagtctgagaaaaggggaggaagcccttccccgaagccacgctacccagtcaatcaagacacgtccgcgtcgggtcccgccctctgggggaggattgacaaggtctgtgcttccagcctcccagacagctcctgcatccgtctgtgatagcgagggcttgggggaagacacgaaggcaggagaggcttacatcctctggatttccccgtcttatcccagaagacaaagccaggtgagggctggaagcgggctagggggatcaagctgcctccctcccttgtgtgccaggggtggtccccagaaggagctgatctgaacaggccggagagtaggaccggccgtcacacccccacacctccagcctcggccccactccttgggctcttaaggtcctgcctcaagaaccacttcctgagtcttagtgtatgtgtgtacacaaagaatgaaagaagtctctagagctaaaggaaggagatccgggctgggctgagaagcatcttccaggatcacggccttcccgcgggacacaccaagcccattccggatcttgctcttcctgaccatggctggcaggctgtggaggaggagcggagagcagaagaaaggagtattcatcaggttccttattgtgctgccactagatgccaggcatgtgctaggcttgggggctgcaaggagaggaagacagcggccctgccctctgctagcaggcagaaccgagttctggccacactgtgaagaaaggcagaagcctgcggtggcagctggttaagctcagagggagggaaagggagaggagaatggatttcacggagcagaaggatgtgctcaaggtgaccttggagaataaaggggagagctccagggacagagaagcagtcgactgtggaaaaaaaaggagcattttgtaaagtacatggcaggttggggttggctggctcaaagggcttgggacggatgtggtgagatgggctgaaggtggtctgaagatcaagattgagagactagatacataa

SEQ ID NO: 1928 - DNA, 423 bp, Homo sapiens
gttctaatacttttgagctactgaatctgatccaggacagcttacctttggacactgactagaaacctgtattccttaagtgcctaagatccctggtgccaagacacttggggacctctgatccacaggacctaacggcacccacagcacatggtaagtgctttgcttattgagtgaattcacagagtaaggtcagtcagtccattatttattcaaggatttttggaaagttgaaaaaagcatggcttgactaatgacagaataaaatttaataggactcatatacagttctggtaaaataagataaagttttcagccactactaagagatttttattttttttaataataaaaaaagaagattacacagacatcccccattattatgtgtttgtttctctcttgaaagtctgccttctggca

SEQ ID NO: 1929 - DNA, 300 bp, Homo sapiens
accacaaggcgcactcgttattagaggccagagagggacagatgcttggtgggaattgtagtgcgaagccaagaggctcccccctcccccccttcccccctgccccaagtgcttagaccgaaggcggcgctgcgccaccgggggacgccctgggctcatttctctgacagtccttctactagcttcattttccttgtcaacaaaatggggataatcacatctaccttggaattgttatgaggatcacatggagaaacacaagtgaaatgctctgtagatataaagcatgtatcaacgatg

SEQ ID NO: 1930 - DNA, 1467 bp, Homo sapiens
tgcctcagcctcctgagtagctgggattacaggcatgtaccaccatgcctaattttttttttttttttttaggagggatggggttttgccatcttggccaggctggtctcaaactcctggcctcaagtgatccacctgcctcagcctcccagagtgctaggattataggcatgagccactgtgcccggccacgggctggactctttagccagccccaaatcccagccacatgactttggctgggtcactcctttgaggcacgaagaccacgtcacttggttgcatgcttgggtgcccagtgggacaggtatgagaagacccactcaagagtggtgagaaagaaggctggctaggaacccaggtggggcaggttgtctgcacgttatggctattatgagcagtgctgctatggacatttacatgtacgcacgtctttctgtgagtatatgttttcagttttcttgccttttttttttttttttttttttttttaagacagagtctcagtctgttgcccaggctggagtgcagtggcacgatcttggcttactgcaacctccacctcctggattcaagtggttctcctacctcagcctcccaaatagctgagactccaggcatccaccaccacacctccctaattttttgtatttttagtacagacagggttttgccatgttggctacgctggtctcaaactcctgagctcaagtgacccgcctacctcagcctttcaaagtgctgggattacaggtgtgagccactgcacgcagccatgttttcagttttcttgagggagattcctaggagtagaattgctgggctgtgtggtaacttccaggcctccttaaagctttagcctggactgggtagagcatggtttccactgcattctcttagtcacagtgagttgcaggttcaccccagcgtcagtggcgggcgggaagtggggatgacacaaggacctgagtgtccaagggggcttcatggagccctcatgtgaagtccccagcatggaccctgacacatcgtaggtcctcaacaaatgtcactccctgttgtcactctgtttagtactaagaataatgatataaaactgggacagtaaggaaaacacaaactgttgggacctatatctgaatctattagtctgcctaatagaaaagccaccatcaggattttggagattacaagctcactttagattagccatactggagtcagccctggaggctcccagagatcagaacaatcccagcgcttgacaggatggctgggaaacaatacatatgaatgccggaaaatgcagaactaatctaggaaaaagtgtaagaagaaaataaacatcatctgtcattctatctatcagagataactgctgtcaatattttggtttccttccaatattttttctattcactctgtgcataagtatgtatattttaataaaagtataattaagatcac

SEQ ID NO: 1931 - DNA, 695 bp, Homo sapiens
tgggaataatgtcaccaatagcataagaattaatgtctactatgatgctgaaataaataaactggtaaaactactctgctgtctaaatccccaagttacaaatttacagagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattaggaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatccc

SEQ ID NO: 1932 - DNA, 609 bp, Homo sapiens
gggttccgcttgactctgcattctcctacttccctgcctgcttactctctgccatcatagttttttgcttcaaccttcaaatgtagccattctttttctaaagcgctttcatcgtagcttcaggtggtgtatatgcaggctgtgatggaggagaagctacccctcagcacaggattttggtagaataagaataaaaatgacaagtcccttcctgaaaagctcttcattgtctcttgaaaacggtctgtgaaagtgccaaaccaccagctctccagatgtggctgaatatcaaggaaaatatcttacgtgcaaggaataaaaatgccagatgaaggcatcctcacatggtggaagggacagaaggcaaaaaagggaggaacactgtgtcctcacatggcagaagagcagaagagaatgaactcattccctcaagccctgctagaagggcactactctcatccactaggactccaacctcacagcttcatcacctcttaaaagccccacctcttcatactatcagttgattattaaattccaacatctgaatgttggaggacacatccagaccgtagcatccctcaaaaaaagaataaagatgttccatag

SEQ ID NO: 1933 - DNA, 513 bp, Homo sapiens
ttttagtacaagtggtttatttctcttccaggtgaggccgcatgtatataagcaaaggtttgcccacctggttccttcaggaactccccgaggaatctgtttagtttccatgcattaaaaacaaccctctagttgccaataatgaaactttaagaagcaacactttgacgtcgcagagttcctctctgcatgtgacgcggatataccaaagtgagtttatggcatacagtatgcatgggttaatgtaggtgagacagggagtcccggctgccctgtggccccattctgttgtggaggcttcgctgggagctgagaacaccctgctgtccatgttttgatgacaggtggttcttccaaaacagaagcaccgagtcaccgcacgcccctgcttcagtgtgcgaggccgtggggctctggtgttgtgaactccaggctggcatttaaaaggtgctgacttttaggctgggcgtggtggctcatgcctgtaaccccagcactttgggaggccaaggc

SEQ ID NO: 1934 - DNA, 812 bp, Homo sapiens
gaccccagaggaagacgtgcattgggtccgctggccccaggccagtgtctctcagccatgtgctcaacacctggtgagctgaagctcaggcccttcctggcatcctggtctcctgcactgagctgtggtctgcagcggcatctggcatccaggccagcctccttggtgggccgtgaactgaatggtggcgctggcctgtgcccagtatatctgggttcggtggctgagagagcttttgttgccctgtgtccgtgacgggccagtgttctgcatgcatcccatcacatggatccatggaggatgttgagcccagaggaagacttgcactgggcccaatggccccaggtcagcgtccatcagccaggtgtccagcccctggtgcactgaagatcgggcccttcctggtgccctggtctcctgcattgagctgtggtgagcacatccggatcctgctggatgcgtgtgcggggaagggggtgccctgggttgggtcaatgagaaccttatattgtcctgaagagaggtgataacttaaaaatcatgctcaataataggattacgctgaggcccagtctaggtgagaggtttggaagaggatgctgggattccgaggtccccaggagggcccctgtatttttggctggagacctggaggccctgaagggcatcttgtgggtgcccaaccctgtctctgcgctcctccttgaggcagcccaggctccctgtgcaggcttggtgtcagccctccagttccctgggtttgaggcacatgggaagctcctttctgagccccgttctcctcttgtgtcttt

SEQ ID NO: 1935 - DNA, 2597 bp, Homo sapiens
acgcatgcgcaaggcttgaatggcgtcggggttggagggttggaaggtcgggaagtgaaggactcgcaggcatatttaacaacgcaaagttgctaggagttggtaccagcgtttgggaggtagaggtggcgctcatgcatatttgagacaacatctggatggttggggagaacggtgatgccacactcaatcagaaactatgctactgctgaagaggtatattgagccctgcctggttaacctccagtgaggttattagagaattgggagaggctcaaatcagcatcctgcacctagttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggtaacatagtgattaaggtaagtagggaaagagaggcttactttgccctgattcttgtcagggaggctcttagagatgccatttccagagcataagtgacaggccagcattttcaaagcttgcaacttattctataatatatccttcttaaaacaattcatgtagattatatgctcacccagtctgggatcactcctgcagaagatcagaagaactgaaatataggtgacataagctcctgcttttgtaaatgttttgttgaaacacagttgtgttcatccattattgtcgatggcagctttcatgctacagcagagttgagtagttgggagagaaaccaaatggaccatagagtttgaaatattactgtctggcccttcacagaaagtttgccaattcctggcataggttaaataaatgtactatatccacaaatcctcctctccccattttcctttcaatgggacttgcatttacagttgatcctagaatgtatggaatctcatagtaatcagcttgcttctgaatttcttcccactcaaattaagctcactcagaaagcacattcacaaattgggctacatatacagaaggagctatgttttatatgcctcactgtagtcaactcatttatcctatatgtatggttcccccattttttccttcttttcaggggtaacttttaaacttgagccattcatgagtatccaaaaagttacaacttatgttctctaattaagacttcatccttattttagtatacttcccctctctggcttttttgcatatttctgcagatgtcttgacctttctggggagtaagcccccttagaagattaattttctgtagttctctattgaggaaatacatgacatttagctttttaataatttgatgccattcattgagtacctactgtgtgctttatgtaccctgtctcgttgaatttttacaaaaaactgaaagagttagttttgtgttattactacctccatctcaaagatgagtcttggaaagcttaagtaactttaggtcacattgtaatcagtggcagaactgggacttaagaacataattcatgactgcattttcttttctttctttctctttctttctctctctctcttttttttttttttttaaagagatagcatctcactcactatgttgcccagactggtcttgaactcttgggctcaagcaattcttccacctccgcctcccaaagtgttaggattataggcatgagccctcatgcctgccccttgcattttctatttaagtgatcttgaagtttttttttttcttttttaaatctcggaatttggcctttagtaagcatagaatagcaaagtgtaatacctgagctgggggaaaaagtccttgaattctttaggaaagacttaattggtgggtacaaagtgaaatgctcactggaatcaggaatcagaaaccagttctgatcacctatccctacatatccttcttcactctgccctggcatatcatggttgatgtacatagcaatgatcatcccttctgtaatcccacttgacagtttagaagtggattgataatactcttctggcttaaaacccttcttctctgggcaggtgtggtggctcctacattatcccagcaccttgggaggccgagatgggaggattgtgtgagcccaggagtttgagaccagcctgggtaacatagcaagaccctgtctccacaaaaaaataaaaaattaactgggcacggtggtgctcacgcctgtaatcccagcacctggggaggccgaggcgggtggatcacgaggtcaagagatcgagaccatcctggccaacatggtgaaaccccgtctgtactaaaaatacaaaaattagccaggcgtgatagcaggcgcctgtagttccagctatgggaggctgaggcaggagaatcagatgaacctgggagacggaggttgcagtgagctgagatcacgccactgcactccagcctggtgacagagtgacactccgtctc

SEQ ID NO: 1936 - DNA, 2049 bp, Homo sapiens
ggctgctgcgaggaagacccggtcagctgtcccttcccccatcggtcctcttaggggaagtggagatgtgggcctcggagctgcgtggcccgggctgtgcggattccctaaacgccgcacttgcgcacagccccttacgtaaccgtcagtgccggggattccctggagggggtcattctattcaaccattatacacaccccgggctcctgccgccgcgccgccgccgcctcacaaaatggcggcgcccatagaggagaccgcggccgcctccccggccccattttgtgggaggcgagagatctgtcaacatggaaaacctctgctgaggatgcatccgagtttggaaaccccacttaagggatggagcctgggggatcacattaaacggaaaatgccaacgacttctaccacctctacgcgtttttagtttttcattttctcgaaggaagcgccagaagcctgtggagtaattgtaactagagggagaacggaaagctgaggtgactgctccggggacttggcgcggcgccttggtggctttggttgctcttccacgctcccggcagctgaccagaatctcttggagggtctcctgggccacctcggccgcgccagtcgtgcagtgagacttctgtagttttaaaatgccacagtccacggcccggtcggcaccgctcgcctgaatcgtgggctttgggaaccttggaggctgctgctccaggaactcgcggtcggccgggagccggggagcttcgttgctgggagcgggcggtattcgcggactccggcggccctggcgggtcgcggccgggatccgagccggggatgacgatgctgatggagctgatggggcaagagtgggaacggaggcacgtacactgaaatttaagtcatccaagttgggacttaagatagcaggttaatattgtctcaggcgagacttagaacgtcttttctggtatcccagtctgcagtgggcaaatctattgtctttatttctcatttaagggcagaatggagggatgacatatttttacttttcaagaggcggttgccacttttaagtcactgttgtgtgtgtgtgtgtacatacacaaacatacgatagtgtgttttcagagcaagtatcaaaggctaaagacttggagtgatactagtgtttaaaagcctttttaaaaaaattaagatgtgatgagaaactggagaattgacttttaaaaatttcttttctgtagaagaggctatcttcaaaatggagtcctaaagtatatctgatggatagaatttaaattcttaacactgtatataccctgtggtcaaaagcatcaacgtaaaacttgatgtttatcagattacttatgtttcaattttcctgtggttagaaaaattaagacagaagtaagctattaacggtatttgcttgtaagagtaacgttaaaggtttaaggaaaggtttgttgaaatcgatatgcatcacacgaatcatttattttcaatgttgttttccagttgcagcaatcatttgtgtttacatgactttgaaaaagggtttagtttatgttgattttgaccctcttatttaatctctagtgcagaagtgcagctttctgcaggctgcgcctcaatcgctaagttccactctccatcctctgccgcgctactcctggcatgtggatcaccaagatacaatttctggtcctgtctgttcttattgatgtcctttacagttaataaatttgattgccactaatcagtctgtatctcttgcaaaaacaccacatttagcatccaagtagagtcagagtatgttttttatgagattgtactaaagtaaccttctattacatttcttattaccatattgcatttcctatagtgggcagcatagagcaggtggatcctgacaaagtaatgttagagatgtgctgacagctttacaatagatattctccaactaatttgacaagatataaaataaaatgtagttcgtagttttcaagcattaatggaaagtgttcctattaaaaaattaccaataacagtggaaa

SEQ ID NO: 1937 - DNA, 2209 bp, Homo sapiens
ctgactctgtctgggcattcttcctgggctagagatgctctgcctcccagcagaagacaagagccctagaaagactgtcattcatttactggagagagaaatggttcatctacacacacactcagagcctggctagctacaaagccgtggtccgtggtaggatgtacgtcttagtggaataagtaaccttgagcagacaatggatccagcagtaacaagcctgccctgatgccggcgtaaattccgaaggagctggagaacgattcttcccttcactttatctaaatcctctgaaggatgagtgggaggatggtttcttctcccttcctgaagcttgttttgttggtgccttatgctaagagaactcagcagatacaaatttattattttcttttagacagcattttccctgcagttagaagaaaacagcagctcacattgaaaaatatctaattcccaaaatacgtgtttccaatagggagtttatagaatttgcttcttaccaaagcaaaatcttgaatacatgaaatctaaaatcttgccaatttaatgaatgcctaataatttttaaatagcatatatcattttaatacattaaacagttggaagattgttgagggataatttgtcaattttttattaaaaagaaaattcataaaaattaaatattctacatttattttatattattatcttggcaattttattttttatgacaaaattctgagtctgttatattatccaaatcctaaaaagatttaattgattacagaaaaatttattgggaaaaattgctttgcccctcttttttctctaagcaattcctgagttttaaaaatactccttaaaggaactaatttatttttcatggcccatcaccaatatccaagagagtatccaatttttaaattctgaaccctgtcttgtgtgactttcaaactaaatgaaatgaagaggcctcaggcagtctgtgtttacacagggtggcaaaattaaccttaagttacttggatcactgcactggggacacttcagagcctctactcaggctacttttgagcatactatgtatgtcgctgtgcagaagcctacctctttcactctagataaaacaagactttctgagcacttactctgagcaaagcacggtgccgcaagtacaaaggtggataagactcagtccttgatttgatggtctttgttggaataggttttcaaactgtaatgtcactgtgtctcccaggggccaaaagtttgctttcattgatgggtttcaaagtagggatgagtttacttataagtacacattgtgtcattagtatgcttgactctccatggtgcaaaatttctttctaatgctgatcaattgcaaacatgatagaacaatgaaatacttccaggacattctaaatcactctcctccttgtgagaaaatagggtagagagcctagcctggtacaggcagccatccatgtctgatgtgggtcatctctgagaatgacactcctcaaagggccagagggtgctctttcttcatttcccttacacatgggtgttattcaatacttatctagagccatgtgtcacttaacaactggaatatgttccaagaaatctgtcattaggctattttgttattgtgtgatcacagagtgtacttacacaaacctagggtggtatagttcactgtaccaccaaggccatatagtgtagcctaggctacaatatacctaggctatatagtatagcctgtagctcctaggctacaaacctggacagcatgttactgcactgagtactgtagcaattgttacacagtggtaactatttgtgtatctaaacatatctaaacatagaaaagatacagtaaaaatacagcagtataatcttatgggaccaccgttgtatatgtggtccatcgttgatggaaacattgttatgtggcacatgactgtatatgcttcgtatatagtgaacattcagcaaaggttttcatcaatgaatggataaattggcaacttttatgggcttaattgggctaaaatatatacggagtcactatttgacttaacacctagacattattttactgatatttttcaataattctgtttttgtaaagccttccttccatttgggtgcaatttccacttggggaaaatctcattccccatcctcttgtaattaaaaagcatggtttgtttgtttt

SEQ ID NO: 1938 - DNA, 5570 bp, Homo sapiens
aggcatgagcccttgggcccagccggctgtttaatgttcttaaatagcacaagggacttctatgaactttcctagatgaaatatttattaactactaggtaaaacacttgtttgatactgcaaagggttatttctgaaacttaaacctcatgattggccaaccaagaactttttctccacagcatgctttaataatgaaatgcggattaagagtccaatattataaaacatttccacaaaagaaagaatccatctgattctcaactctgaatgcacatttgaattccctcggggagcttttaaaagtctaatgccccagtgtaccccccccagttaattaattaaataattctctggggatgagaactgactgacagcaacacttaagcttcgagactgcagtgtgcagccgaggcccactcctccagcgtcaccacctcgtctttatctgccactgtgtctcctcattgcccacagctttagcaacagcaaaagtagaattcaaaccttggtaaacaaggcttaaattattactgttcatgaccttaattaattgaaaatgattactggtgaccacagcactccatgctcttccttatggaaaaagggttgcctagaagatttaggcaatactgggagttcttatttgaagtcacagaaaggagaaacttttctcaagccgtttttattacacttagtgtattaagacaagtacaaaataaccttgtaattaagatactgtatcagtcaaaaaagaagtcactattgtatgaagagatttacaaatgactaaaatatacaggctgtgacagaattaacagtttgaaagagggttgcttttttcttttagaaatgctaaattttcttaacaagacaaaaatacagtgctctaaatatgcattaccatgaaaacgttaaagaaaagcagtcttaacacttaactactattaacagcctttgccaacacatgcctgcctactccctttcctaactttaaagaactgtttcctctaaggaatactagtgcagcataacccttaaataatttcatttatttttaaagttacaacctacagagaaattaacatcttgtcaatctaataacagtggcaaccattcttcacatgcacttctcttagaataaatccccttggctggcaggataaggcttatgctgtagaaccttctcccccacagccacaaatccccttctataagtccctcctaccctcatccccccgcatccccactggcattcacctttcccaccccaaaaagtgcagctcatggtagccttctagaaaatggttttaatgggtatcccagcatacacgcttttttaaaagccccctctgaacaccagaggtggtgaaaatgaattgtgttcttggatttttttttttttaagcctccactgggtcaaaaatatgtgctcttaatacttgagtttttgctttgtgtgtgggttttctttctttttcatttagatatcgtgggataaagtggagaggacatctccattttcccatacaaactgagggtgagaagagaaagagaagcaagctgttgcccccactttggcctggcttcccagccatcttcccagctctggttctttcataggaactagttattgcttccacaatgccgttatacggaatgttccacaaaggctgtgaacctagtcacagtctacccacaacaagaactctgctctgaaaaaccagcccaagagctcttacccagaagaacaatctttagccctcaaggtcactgaaacttcattagagcagtttagagtagacgtgtaagatttggcatatattaaatgattattggcacaatgttctccagttccatgtataaatgttgatatgcacatcggccagggcccaggatgaatcagccaatctgcaccatttttatgtcagcaataattccatctcttccctttgagcactgtagggagagctgcttcatccggttctccaaggcctggccctcaggggaggtgctgctttggctcttactgctgccaccactgccactgctactgctgaggccccggttgttgttggctttgtcacttgttttattctctgccccttctgccctgtctcctatagaaatacaaggattatcaaaagtgagtattgacaattctgccctgtctcctatagaaatacaaagattatcaaaagtgagtattgacaattctaagtcacttgagctcaaaccagtcagctaactcagccctgtagaagtcccactgttacctaccgtgcctatcagagaggttctcagtacataatcatttactgcttttattccttgtgatgttttatatattccttagctatagagatgaaatttgccatattcactttattgctgagaaacaaacctctctactatgtgcttgccaaggagactgttctgatgtgagacataggacctaagctctactttatagaagctgagtggagccaggagcccccccagaacagcacttggaaacaacctcagtgatcaatactgacagcacaaccacagagacctggtaatgcagcatgggggccctgagacctggcagaggtatggaatggcacaacagtcaggctacagaggcagtgtggcatctgggacggggtgagaaggctgctactcacctcgttctacttcacattcaggggaggaggccccgctgcattcacttcgagggcccaacactgggaacatcatcccaaactctgacagggacacagggctgggcagatccaggctgccaggcctcacaaccgcagggaactggtcaggcatctcagacgggcttgttggtcctgaactaaagctggacacggactgggtttccgagtcatcttcagacacaaagttgctacagctgtcatcttcaaaggcctccgaggccactaagttgagagagaacaccagtcacatgggttctgtcacctcctcaaacaccacaagtgcttgctgctggcaggcagctagacacagcatgggggactaaagagtctctacctctgtgagtgcctaatgaaggaatgtgacttcccaagcctgaatgaccagcctctaaagcagctggaagggaagcagctggcagcaggatcccatggatattaagcgcccttccaataaccttataaccctgccaagaaatcagtgtcaccagacaccacctaaaaatggaagattaattcagccacaaattaggacctttactccacctcagtcccccaaatacatcctcatgtgcacaggaagaggttctagtcctctgtaacatatcccaaacaaagccagctggactcaggcttctttcttagggcaatagaagcaagagctgctagaagaaacaggccagcatggaacatctgttgggacctttgttatctccagaatcctgactttgaggaacacttagtaccttcttaatgaacacagtgttccataaaacatgggaacccaccagaaatagccctcaggcctgcccaactctgagacctttcactgatggccagagaaagtgaggaccttgggaaacaaatcacacagtctgatatctccccacatacccagtggagcccctgacttaccagaaatggcatcaggctcaggtttgctccctggcagatcctccacagatgtgctgctgccctcagcaccaacaccgcatccccgaggccccatggcactggagcgccgccgctcgtggatctcatctgagatcatctccaggttcttcagggccatcttgtactcgccttttgccagggtcagtttggcctgcaggtcatccacagtctttttcagttgctgatcaagagaacaggagactaagtgaagactaccctgctagccttaagatgctttctgaatgacaggttcaagtacattttctgcccatcattctacttcaaggaattttccaagacatgactgaagacctaattaccattgtaactgctattcattcaccagacaaaatcagccaccaccatccccagatcccatccaggtgacaacctctaatatccaaaaactctcactggtggaacaaaccccatcagggaagcaaaaatgggcatcagacacaccaaagtcccacagtctagacatctggttcccagtacagtggttctcaaagttgagcttgcatcaaaatccccttgggtgttaagactcagctcactagactccaacctcagagtttctaattcagtcggtctagagtgggacctggtctatcaggtctccaggtgatgctgatgctgctggtcctaagagcatgctgtgagaaccactggcctagtacaacagagaaggtgactgaatggcagttacagaggttcagagaccactgaagacccaaccgagacaattttgaggtctgaaaactcagtaaagcctgtctctccactttccccttatagcaagtggcccatgtgatactctgctaccccagaaaagtgaagctttgagtgcagaaaaatctcatcagtgacgaagcccaaagctacacatacctcgagctgcacatagtactttgccttgagttcaaaataaggcctgcagaagacaggaaggaaagccatcagagtaatataatacagtgaccacagtcaactccacaagatgaacaagaggcatcagctaccactggccaggtcgtccttccaatatttagtaaactcttaacaaggccgtgacatgtcagtgatgctcctagctctggagactgacagacaccagatggaacgactgggctcacccagggctatattaacaggaggcccatctcaagacacggggaacccacacacacatatcttggggactctgcaacttagctcatgttcctcctctgtgggaaggctgttcagagcctcacaggttatacccagcagtaagggtggcctggatctgctctcctaatgaagttggctccccagggatgaagagcagctgaggctggagaaggggctgcttaaacctcctcctctactgaagtcaactggggaagagagagaagcaccactcctccctcacagcacagcaaggccaccactaggagggggtctcaggttggtcctcccaaaccttgtccaaagactggagttattagttggctgactcagccacataatgggcccaagaaatgccagcgtcctagcagttcccttggttctgggtcagctgaaagagcttggctcttttttaggaactttggtgcctgaacattaagagtagatcactgctttattcttgagctgttcaccctccatgaagctctcaagtcctgcatcctgaggatccagatggatgacaaggacacaggactgccattgagaaatgaagatgaactgtgtcacagatgcagtggattactgactgcccttgtaatagtccattttgcatctgttggtaattcattgaggcactcttggttttctatgagtttgtattttttgaattcaagaattgtaacatcactgttagatccctccttatttaatgagagaaataaaatatttgacacgagaaaa

(The sequence listing continues in the following parts.)

The invention claimed is:

1. A method of detecting a level of expression of one or more lncRNAs in a subject, the method comprising
   (a) obtaining a biological sample from said subject; and
   (b) detecting the level of expression of one or more lncRNAs in the sample, wherein the one or more lncRNAs comprise 20 lncRNAs of SEQ ID NO: 0190, SEQ ID NO: 0359, SEQ ID NO: 0776, SEQ ID NO: 1421, SEQ ID NO: 1795, SEQ ID NO: 0477, SEQ ID NO: 1511, SEQ ID NO: 0435, SEQ ID NO: 1418, SEQ ID NO: 1025, SEQ ID NO: 0265, SEQ ID NO: 1311, SEQ ID NO: 2540, SEQ ID NO: 2323, SEQ ID NO: 3011, SEQ ID NO: 2447, SEQ ID NO: 2863, SEQ ID NO: 2697, SEQ ID NO: 3128, and SEQ ID NO: 2265.

2. The method of claim 1, wherein the biological sample is selected from the group consisting of: whole blood, serum, and plasma.

3. The method of claim 1, wherein the lncRNA expression levels are detected in the biological sample using a technique selected from the group consisting of: polymerase chain reaction (PCR), reverse transcriptase polymerase chain reaction (RT-PCR), and reverse transcriptase quantitative polymerase chain reaction (RT-qPCR).

4. The method of claim 1, wherein the expression levels of the lncRNAs in the biological sample are detected using a singleplexed or multiplexed method.

5. The method of claim 1, wherein the expression levels of the lncRNAs in the biological sample are detected by measuring the levels of cDNAs, amplified RNAs or DNAs, or quantities of DNA probes that are indicative of the expression levels of the lncRNAs.

6. A kit for diagnosing heart failure with reduced ejection fraction (HFrEF), comprising at least one reagent for the determination of expression levels of one or more lncRNAs, wherein the one or more lncRNAs comprise 20 lncRNAs of SEQ ID NO: 0190, SEQ ID NO: 0359, SEQ ID NO: 0776, SEQ ID NO: 1421, SEQ ID NO: 1795, SEQ ID NO: 0477, SEQ ID NO: 1511, SEQ ID NO: 0435, SEQ ID NO: 1418, SEQ ID NO: 1025, SEQ ID NO: 0265, SEQ ID NO: 1311, SEQ ID NO: 2540, SEQ ID NO: 2323, SEQ ID NO: 3011, SEQ ID NO: 2447, SEQ ID NO: 2863, SEQ ID NO: 2697, SEQ ID NO: 3128, and SEQ ID NO: 2265, wherein the kit comprises:
   (i) one or more oligonucleotide probes comprising a sequence complementary to a region of the one or more lncRNAs which form one or more probe-target nucleic acid complexes; and (ii) a reagent for purifying the probe-target nucleic acid complexes, and wherein the oligonucleotide probes are biotinylated.

7. The kit of claim 6, wherein the reagent for purifying the probe-target complexes is a streptavidin-coated substrate.

8. The method of claim 1, wherein the biological sample is cardiac tissue.

9. The method of claim 1, wherein the biological sample is PBMC (peripheral blood mononuclear cell).

10. The method of claim 1, wherein the lncRNA expression levels are detected in the biological sample using microarray analysis.

11. The method of claim 1, wherein the lncRNA expression levels are detected in the biological sample using serial analysis of gene expression (SAGE).

12. The method of claim 1, wherein the lncRNA expression levels are detected in the biological sample using Northern blot analysis.

13. The method of claim 1, wherein the lncRNA expression levels are detected in the biological sample using 51 nuclease protection assay.

14. The method of claim 1, wherein the lncRNA expression levels are detected in the biological sample using a hybridization technology.

15. The method of claim 1, wherein the lncRNA expression levels are detected in the biological sample using next generation sequencing.

16. The kit of claim 7, wherein the streptavidin-coated substrate is a streptavidin-coated magnetic particle.

* * * * *